United States Patent 10,113,201 (METHODS AND COMPOSITIONS FOR DIAGNOSIS OF GLIOBLASTOMA OR A SUBTYPE THEREOF) - sequence listing, part 6

SEQ ID NO: 63 - DNA, 152475 bp, Homo sapiens
gtgaagttgtggtatgataaagtgggacaccagctgattgtaaatgttctgcaagcaacagatctacctgctagagtagatggacgtcctcgaaatccctatgtaaaaatgtattttcttccagatagaaggtagtgaataattttagaaaaaaaaaatcttaaaatctgtactaatagaaaaggtagaattttctcttttgggatgtttttaaaaaatataatagataattctgaggagataaaagtacattatctctgaaaaaagaagtccctcaagtgttggaaattgtgttggaaatatttgaaaataatctgtcaattaaaaaaatctattaccttgtttataggtatattagtctttgatagcgacacatcatttagaatgtacctttgtatgtgtccctataattacaatactgcttatattgtaactgaagttagaatattattaaactctattatctttttatagactttccatgagttattagttaaaataatataaatatcaatggcagttttacatgtaactacagtagatggcagcatgtacttgctttttcatttacaaaacatacttatttttcagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagaggtgatgtatattttaaaaactcaagtcaaatagttaataaagttttgtgatatttattatgattactattacattatgttttgataaaggtacttgatttaatttgagaattaccctctcagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagtaggttaaggtccttttagttgccacaaagtaattatgctgtaatgatctaattagtgattaataattcaagatgttttttttaaatgttttattagagatcaaaatactggaaaattgttcatctttatgaagcaacttggcaaaactgtttctacattttcacaatgaaaataatgtagatagcatagcagagtaattgcagagctgcaagccaaaaacctctgaattaaaattcttgcacagggccaattgagctgttggttattgactgatggaataatttctgtcatcactggtgagttgccacctgtgaagtcttaataactttatagttcaaagattttttctccccccaccgagagagagtctcactctgttgcccaggctggagtgcattggcgtgatctcggctcactgcaacctgcacctcccgggtttaagcaattctcctgcctcagccactggagtagctaggattacagaagtgcgccaccatgcctggctaatttatttttgtatatttagtagagatggggtttcaccattttggccagcctgatcttgaactcctgaccttgtgatccatccggctcggcctcccaaagtgctgggattacaggtgtgagccaccatgcccagccagttcatagatattttaatagttattcataagaaatgttgtttaaaatattagaaggtatgtttattgctattcatctagtgattgggaaaagctatttttttctgtacttattgagtaatttttgtgtcataactacatttctaagttaacagctgaaagaagcctcattttggtaatctggaactaaattatttttctcacataattaaatatttcatgttgatgcttccctgatcagtaatttcctcaaagttaatgtttaatgaagtataatgactaatttggggagctaaacataaatattttataaagggccctgatgttttttcattaatataggctgaatagagctccagccaagaaatgtctctgaacctttccactcagccctattctctctgaactgcagaggaaagcacttaattgtgtagaaaacaatgtactgtatatactgtgctgaaggcttttagtataatattttaattaaagaattaatctgaaaatcttattctgtgaagtccccttgtttctatatgtctttggtgtaatgaggaaaaaaatactgataaaatgttatccttagagaacaaacatttcttttaaaattagctcagtgtttactgtattagtcttcataagttttcagtaataatgcaattcactttttaaaaaaagtttgacagtgctctttacgtttcataaaccaaccagacacagaagtatctctttgccttactgttgtgcaggatctcagcgaatcagtgatagtgacatctcagattatgaggttgatgatggtattggcgtagttcctccaggtgcgtgggtgaggagcatgaccctgcttcactgtgctgctttgcttgttttctctgtcagcttccggacctctttaggatactaaactgaagatttatagcacagagaaatcagtattatattattccatggtgacttacatttcaaattattaagaaagttttaaatggactagtctctactaattagcattcccatagtgaggttcttccgtagaaacatgtctaactagtgaaacaaatcattatttcacaatgctctgagcgtaagtgaaaatacgaattttattttgaaaagatggggttattaaataaaaattccatttttctgtgttttatatttgcatttctatgattttccttccaccatttctgaaaataatgtagccctccatggaatatactgagaaaggtgcatggcggggtttaaaattgcatgtggcatggctgtaacttttaaagcttttgtgatgtgttcccactgattatacctagaatgtgtgtatatgttttaatacaataatatgtttaagaaagattaagtattaatttgaagtgaacatctctttgtcattgtgtaagttagtaaaacttttgtgatgttgtagggtttaaatgtttctcatctgacttctgtcagaaaagtgtaaaatcaagtggtaaagacttactttcttggcactaattctatactttttaaaaatttactaatgagaggagaagtaaatatgcaaataagaagaaatgaaagagacagtcttaaaatgtataaatatgaattttaaaggcagtttttaaagacagtatatatatatatgcccttgatatatatgccctttatttacataatttctcagatggcagtgtacttaatttgagggcaatggttttgctcaaattggtagattctacgatactaacttcacagtttggagagatgcatacaactattaaaactgggagaaaattatggagagttctctaaaatcaggtttcatttgttccctataattcagagaatatatggtatttatttatttatttatttatttgagacggagtctcactctgctgctaggctggagtacagtggcacaatctcagctcactgcaccctccacctcccaggttcgagtgattctcctgcctcagcctcctgagtagctgggactacaggtgtgcaccaccatgtacagctaatttttatatttttagtagagactggatttcaccgtgttggccaggatggtcttgttctcttgacctcatgatccgcccacctcggcctcccaaagtgctgggattacaggtgtgagccaccatgcctggccaaaaatgtagtatttaatcactgtgtgaaagtagaaaatattgttaaatttattattataaatctagtgctgtgaaaatctatatacttatatattaacctttgatgtcagtgtatcagtgagagatttagatcatactggagagaaattcacttttgctctctgtttttatttcttagaaggccatagtaattacacacattctcaacagaaaggttcacacaaaatgtaacatcatattagtttgtcatgaaattcaaagagtaaagtgattataaatttaaattcatttgggatattcaaataggaattagattatacctggtagaaaaatcatcacctctaacaggaatcttaactattagtcagccttaatgttgtcattaccaatttatctaaatagaatttgcttcggtgagtggttcccaaatttcattcacctgaaatttcatatttttagttatgagacagggaagtaaatgatgaataaataaatggccaattaaataaatgcttgcacaaatgatgagtttcttcctctttctctgagagagcaacatggataacgccttgtgagaagtcaaagtgagttatggaatccactagagatgggattagtgcttgagtaccaccaaggagcactgaattctaaatatacttatattccatactgaaatataccatgtccctcaaagtgtttgcaaacatgcataatctctgttatcatacaaagcaatatttttcaaataatattgttcatttttatttagcatttaaaaatgtaatgagtcaaactttaatagaatatgactagtaacttataaaactgataagtaatattttatgtttcaaagatctcctcataaattaaaggagagcatgtaattcattaatattttcagatatactcttcattgatccattgtaattatgtggtagtatttgtatggcaaatataactagtcacatagtaacatgcaatacattttaaatgaagaggaaaaatgagtcagtaaaataagggcaagaagctaaaataaagtgaggtgataagttagcacagtgcattcttatgtacttttagatgttggttacaaatttgcgtctacgtttcctagcatccaatatgaagaaaaaatttgtttagatatggaagtcgtcttctatatatgtttaatgtactcaaggaagttcctggttgtttattatctagagaagctcaaaagctctgtacaaaatgttctactacagccaaaacttaaacttcctaatgccttggcttttctagaacacgaaattctctgtttttatttgatgtgtttactatctttttccagttagggaaatgtagcaggttttcagcagttgagactgccagagccacattttattaactttgtagttatagccttattgttatttaaagtaaataattttagctagttaagaagaataaaaataaccatatacagaatgccctcatctgaggtgaggaatctagcaacttcaaccagaaaatgagaaaaaaattctctaatctctaaccctgagtcaactaaaacactgggattaccataaaatagtttcatcccagccgggcacggtggctcacgcctgtaatcccagcactttgggaggccaaggtgggcagatcacaaagtcaggagttcgagaccagcctgcccaatgtggtgaaatttcatctctactaaaagtacaaaaattagctgggcctggtggcgcacgcctgtaatcctatctattcaggaggctgaggcaggagaatcacttcaacacgagaggcagaggttgcagtgagccaaggtcatccagcctgggtgacagagcgagactccatctgaaaaaaaaaaaaaaaaaaaaaatttaatcccagtcatggttctgaagatagagtgcatgttgtcaacaataacgtaaacataatgtgaagaaaatcaaattttttgtaaaaagcaactataaatgtaaaaagcaaagaactttttctttgtaaaatgcaaagaactataaatgtatatttatttaaggtcattcactatagagtcaaatgttaaaactttgaatattatagcatatgttatattcaaaatgactttgagtcaccaaaatagtacacattgccgtcagtatactttttgaattcagaactttctaagttacattaaaagttgttaatatgttaaaagtttcaagatttcacttgtttccttaaagtcccttcttaaaaggataaaagaggcattaatttctatataaccacaaagaatccaggaaacaattatataccttttacagcaagatgccaaaattctctaaaatttattctgtaataattaattatacaaaatctatttatataccttgaatactcacttaaatctcgaaatagggctcataagtcaatattggccttccataattattgtgtaattgataccagatagcaattaaaaatgtttaagtaattcagactatggattaattgtctttataaatagtcacccttttttttttacaatgagctatgtattaatagtgtattcactacatgttaacttagttggtctctttctagccttaatattataatttctagtcttaaaattacaatataatattacatctgaataacagactttttatacaaaactcaatagcttagttgatattttgataagaaaaaattaaagtatttcaaattataaattataccatttatgaatattaaacatgtttttatagagtgacaaaatgtttgtatttctttagtctgaatattgtcaaagtacacttaatgaaatgtttgaagtcccttaaaattcggcataagatcatggattcacaatatataaactgctagggactattagcctgcctttaatcatgatgtttcataacatatttttgagataatgtgagagttgtcaagtaaaaaatgaacaacagttttagcttcccagttaaatttaacatatttatggtttatgtatgttttatgtagttgtaaatatagtttttttttttactttggccacataatttttttattttccttatgataataaaaaacagttacccttgtgaaaaaattttaaactctaaactcttcttttggttttgagattactgtcttatcttaactaaatcgcagacaatataaacctttttacttcagggaaaaagtgactgttataatttattttaaattgcaatatgttaactatattatcttagttatgctaattaaaataattatggagtagtttcagatgtgtaaggcagatttggcgattggttcttcagaagggtgcattttctctacattattgtgatagtcatcttcagtcatatactacatttgaaaattgcagtattatttgtggtttgcaaaattcacaatgagtataatggtgaagatctgctactcttctttgttaattaaaactggaacaatatatttgttttcttattaaagaggccacctgcaatccaactaaaataatttattctctagaataaaaatcgaaatgaagaatttatttaaatttaaagagactccaaacttctaagcattgacttgtatattaactatagtttcatgtcaagcacttcatttgtgttgctaagtcacgaactcgttcattatttaaattgaaacagtatcccaactcatcgtaatgtctgaggcatcaactgtcatattcatattattatctccatggttcctttgagcaaaactgtaacctgtttcaatgcatgtatatgttacactctgtgtaggtatacttaatatttttgaagataaggctattaataccgattgcatgacatttattcttcatagatcaatggctgctttagaataattttatattcctgtgttaatgtttgcattatagaagaatactgactaaattttttctgtgtgtacttttgccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggtaggctttgaaatgggctcagtgtccctgacagtacatttttattataatgcagtgtaaattgctgcaaaactaactgaaatgaaaaaatagtttggtcaaattatttttttcagaattaattgtaggcaaaattttttttattctttatccaacctatgtggcagtctgttgtttaatctgaagaaatttcccagggagcagaagttgtttatgtcccaggaatagtttttgaataattgtcttgtattctctttgctagttttctttcttgttagaaaaaaatggtaacaaatcagaattgtggagagaagtggcgaagaggataaggttaagagacagaatggactttgaagagatttaggattgtctctttgaagcactttaaatgcttggaaacataaataaaacatatagtgctctacttcattttactctgatatacactcctgaaattgtaattaattatgccgataaaaattgattttgatagaagtatgaaagaaggttggagaaatgcagccacaggcaaaaactcatagaaaacaaatacccttaactcattgataagtaggttttgattatgatgcaaatacttttcagtgtttatttgcatattactctcagttccttcactttagtctgtctgcctgttttgggaagatgatacaatttgacacataagaattttgtaatcattttaggagtttagatgaaattcatccaacaagaaggtcacgttctccaaccagacaccatgatgcctcccgaagtccagttgatcatagaaccagagatgtggatagtcagtatttatcagaacaagacaggtatttgtcaaaattatgatctcaacgttatgaattttttgttctgttttaatatatacagatattgtggcatagcacattagagagtaaaagtatttatcactcaaaaatgagctgctctcaagcaacaactgttaacatattgtaatagaaatgtaactctaggaaatatttggctaatattatattgttataattatccaatttcttttacaaaatcagaatttatgcttagacagctttaaaggtacagcttgttgacttagatattgacctaaattatagaagggagtctgcataaggagttttcaaatattttatttattgtgggtcacaatatttgaggtatgaagtaatcataaaaattatgttatttatataatttaaaacattgtggatacatgccatttgaaagttaattgcagagtttctatgagaacttcaataataatgtttctgttatatacttcttttcataaaatctctttctagaaaatgtctatagaatacaattattgagatgggttcttatggggatatgtgcttagatttaattctgcatttgtgaactaatatttcacggaaataattactataagtctacattatgaatctgttgctctgcgtgcccacagactttcttcttgaagtaaccatatacctgtacaattagcctgattataagctcaggatctgatttaaggttttataatacccaccttgttgaatattctcttctggctttttaaaatggagaaactttcagtgaggagaagggtcatgatagtggtgctaaataatttttcgccatggagtcaaggacacaaagtagaacttcttaacctacctaattgccatcctactgtggaaagtagcgttgtgaccttcaagaatggagtcacaataggtactaggatgaagagctgctctgaggaataggattccagacatctcagcttgagttgaatgagggctattttatcaacattcatttgggccaccatgaatttaggtgaggagggaaaacacagggctacttgaccagggcagtcaatatagtgaaattaatttggatatagataaagtattaattgtaaaataaaaattctaatcaattatattgttagttggttaataagaaacataatatggtattgcattttcagtggctataaaagccaagaaaactatcacgctttaatttgttataaagttataaaaatgttcagaattcccattagtatcaggccaaatttatagtattaaaaaaatactcagttgtctataattggaaacagagtcctatatcttatttgaggaatatttaattttgttttgttttaatattctataaaatcattttgaaatacaatggcaaatcagcaacagctaggacttcaaccataatatttgtactttattgtttaaattttttaaatgcttttatgtttatttttgtttaacctctcaagcaaatatgctagtgcagacaatctggtttcttcccttttcatgttttcattggcataccattggcataacccatgtctcataatttatctgtttcactcaccacccatcctgtctgtgcagtgagcttcttatgctgcccagagcaaaacgaggacgaagtgcagaatgcctacatactaccaggtaaatacagggatttggtaatggtgactgtgtgtgatgactctctttccattctattattcttccgtctctcccttagtggtattattacaagcaagtcaaataaatttcccaagtatttgaaatttgttttgttttatattgaggttatggaaaaggttccaaatatatttcagttccgattcaggctgactgctttgccatctgtagattcaaaaatccagagactagtgggcctctctgggactgtttgcgttcctaaaactgaggaaccagtttctgcaattaaaattctaaatgctcactgtgagtgcccccaactttcccacacatattcctgtctagtcacaagaggtctaatctgtgtatggcagtgtcattgtttcataattgtaagtttgctctgttttagccttttttaatttccttttagaatttattgttgtttatattctgtttgcttttgataaaatctttaacagttcacttttaatggctgagcttcagcttctttcttgatgaaaagtgaagatattcaacctgatcttaactatcctagcccaccagttgtcagaaatgctgcagtacaaactttcccacaaaggcatataacagtatgaatgcctctttagaagcgacaaaagatataatttttgcttctaaattggagcttagagcctgatgctttatgttaatctcattacatctttaatttcatatccaagtaaaacttcttacagattactcatggaacatattctataaatacttaatgtatatttgaaatgaatatagaagttaaggaagtagtaagtcagtgaaacaaactaacacaaaataatcgaactcaaatattttagccaataaaaagcaagaggaaagagaaagaaagaggtattaccgcagtacttgggatgcaaagacaaatgcatgatttattatgtctgtgtgtaatatgtagttctgcccaataatgcaaacaaaattgggctaataaaaattgtttgaactttttacagtctgaagttatactactcataactactgccatgtttgcttggagtgccacaggaaaaaatcgaggaaatattagttctgcttgctgagaaaaaaatgtaaaatcatgcatattgtaaaaacctactgaaggtcaaagcatgaactatccaggtttattattacttgttcttgacaaacagtttcttaaaataatggtttatttactaattctgaaagttttctcacactcctcttgatgtgactaaagcttcaaaagaaataaaaaacatgcacacaaaacaaacacaaaaaaaatccttatattttaagctacttagtgtgtgcctggcactcagtgtgtgaatatttctaggatactcacaccagtggtctaaatataataactaaaaatatttttctttcccttattttgtacttgtaaaatattatatacttatataatattatataatagttgcatcattttatataatcttatacttaagattggtgctttgctaataattctgagctccacaagtcctatttaatagtctctgtatgttgactttgcatttcctgatttaagcaaataatcatatttgtatgtatacaatttaaaaataaatgagtattcagcgaggcagataacatcctgtggacaggtactacgacaataagatagggagtggaaggaagctgagctagccaaatgtgtcagtgcgaaacatatgtcaccagtgtcttttctccttcctgtctttcattctctaatgtgtaatgctaaaagtatggagatagagacaacatgagttcaaaaatacgtgcatgtatgtatatataatctcttctgtgtttatattcatgtatttataaaaacattaatttatatctgtataaaaatgaatgtcaaaatgtgtacatataaataaccacaactttatatggatatatcaataatatagtttggtttcatataaactatggacacttattatttctataactatccatggctaaaatctaaagctttcaaaatacatcataccatgttcacttaggacttataaaaataaaatctgaggatttactagtctctagtaaacataaggaaaataacatttatttaataacaagcacagtgttaaatatttaatgtactttgtcaatttcctgacaataattatatgttatgaatattattatcctgattttagagatgaggaaaaaagctacgaaagtttattttacgactaatagagtaaggattcaaaatcagatctatttgatatcttctgtttaactagtttttccaaaaatatgaaaacttgtcctatgagatgtttcaccaataagagtttttgtgagtcaaatacattttggaaactttgcaactgaaagtgtctaccttgaaatttaatacacacagcatattaaagtcatgttctaaagaaatctgtatgtttagtttcttttctcccaaattgtttaatttcccaacctttttttagtaaaacgtgtctcgaggaagtggtagtatagagaaaatgctatagttgccttactgtatcctactgtgtcctaaatattgtgtacatgttaccacacacccctgttaagtggaagttatttcccacattttgtggatgtagaaacaggcttggagacttaatcgaattacccaggtcacagccaataagtggcaaagccaaggcaggaacttgaacattcagactataaattttgtgctattttctagctgtttcccattctatgttgatcccattcttgaaaaaaaaatcacttttgaagcaatgcttagaaaagttttatagcaacctattactaaagatatttgcctgaggttaggagttgaaaagaagagtcgactgtctagaaaggaggctaaatccttagtttcagtaaaatttgtcctcaacttgtacttaataaggaggaagctgaagcgggcagatcacttgaggtcaggagtttgagaccagtgtggccaacatggtgaaaccccgtctctactaaaacacacacacacacacacacacacacacacacacacaaattaggtgggcatggtggcaggtgcttgtaatcccagctacttgggaggctgagagaggagatttgcttgaacccaggaggcagaggttgcagtgagccaagatcacaccattgcactccagcctagataacaagagtgagactctgtctcaaaaaagaaaagaaaagaaaatggcattttagttcattttttaattgaagttttaagggatttcctttgatttgatcattaatataaacatgattaaaccagtgaggtgtttgatgtttaggaagcctttgataaatgtttattcccttccctcttgattatgctttactgctagctgagatagatgatggattttcataattagtaattaaatttatagaacattattaaattatcaaaaaaaatatggctggacctagtttgtccttcatggcatagacagtccagaaaccctcacagattttaaaggaatcagatgccgttgggccaattttctgccaattcaaaatccatattctggtttgcatctaatgcctatcttaccctacttccaaaggaaaatttcctgtggttgggtctggatccagacagaagctgataagtagaaagagcttgctcctttgcaatcacttcttggcctttttctgtttcctttttttttgctgcagtctggtactatgaccagctttgtccctggaatgctagtcaacactttgttttgttttagaacattaaaattcttttagtcatattgtaactctaaaattatataaattagttgatttttacttttagctatgagtttactttcgtagaagtaggcataatattaaatcagagattaagtagcacatttacatattgatcaatgataattcatagagtttggttagcaggtatttttctaattcagataattaaataataattttgagtattttatgaagtcaagtgtctatgatttcatattttaataattgtagtcttcccttcaaatagttattgtggttcttttgagaaaaaaatgaccaaagatttatctatatagctttataggcctcctactttctgaatatcttaataaaattggtttcatatatatttttctgtttcctgcgtgtttgtgttgctacgttccagacatcttgttaggcactataaaacattacctcccaagatgcctttattacagagcagttctcactggaatatttacaggtaagagccctaacagtgagtcccacccagttataaagtaattcctaatcccttgcctactaaaaatagaaaattcacattctaataaaatattaaataggaaatttacattctaataaaatattcttttgaaataattatacagtgagagacattaaattaatgatatctaaaatcgttttaactataaaacttagtactagaataattctctgaatgacatctactaactcaaatgtcagaattctagttgctttgtcatttgtatattgttgtacttgttgattttaattataatttattttattttatttttgtgtaattttaatttgtggagctcaattctgcctgcacatactaagaccaaatcagtgactagacaggacatttcccttcatcatgaatgctttaactcaacagtattgagatttactgatgaaatactggttaggtaagaacatttggaagtgatatcttccgtttcccttgtttattgttgtgaaccaaaaaagttgagttgtaaaattatttctcctctgatgtccttcattttgttttggtgtggcatctgttcctggtaatgaaattttaggcattttgttttagtgctttctgtatccagtttttttcataagtaggtgtgatttagtctcatttttcagtctgagacacttttaaaaattatgcaaagcaatttaagcataatctttgtttagcttcattttctaaacaaaattttacactgtcattctgtcaactctctcacacccttatgaactgaatcccagtgattctacattttgtgtaaaggggacattattttatgctttactctctaacatggtcttcctttctttgttttctctgtctttctcttctaccactggatgcaatgcactggcactagtgaactgcagccctttcttgacagggctaggagtgctagtaccaactgcttgagaccagatactagtttgcattcaccagaacgagaaaggtataaaataaagactttcttaatttcttatcatttgtactagtgatttttttcagtcactttgttttgtttcatgacagccttacaggtttattcattcatgtatactttgctaactgtctacatttccccttcccttattatacatgtctatttagagatatgcgtatgtggataaacccaagggtacacatacacatatttctatgaatgttgttgcaaatggcgtggtgtaatttgtaactgcttctggctgctgcttttccccttttgttgctgttcagtcattttattgactattcaggaaaccttcagtatgctgataatgttataaggtccagtgaattatccgaaggggaggatcactttcctcttagtaccactgataaatagtatttataggtttaacaacaatcttctataaactcataacaggaagtatttttaaatagaatacttcctttgtatatctacattcatttttaatcaatctactctttgatataatgttttaccttaaattatactttgacaacaaaaaatgatgttattcataaatttcctgatgcctaacaaaaagaaatacatatatatgtacacagacaattttgcttaaaactttaattaataaattctgatatattcattgatgttgtgttacactatctcctagctgtaagcatctaatttttccactgtgatggaactcttttaatagacttagttataattttaatagacttagttataattgatagtcttgtttataatggctatctctttttaattagaagtcattcagaagacatttgcatactacctctttacaaatcctgaagaaaaatatttagttgtactaatgtaacccgctcctccttcttagtaggctacttaaagcttttctttaggtaactttctaatctgagtctattcatttatttatgagatatttatttctggaattgaacaataggtacacgtgtgtatataccttgttttagtgccttaagaatttacttttaaattgtgtattcttttacatttgtaaactgtgtaatagaaaaaagtgaaatttaatttctgtcttgtatccctttacttttgtaatataaattttagttgaaaggactatagagtctctaaaatcataattggaattgttttatcattctctttagtcaaatataaccccttccccaaataatttcaagagtagcaagaaaattttaaaatatgtttagttattattttcttatatgtttctggttagtagtaaaacaaggatagaaattctcaagttagtggaatcttctgaccatagcagcctgacatttttaatattacccatatcagtgccatctgatagaaacataatgcaagctgatactttaatatttcgtagtagccatactaaaaggattaagttaattttaatttttaaccctgtatattcaaaatataattttcacatgtcattattatacaaactattagatattttgcactcccttttttacagcataataagccatagatactaaagatagtttgtacttgcaccactcccactttggactaaccacattacggtgctcattggcttcatgtggtttgtggctcctgtactggacagtgcaggtctattcttatggtgagcctgtctagcatatgttcccttgtgacactgaagccacagagtttataaatctccatgttggcaaatttaatctgtcagataatacccttaaagcaggtcaaccagcaggcaaataatctagggacagttattgtacagattgttgtaaagtccaagtgggtgtatttaccttgaataaaagaagaaaaaatattgaaaacatatattcactctacatattgaataaaaaggaatttttcatttaaaaactcaatgaaacaagtcttggtattatcagtgatcctaagtttattgggatcactttattgccaagaagaacagcaattattttatgtaatgtaaaataaacaattattttatgtaatgtaaaataaaacttagataaggtttcatcaagtaattacagaagctgtagatgcttattggtttggaggatagagactacaagtaccctttgtgaacacgcctatgaagcagctttgaagcagaagataacaatatcaagagtggtgactttgttatctttggagagtgcatctaaagcccctagacagtatgcggagagtatgagaagggaggcttagagggttttcgaggctacttaatttttctaatttaccgcagggattattgtattaatgcctaatatatacatagtagataaaatgttagagcaaatgttttaaaaacttaattttatattcttaagagatgaacattatttctacaaatttgtcaactatgtatggtcaaacgattttgattaacatttacatgcctttataccaacttaactcctaacctttaacacaagttttctgttaagataaagggtgaaattgtcaaagcacactcagtactcaatataatacttttctaatgattcagaagataaaagagcagcattcttttcctgaaggaattgaaaaccatcagatacacctatcgtttctcccttgttacatagtttggcctactttaacagatgagttttgaataatgcatgtaaaaagcagtttggaaaggaaaccgttttagtttaggagcacctccatttcatgttctgttgattacacagatggaaaacatgcttatgggttaccataattcagtgaattattccaattcagttatgcttcttaaatcaatatatttgaggtttatttgtaataagaaataatttatcatttatatcttcccatttcccttgcttccctgattggcaaggagtgagttacaggcctgctattaacctttgcttttctaggttttcaaacaaattgttacttacatgttcagaagcaatgatttttagagccactagagaaaacttacttttcttggatggtttaccttcttccttggcctttcagagcaatcatatccttgatgaaggcttatgaaagggtagtttaaacttaccgcctgcattttttaccttccagtaattcctgtaatctgtagctgtactgaagttcttctgtggtttacattggctccctagttgttcagcaacatcttgcaacattttacattacccaccctgtcacttgaatctctcttccattaagtacctctacagattttcttaaacctctgttatgatgtctgctttgaaggcttgtcttactccgctgtcctataaagataggtatttccctagctccacctccagttttcttcttttgccccacccatactgtactgttccttaaattttatttctataaaaggttcccactccaatacatatgaagacaaccctccactatgattgaccagaccctgtcaggcctaaatttctaaatgatgatgtctaaatcaacttcattatccccacttcagtccctttacagcaaaatccttcctctttctaaatttttctctcattttatggttttgacatataaccagccacacaatctgcaactacttctcttcctgctccgtcacaaattcagtcacaataaattcaatcaattccttcggaacaggtccctcaccttgaatatattaatagatagcccttctccagttccagtgacactcctgctcccattaattttcttaagttctaatagtctttattaacttatatctcattttcttcctattaaaattaaaatattcttcttcctttgttgtctgattaaaaattctgctcactgttcaaaaatacaggttaaataccatatctttgtaaaacccttcttaacctcctcccctgtcctcagtcccgccaccaacacacgcacatacttccttttcttttgccagtcagaattatttactatcttttctgggcccacctaattttatatacttctattaaaatacattgtattttatttagtactgtagtatgtttgtgtcttccactatattgtgatattcttccacgatatcaccatatagtggaagaaacacacacactagccttaagggaaaggaagttcttggctaaaaatcaacagctataaattgaattgaaatagatatcataggtcttgtttcagagtataactatgtgtattaattaaaataagttaaatttagtttaaaacaatattgggggaaaaatatttaaggactaaaatgaataattagaacagacaataaaaatacatatgtgtgtaatcagttatctcattttgtttggtttttaatgttataatttctaattgagggcagggataatatcctatttctcttttccatctatagtgacaacatgatgtattttttacttggtaaatcgttcatttggggagtttaggggcttaaaaaacaccttctacttttcacttcaaagttggattgagctgtgagttagacccaggtactagaaagatgggagatttaattttcaatataagtactttgaacagaattgaaagctgtggctttgagtctgcaagatggctaataactaatcccagaatcagccagattcactgagccacacaaacttctgctacagggtcaggcctcagatctcatcactgctttacaagtttgtttgttgtgctgtttgcaggcatcataatttggaaaaaggaatccagaaagggctaagtttcctgtgcccaattctttaccatggtcacctatcatataagccactctttcttccttggggtgcaatgaggaaaggcttacttgaatgaatttccctcaaaatggaaacatgagacttaagggaaaggaggttcctacctaaaaatcaatagttatatatcaaattgaaatatgtatcatagatcttgtttcaaagtagaagtactgccgtggtggctcatgcctgtaatcccagcactttgggaggctgaggcgggcagatcactaggtcaggaatttgagaccagcctgaccaacatggtgaaaccccgtctctatgaaaaatacaaaaagtagccaggcgtggcggtgtgcacctgtggtcccagctactagggaggctgaggcaggagaatcgcttgaacccggggagcagaggttgcagtgagccaagatggtgccactgcactccagcctgggtgacagagcaagactccatctcaaggaaaaaaaaaaaaaaaaaatatatatatatatatatatatatatatatgttaattaaaataagtgaaatttagtttaaaataatagggaaaaaattttaaggactaaagttattaattgaaaacacaataaaaatatatatgtgtataatcagttatctcatttgttttggtttctaatgttgtaatacctcatatttttaatttgtgctatttatggaattaatgacttacatttttatttaatgccttttttagatagttaagcttcttagccatgttctgccaagagatatgcaccattgaaagacgtgtgtatatgcaagtacaggtattaataatacacatatacatttgttttaaagtttatcaatgcctgggggagagggaagagctgcaacataagtatcatttaattgctttctgaggcctatcaattctcaatccccttatgtcaatagcactgtctatttcttggttaaggttctcattattctttatccccaaagccaatagccttatgtcattatttacttaaacattcacaaatatttgtttattctgtgctatgcataatggatgcaattatcaaaaaacaaaaaagcctcactgtatttccttctgcagggagttcacagcctttttattcaatcctgtagcctccagagtgatctttcttcttttcttctgatcacagtgaaaggagtgggctcccaagaaatagatgttcctcaattaatgaatttagaatacctgatactaaagtatgaataatttactaagtaactaagcaatgaacttttaggtaggctggtttggaaatacaaatcaagaaaggaccggtttagttcaactttatgattaaaatctccaacgtagcctgccatattagcttgtaaaatgaaaatagaaatgaaagttgaagctatgtatatttctcaataaccagagttgggaagagagataaagattctaattttggtcattccttgtaatagggaaaaaaaccagaagtagcacctattatagaaagcatataaaatatgctagtatatttaaaacttacaaagatgtgttattaaaacttaagtgacatcttttcttaggacaaaagcttggatataaattgatcctgctctcgttgtatccactgtatgtgggaaaaagcaaacagatttattatattggtactacatatcagcatattcagaaggactctaagtgtacaaatatacgtgtattaaaccaaatattcgtttaaaattaccttttaatcgcttgcattcacaattgcttgtttctaaatgtacatctttctcctccacagctttcactgcatgtttcataattatgccatttttacttgctttttctttacttttatgtttaaataagcacaaggactggaattttgccctaggaagcaaggttattcataattctgtccagttaatattgttacttcacagaaaaatactaagtctatatttatgtttccaaataacaccaaaagttttaacacaactgagtatataccttaatgtagaaaatgctgtcgtcgtaattcttttccaattattttacaactatttcttcattttatctataaacaaaagccagtacagtgaaaagaaactttttaaaacattcagattggattgaccaatcctttaaataatttttaaaaattaaataaagttaatgcaaaatgttatttcatcaacatttatcacctttaagagtatgttccacacatttttatcttctgctcaaaatctgctattcagtattttcacttgcttcatggcttcttcaaagcctgacttgaatcatgccaagtttgtctatttaagatagattaaacaaaggcttccagagaatttcagaattgagtatctgatgacctcgcatatcctgagtgacagaagccctttgctatgtttggccagatggtctaaaatattcagtaaaccaagttatatctggcaagttttcaaaaagaaaactttctttttgaaatggtaggactagactcctttggataattataaaatcttatacctaaatgagtcctttaagactatccagttattccttctttcatacaagaaagccaatatctagagaaaaatatcctgttagaattttcatatataataaataaaaaattttaattctgacccattcagtgtcttatttcctcagttttaactagatgtttgaaatttgtgtctgtgcacagacagaatctaaaggtagcttaacaaaggaatgaaacagttttctaacttgtgtttactgttaatcgcaagaaaagtattgtaaatgctgagctaaaaagcatccatttaattgacatacttttgcaaataaaaaccagtgaaactaaaaaaaattaatgctaatttatcatttcatgtatctatgttctttgcttttatttatcagtatcgtttacttacagcttttaaagttcagtaattagccctgtggtttttgacaagaaaacttaagaattcacttgtagttttcccatgaattatttcttcatgtcacggtttcaacactgaagaacacttttatttcttctacttaactgtgctccttactttgtattaaattcacacatccccacctttgcaactctacccagtaatttcaaggcctggtatcacaaaatcattggtagcttattaaacctatttattcaaacataagccatattcctaaagatgcatctttaagaacttaaagttacattaatatttgtatatttatagattaaatatgcacatagaagcacattttggaagaaaaaaactacacttaataggcggattccaaacatcttcccgaataaattgtttctttattcacttataagattataggttttatgttcttaaagtattgtaacttatctttccaaggcttataacagtgaagattttaaattatggagcaaagaatctacactttgcctttatggggtgcttttccagtcctcttgttccatgtattcttttattttaggagttactaaatgtcctgttttttcctgtcttgttcactgggcaaacaggggtagatggtccccctccctagataggagacgacctcctagtcccaggattcaaatccagcatgcgtctccggagaatgacaggtactagtcaactcctcctcacagacaagtggcttctagaagcttataggccaccaactgaaggataaccaagagaaaagttgaatatgatgtactttattccaggagccagagccagatatgttagatgtagccaactctggtaaagcacctcagaatatttactgaaatgaggatagcatacaaatggcagagtttaaacccagtgaagtcaggatccattgaaaggatgttctgttttgaagagcatttgattgtgttttgaatttctggaaacaaatttaaatactgtttttgttgacaagtaaataaaaattctcaggtgctttagagtatattaaaatctgtcacagagcctatttgttatattggttgatggttttatctcagttgtcttgttttgctgctgtgtacacttgttaacaatgaagtttaggctttgattatattaaataatgtctgtcttattaagtaaaatacctggtttttatatattttataaatattgtattgttaaacacaatattgtccagggctaaggggtcagtccccaaggtaggtttttaaaaatagcatcagtgctttgaatccactttatgctgatatgtcagaagtgccacaacatatattttccattactttgttattcttctcagtgtgaagttgacccagttttcctattttatggtatatatatatatatatatatatatatatatatatatatatatatatatatatatatatatgctttatctttaaatgtgttttcctgactggtcacaaaggtttttgggtgtttgagatgcttctcttctggttcaagcagaaattcagccaacgcattggtaatatttattcagcagataagtagacgtggtatctcagaagcagcataattagtcatgtaaatgtacagattttttttagtgtgtgtgcgtacggcagagtaatttaagccctagttaaccgtgacacaatttattttatgtatttgtaaacaatcaagatatcctcaggattttagcttgaaagaaaaaggaaacattgtcaccaagaaaaaaattaaggttgttttacaaatactggaaaagactacaaactgatattttatgaaggtttcaggaacattttagcatcttttaatctctaagatacttgcctcaatatggtttacatttacatatttggaaattaaatataattctttctgctactgtctgatttctaggatagaaattctgggactagaaaaactagtaaccaatctaaaaagtattacaaatgtagagtcttctcaaaaaagaatataaaataattgtgtaaattcaataaaaatttatatctatattgctactcatttattcaataaaaacttattgtacccctactatgcaccctatccaaatggctaggtcacaacagtgattaagacagacaaagtcctggccatcagggaacttagaattttcttttagaaaaaatacttctgtgccaggcatggtagctcacacttgcaatcccagcactttgagatgccagggccaagtggggaggattacttgagcccaggagtttgagatcagcctgggcaccacagtgagactgcatctctgcaaacagtttcaaaattagctgggtgtggtggcacatgcctgtagtcccagctactcagaagggtgaggtgcacacacagtctgtgagcccaggaggtcaaggttgtagtgagccatggtcatactactgcattccagcctgggcaacagagtgagaacctgccccctccgatccccaagaaaagaaaaaaagaaaagataattctagaaaacctttgtatgtattccaaaacaaataaaatagtagatttcatcttctgtattgattgagtataggaaaattaaacatgatgatctttgtaatgaatataaatgtaagtttatctgggcattgattaagcaaaatggaaattcaaataatactttcagttcttacatacacgagatgttattagcttaatttagtggtatatgaattattccatttgattgtctcgatagtatatgtaactataagagtagattttgggaccagaaatgatccttttagataagattattaaaataaattattattaaatacataattttgaatacatattttgcttttttatgataacatatttatagataagtcctatgttcgaccaaaataaatacactttacatctcttgatactattatttattactatagagaatagagaattatttacaatacaattttattaaaatataagacaaatatgtacgtataaaatgagagataaattatgtccactaatgctacattcataggttatatgtcaaccacttggcaaatcgtaatgaacgttggcatttcatttctcatcagctttatttactcattcagaagtttctaccaatttctaaatgaagtaaatatggcatcagatttggatatagtgaatgttcataagaatttcagcgttaggtgacttttattgttggacactggtagccaggaaaatattctaaagttaatgacaatttatacaattcaactttggatatcttctatcagggccatagttgattattttgaaaataacattgtaatgcagaacgtaaattattccttaagagagttatccagtacattcaaataaattgaaaagcttttagttgccctcttgtttcccacagcatatatgtgtacacagacacacaatttttagagaaccatttctccataatttaacagtaagcattctcagtttttctcaagtgataccatagatttatttggaattaacatgaaggtacttttatctaagaatattttctagaggccgggcgaggtggctcacgcctgtaatcccagcactttgggaggccgaggcgggcggatcatgaggtcaggagatcgagaccatcctggctaacacagtgaaaccccgtctctgctaaaaatacaaaaaaattagctgggcgcggtggcaggcgcctgtagtcccagctattcgggaggctcaggcaggagaatggcgtgaacccgggaggcggagcttgcagtgagccgacatcgcgccactgcactccagcctaggcgacagagccagactctgtctcaaaaaaaaaaaaagaatattttctagaaattgaggaaatttaaaacattgatgaagaaaaaatacataaatttggaatcccaggggatgttttcgattttaaaattgtagtgaaaatttccttgtagttttatttctaaaaatgttgacccttaaaaaatcatcattccaataacaaagcatctctttagaaataacactattttaatacatgaaaatgctaatgaacctatatatacgtaattatatgagtgtaaattaaatgtagattgagttgtagcttgaaattaaccaaaatttgtaagtagccatttagaaaaaatatattttaatatggccctgaagcatcagagttctgagtttagtgcttacagtttaatcaatcgtctttaagaatgaaaggctagtgtaagttattattaaataaaactttaaactattttggtaaatgttttattcaagaaaatgcaatattttcattgggtacattttgaggtatattttaacatgtcactggctttacaaatcactgcagttactatcttcaatattttgattgagaatggtttttaatctatctatctatctatctatctatctatctatctatctatctatatatgatttttaagggtacaatttagtagtgcatgactcaaataccaaaaatatttggttaaataatcttatttccagaactttaaatttttcaattaagtaaagcatcccactatgtttaattcctgagttgttctgctaaagtggctctagtttcttttgcagataaccaaatttgtgtagtttcctatacctattagttggtagcagctacttgtctataagaatcctcaaccaagagtatcaagtgatttcttttgatttaaaatgaattaatcttatttctcctttgaaaatattctgggacaaacaaatcacaaactttttgcttccaggattcatggcagttgccacatattttcaaagttagtgtagaaccacttataaataaatacagtacattacttattatttctttttgttctataatatcctttattatctgtgcttttcaaaaatactctttctttgaatgaacaaagtgtatccatgaactaaaatatggtgagtctatttaatagctacagtcgtatacataaatatcaataatatacaggaaggtaaatgtatcttaattgcatgcatccatcttcactgcataggaacatctcttatttaggttgattctattcaaatttaatttttccttcccaaacttaatgagtaaatagggtgatagagatttgctttgcacattaagacagtataagccatgtaagtagtaagccaaaatatagacatattcttatgatatcagtgttagctctaattaagtgaaaacattatgtagtagacttttgttacagtatttccaaggcagaacagactatgttttcattgttataaaatagtcttaaataattatgattttattaattttgtcctttaataaaattttagtattttatcctttaataaaattttaatgccttcagaaaagctttatttaccaacgtctttagagagttaccctaactgaaattagttattgaaaaggaaaagaaaacacatagattttaacaattacctctgtttttcatcagttcattttataaatcttcacactaaattaatagaaaggaaataatcacagaaaatggaacttcaaaagaattggggtttaagtagaaacatcccattttctgatttttactctagctttgatttaataataaaataattgcttttataccttacagttgaatgtacttttatagctttaaaagaatttctttagtacattgtgaactagaaagcataaggccaaaaatcacacaactattaagttgtgaataaagggagaaaaactcaagatttctgattcttgcatgtttaaaaccaagtaaatattctttatgaataatattgtaaagataaaaaatttatgccagaacaaaaaagcatgtttaaactaaaaataagacataatgaaaacactgaaacagtgttgtcttgttcactcgtgcccagggatctctcaaataaacatctaatcattcaaaatgaacatgtggcagagtcagcagagaacttaagcacataggggtgtgatggtgttatcctcatcaacttattaaggtctatcatagcttggatgagacacttaaacttttgtggactaagtttcctcatctctaaacttaactggttatacatgggatagctgaattttaatgtcctatagactctaaaattgagtctatactgccttgttgcatcatgttaaaacatccattaggccctggataatgactgacagttcattatgtattattcagtaaaccaaaggtcatgttgtatttaagtattttatattttgctgaaggccagaaaattatgcagttttatttttaaatttatttcatttgaggcaaactagattttatagccctagttagttcttttttattgtaatttttgggctttcaaatttaatgataatactcaaaatattaccttttaaactatccattcaacaaataattattgagcaactaccatatgctaggtgttgatattacactgataatccaaacagacacaattcctgaccacagggaacttaaagtggtataaggtagaaagtaattcattttagtatgatctattttgtgattacacaattaatagtttcagtagtatggtacatgaatataggtggattgttctaacctttcctattttatatatctcaatccaatttattctaagacatggctgtgttaaaatatacaatattttggctataatttggattcaaaatagaaaataacattagaattttctattttattctctgctcctttacagaaaattattgcaattaagtgcatatcattttaacttaatttacgtattcttttaaggggttagaagaattataaagacatatcctttgtagttatctttagaagaatctttaatggaggtaaatttcattgctatttgaagagaaaaaaggggcatcctcaataagagggttaaaaatgaaaacaaaaattaaaaggttagattatgagcctttgcatgaatatttgttatccagttatagagcactggctctaagttttatatttttatagatgagtaagaaaaccctttgccttcaagaaacaaatatttaaagcaatattttcatagcaccacttgctaattccaagtaatgcaaaaaacatagtcaattctagttctgtgtaatactacaaatactacaatactgagtactactgaaatatttaaaattagcaaaacctgtgtgtgtgtgcagtggtagtggtattattgccactttttaggtaaaagaaaactgaagcacagagacattaagtaatttcaccaaaatcgcctggctagccagaacagagctgagattacacccagttcattattttagccatttatgccagagatacaacatgattactgttgttcagattatggactctcagttcacctcctggctagatgttgaatgaccatgtaagcgagaacaaagtgttctctaactctcaattttcttattcttaaaaaggataaaagagtagtacctacctctggattggaaagaagattatatgagataatgcagataaagtgaacatgctatcacagagaaagctctcagtaaatgttatatattattaatatcataatcactgttacaacaatcattgattactgtgataatctaatatatgaatccattacattttaggagatgaaaagaggaggaagagtttgaaagtttcacagaggaaatgaaatatcacttgggtctagaaattaatagaagttgccagggatcagaagaaaagcaggctatttcaaaaagatgccaatagccctttgattgtgcagaagttttattcaagggtccaccagattctacacaatttctctgccttctcctgcaaaatttttcatctgaatcatctctcttgacccctgccttcttattatttcctattatttcttcccttttcctgagatactttttctctaacaatatacatggctatctccttcactttacatctttgctaaaatgtcaccatttcaataagtcctttccaaccaccctacttaaaattgcaatatgctcctgcccctaaactcccaccttcttaccctggtttacttttgttgttgacatgtatcaccttttcccatactacataatgtacttgtttgagctactttttgttgtttattttttgtcttgtatcaacaaagtgtacatttcttgaaggtagagagaattgtgtttttttttccacagacatattccaaccacctagaacagtgcctagtatatatacatgcacaagtgtttgttggatgaatgaatgaatgagtggaaattttaatgacagtaagttttgtgggtcttcctgaatctctccactctcatctgctctacttgtgctgaagatgagaaaaggagcatttgatcttccagtcagttgccttgagcactgtggggaccaagcataaatttcccataactatttttattttgagctccaatacctcctgagcctgcagatctaattactaatcctttcttctccccttacttctcatcttcccactatgcttatgccttcttccctgtgcttcaggaacaagattccattcccaacaaccatgtctcattgatttcagccatgaaatcaatcatggaatctctgcccccctaccacccatgatcccctctcctgaccacagaagcaataaagtaaataagaaccttaatgtcagagagagagagtcatctgttagtgatatcccagcacctgatttcatggtttcatttcttccttccagaacagatacacacataaggcatgtgccagaatctctctcttccactctctttgctgtatagtatagaacagaaacagcttaggagccagataaacttagattttaatcctagctttgccactttctaactgagtagcctttccctgagcctgtttcttcacctataaaatggaaatgacacattcttaaaggattttcatggagtttaagtaagttcatatccccctcagtgcctgacatagttatccctcaatatattgagtacgctcttttccaactggtaagggaatatgatgtctcactcctctatttcttccttttttatcttaaaagtggtatgtcagattaacatgagtctgaaaacacacagctgaaaccctgaattgaaggggcaagagagtgtgaacacaatttctggcgaaagcggaagagattgggagagatgagcagtcccagaactctgtaacagcctgtgaaggcttgtaccttgatatgtgttcctagtgcctagcagaacttggtatatactagatacttaattaggatgtcacacattaataagtaaagacagatatttttctcaacattgttgggagaaagggatatcagtaaagaaaaataagcttaatttgtagataattaatattaaatacacattcctagggtttctctctttttttttgtaataagtgtgagcttcttgaccacaatattttacattacttatttcaaatatatggtactgaagacattttaggctaattagacatatgtaagctgctgtggggaagcaaactttttatagaaaaattatttctgtgggaaaaatgcatttcaagtgttcagtgcacatatgtacttttaaaaagtagaataaactggggaatatgatttgtaatgtgattaaaatgctgtgtgcttttaaaaatgctatgtaatttataaaagcatctttatgaaaaattttaaaatgattttaatactttatataaatactttcatttatataaaacatctttaactgtagcatttttcttctcttttcttcacaatttgtgggggacaaatcaaaaaaaatctttgtagcaccaagtttcaacttgtaaaagtagggggcatttcacccctttgaagcctttcagcacctaaactattaccatcatcacatttatcattattacacttcaccattgcatttgtttgctcatcagcagaggccgagttgctcagtaggggttcatattagatcattgttgtagacgtacttgtctagactaatgaaatgtcagcttctcgtgtcttctattgggcaacttgtgtcttccacttggcaccaattctggttttcattttattcattcattcattcatttatttgtttatttagttttgaaaagtactgactgacaaaatcatttaggtaatatagttgccatttttcatgtctattgtgtttatcattgtatgatgttaatgtagctttattcatcatatattttgtgtttaacatttcattccacaggcactccagaaagtctgaaagatctagcatccaaaaacagactaggaaaggcactgcctctgatgcagaaaggtaggcttggtgttgtggtgtgctgacatcttccattttaggaatatatttaggggtgctgtcactctcattttacatgatcagttcttaaacacaaattgtgatgtttaaaggcattcatgtaactaaacctacccctaaatggaaatgatctcattgaagaagtaagagaaggataatttcaaggcggttcttaaatcttagggtttaaaaaataattatgtatttctcttagtgatcattctgattactaataaggattaaatccatactcattcctatatacatattaggacattaatattttgtttctgatatcttttaaatgttaccaatgaatgtagtgcctggaatatgcaaattattgactgtcttatttatctaaataatgccatcttttaaaaaaatcacttttctacaaatatatattctaatattctactggtatattataaccaaggatatacattgagttaatgtaaaattataagggattactaaccttttgtttgcaatttgtccaattccacaaaggttttaagtatttttaggtacaacatattgacacttttttttttaacatagtgttaaaagacctaagaattgcaactaacatatattcattcacccattcatttatccaacaatgactgagagcatgtaaagggacacagatgtaaatgaatgagtatattcaagtatcatagctttcattatagaggcatgcacaggtacagtatgaacacaagaaaagttgtgcagtaaggatgaaattaggaaatgcttcataaacagatgtcccttgagctaaatccagatacataaaagtatgtgtgaagagtggagtattctgagaggggacaacgtgagaaaacactgagattggaaatactatcttgagtttggggaaatggtaccagttttgggatggagaacaggattcagtggatagaaaagaggcctgaaaataaaattggagaaattctgagaggttaaatgaatgacatcactatgccatgttaataccatgctaaagaatttcaacttctttattgatctgtgagccacagatgtgctttaaacatgggaggcagaggatcagttttgagttccaaaattatagatcactttgactgatttttggaaggtagatcaaaggatctaggggtagatgcaaggcatcagccaggctatctcaataggcctagtagagatagaatttgtacaattcagtgattcattcagttaacagatatataccaactatgtgctaagttcaagtaataaaatagcaagtagcaaaaaagaaaagctttccagaggatgttaacactgagttgagatctgaaaaatgagtaggtgtgagacatatcaagggatgtggtatgtaaaagggagatgaaatttatttctggacagtggtccatggagaaattgactatttagggaacttgattcacaatggaataaggatacaggggactcatgaaaagtgttgagtagtacaaagagttggactttgaggaaggaaattgatcaatcgatagatagatagcctttgatgaaacaatgtttgtattttcacattctttaatcccagctcagttaactgcagtttctttaccatcattgtaaataactataatttcttagataaattttcaatcttcaaccatcattttcagccccctctacacaatttcaattattttgacatgattaaaccttttccttgaagttgtattcttttaattctattcagtattctttcattcattttttaaaaatactagttgagtctggtcatggtggctcacacctgtaataccagcactttgggaggccaaggcgggcagatcatctgaggtcgggagtttgagactaacctgaccaacatggagaaaccccatctctactaaaaatacaaaagtagctgggcctggtggcacatgcctgtaatcccagctactcgggaggctgaggcaggagaattgcttgaacctaggaggtggaggttgcggtgagccgagattgcgccattgcactccagcctgggcaagaagagcaaaactccatctcaaaaaaaaaaaaaaattgctagttgagtgactactgtgtgtagttatatattaaggatacatcagtgaacaagtttttttggcaataagatactattttagaaaatgatagatgatgccagtgtcagctggaggtgcttaactccagattaatgatattgaggcatctgcctttgcaactctgaaatgtaatctgtggataaacacaaatcctccaatcagaatagcaaggatttgattgactttcattttcaaatatatgacacttatgaatcatattcatagtactcttgcctttcctttgcttatagtttaaagtagaaagctgtaaccttttagatgtgtttgattataattaaagcttttcattgatttttattagagtgtaaactacatgcctagtttctttgtgaattgttgaatagcaggttacaaaagaagaactggcctgggttttctaatttatgttagctctgaataagagctgttaagaagataccttgaatttacatctagctacacgtgaaccgaagacacagtataaatgctttggacactgactcctggcctttgagagttgataacttcccaaaaggagtcatactacacagttttgcactggtttctggcgaaatttgctgtttaatgatcataattttaaaggccttttattgccctcaacaaatgtaacctcatgacagatagccttttaagaatatattttgaaagagatgatgaccagttgtcattaggagacaagtagaactgatttatattttttgtgtcaagccacttaaagaaatgtatcatattttctttggaagcttcttgataagataaaagtctagcttttcatcttcatgtgaattcacccttgagaactgctgcccatcatttctgcattccattctagtgacttttcttcctgtagaaactacactctacattctaacttggggatgctttatttctttatttggactactatttagaattgcttacatatgcattttatggtgtgttattgcaaaagagcctgtgcaggcctgtaacggaccagcacagtaggaaccactttgaaaatttgaccttaaataccacatacatgtccattctttaacaagttgtttaaaaacaaaaacaacagaactacattgtttttaggctttggtagaagcaatttactgcaagtccatttgcagcaacaaaaatgtctgactaaagacgcaaatttttattgagaagtatgttttacttaagtgtaaatcaaaactctagtcttagatgaaggagagtaggcatggattgaacttagtggtaaatgtttagatacatacttgaagatggtaaacttagggtcaggcatacataagtttgaattaaacttttgctctgcaaacttttttttttttttttggagatggagtcttgctctgtcacccaggctggagtgtggtcacacgatgttggctcactgcagcctctgcctcctgggttcaagtgattctcctgcctcagcctcctgagtagctggattacaggtgcgtgctatacgcccggctaatttttgtatttttagtagagacggggtttcaccatgttggtcaggctgctcttgaactcctgaccttatgatccacccgcctcagcctcccatagtggcatgagccaccacgcgcggccgcaaacctcattttttaaaaatgaggagctgtaaatatacataatagagtaggtatttgttaaataccattgtccatatattttgattccacaaactctcaaacacagttctgttaagtcctgccaaataatttgatacttggacatatggtttgtgttaaaagattcatggtacatcctgagatgtgaaattaccacttttttctcatgatacacaaacaatcctatctcactagacagaaaagagagcaagcattggagctggacagacctgtgtggatcctgcctctaccacattttagctgtttatctttctccaggtcactctatgaccctcagtcataataaaataaaataaaataaataaaattaaataaaatagtagtaataacgcttcttagtgtgtgagaatacaaaaaggtacatatgtatatacttgtatgtataaacctatagatacatatatgcatgaatacatgcatgcctgcatatgcgcacaaacactttcagttcttggcatgaatagatgaccctatattgatgctcagtaaggaatagctgttactgttatgttatttatccatcctacactccctgtttcattctctaacaggttgttctaaatctctatcattcttcttacatccttacattcttagcacatcccatttcattgaaaagatcagggcacaacagcctggattctttcaactttacactctgtacctcagaatttcttgattaattgtcctttcctcttgcctaaaaacaaactatacttggttctatcatctctcctctgcaaaaccttgctcttctctctctaagctctgcatttttcctctacccagcttccccttcataattcagcattgctaccacattcctttcttcctctggcaaagtggctttctacgcttctcctttggtctgtgatctcatgcttgttacagagtggctgggggcaggaactcttttattattgagggacttttcatgtcaaagaaaaaaaacatatattgtgctaaacgattaacctcaaacattacaggctattttcagacactgcaagccttgtggctcaggagatggaacactatatgtggttgagctgtgaatattcacccaggaagccatttatttgctcctgaaattgctttttatacttttgccatttagtttgatgccacagaaagttcaccgaaattttttacatttcaagtcacatttgagtttttcttttagtgcttgtgaattgctttaaggaatggagcaagatttaagtgaaattgtaatatccgtgaaatttctcagtactaaggtgaaaactgtataattccatttgcgagccacgtttagaaagagtatcttgaacaaagattgaagtttattgtcatgataatgacttttaaagagtaatagataaaactctcatcactggaaaggacttgatcatttactctatcccatagaaattcattctatgtagttgagttaatgtgaaaagccaatttggaataaacagttttaatatatagaaccctatgagttactttttattttaatttggaaattgaggtaacagcccaggtttcagcgtttgaattatgacgtgataaagcattaatttatagctcaagaaagtaaaatacgcctttattaaagacctaagctgaacatctttttgttatcttcaacctgacattttcctgttttgttgttcttgaatgaataagatactcagaatcaaaatcattatagctataaaaatcattttacttaaaagaaaaattgccaatctgaatagaagttgaatgacactcctttatgtgcttttggtgataaatatgtattctttattctcacacatttttagtcactaagtgaattttacagtattgctttaaaaagggatgaggtatcattttattctttctgtcaaaataatacctgctaggtgttttaatcatgcattttatttaaaataaataccaaaatcaatgaaaaaggcaaaagcatgcattaaaaaaataagtacatctatataaacatcagttgtttatttttaattcattaattggctttataataattttaaacgccatagtaatatagttgtcaaaatatggacacatacattttcaggtattgttatatctgagagaacatgtttttatccatatttcagccatttatatttaatcagatgtataattaatggagcattctccaccttatattgttttaatttttgtctacttagattaacctcaaaaggcaggcttctttcgttgtttttggcatagtcttgcttattacagagtaaaattatgaacattgtaaaaatatagaggcctacagtatttcttcttgaaggcaagcacttgaagctttcctgtattcatcatcctaattacagtcactcattcaagcaacatacctttattgagctcttgctatctgtgcagctgtgttgtaagcacttgagatacagctctataaaacaaaacaaaacaaaacaaaacaaacagacaggagtctctgctgttggtggaacatacaagaggtttattacattagagcaacaccaattagtctttaaaaaccacatggcgttcacatttgcaataataacttgtcagtttgatttgaattccatttcaataattgcgtgatgggttctcttctttgaaattactgtcatgtacgagtaaccaggttttccttggacaaatgtgttggtatcaaagttaatgtgaacctgctgactgaagatcttttttggccctaatgttttagggttctcccaacatgtctttctagaaggggacacgcagccccaagagcaactgatcagccagtcattaggggaaaacatcctgctcgctcaaggtcgagtgagcactctagtatcagaacactgtgttctatgcaccaccttgtccctggagggtcggcgccaccttctccgcttctgacaaggtcgctattcagtgtccccctcagcattcatgtcctgcctccgggtgttggtgtggtgttgtaccttcctgagcacttgaagctttcactcattttgacaccataacttttaatcctttctttgtgacacttaaatctctctcacatcctctattacttgcatctatcttcactgtgctggtggtatactatagtttctgccaattagctctcattgaaaattaaatttggctgtgttatgtcctttcatctgtttgtggcatattcatatataatttttttaattatgtgaaatttttatgataaattacctggagttaaatgtgtgcttactttaaaaagcataagaggaaattttaaaaatcttttatatgtgttcagtaaagtgttaagagtgttttaaagttcttcagtttgaaaagtgtttaaatgccaacagatggaagtccgcttaatcctgggcagtagtaatatatcggcacacttctcaaacttttatttgtaattttaatgctagcaccagtgtatttcataacatatgtccaggattattttaaatatctttcaaatttgttcctatttagaaataaagtacaagtgagtggtaatttataaaagtctgcagctagaattcttatcagttataaataattctatagtcaatatcaatttaagagtagcagtttaggcaacagcctttcttgcctcatttatccatattgttaagatccagaggctgtaattagatgtatttggttcagtactgccaaaactgaataacttgcccaggtagaacaacttaatagaaagttaatgaaaagaagtgaattggattctgctcagtttaagaattcattatgtagaactgtgtgtggtgcacattgccctatctcatttaacccctttttgtaatattccatttacacatatcataaaaagtgtttgattctgctcccattggcccagtgagggggtttatgtctattttaatcgtaacagaaaggaggaaagatttttgtcagaccacattggaatttcattgtttcatgcccgctttgctttttgcctgcagaatgcaccgacagagaagtccaacacaatctcctccagcagacacatcgttcagcagtcgcaggggaagacagctcccacaagtgccagtgagaagcggcagtatagaacaaggtatccgataaagagagatcattgtccaaaaatcttggatttgagaacctcctctatttataccccttttattaaatgaatagtattttgattatatgtagtttgctgcatcctaaaaatttgattttcttacagttttatccccaacacctagtgacagtggttcatggcatgcactcagtttttgctgagtgagttttgctggatgattgaattttagatggtcatttaacagaagggatttagggctagaaacatcttattccaaagtgacaaaggaaaaaaataaaatttaaaaatctcattgcaatatggcattttatgtgttaaaagaatattttatcttttaaaagattttttaaaaattaaacacttaatcatactgaatcctttacaaattttttaatttaacttgattagcagtagcctatattttaagtttgatgatgaaaaaaatgacagaacacatgttttagtgtcttcagcagttcatattgcttaaagatttccttattttatgcatatattatttcattttctgagcaacaaagaaagagaaagagagagagaatgtatacggtctgattttagtagaaactaaattttctaaactacctgagctagatgatttagacactacgttaaaatagtattcttcatgtgacccaaagtgctatcacatatcttagtagatgacatgacttgttatcattattttttatcacatgtttttaatcaggaatttggtaagcaatttactaaaataatttctactttgggattgtaatataaatgtagtagaattacttttaagatatttattaaaaacctttatccctatgaaacaactgaaaggttaacactttgaatatttttttcagcagtgttattgttgctgatggaaaacttgcatttcattttatattgagggtacgggggtacatgtttttctcacttaattcaagtgatttactgaatgtatcacagatatgtcaaagatctcagaaggtaaatgcattgtttcaaagactgatgtggcatagattgccatgcagaatacttgattatggaaaacttagtgtagatttttaaaggtatcaacttattaatagagtaacactggtgtgataaactctgagtttatattttttaaaatacattctattgatactccatgctttagttttcagggttgctaaaatggtattcatttagtgaatcatgaaaatatgatgcattgtgaaactctgactttcttttttaaaatcgcagttaattcattggaattattcattgacatgtttaacatttttcctctcctctctgggaacattttaaaattattcataattaatctggcaataacccagatgaaattgttttaaaatttattttttaaagcaaaagttggtgtttatttaaattatctattcatgagctcctgttgcacaactgaaagaactacaaatgtgggtgtttagttacaaactcggtcttaccgatcatattttgctaaagattgatattctaaaagtcatgtgctcctaaaattctttgcatttccttcagttgcaaataaaacattttatgggttcaaaagcatataagggtactgcatataactctcctatagtgagattctgattacattatttctgtagaaataagaattccttccacaaaataagttgtattgtatgttggattttggttttttaaaaaagctcatgttctattgttaatataaatgttactgtttatgatattcatattcacagttgtctttcagagaaatcatcaatttgtaaggattgaattgaggtgggaagaagggaatgactacattggtggagttactttgatatttaatatgacaaatacactaataaacattttggttatttgagtttcctgaaatatatgatctttagagttatatacatacagcttttaagaaatgtgacaacaagcatgtattttatatatctatatatataaatgttctataaataaaagagacctggttggtgttttttatgatataaatatgtgctttaggacttttggtaaatgattataccgtctgccatcatctttttatggttctatttcaaaatgaacagtccacatgacagctttgtttgtcctaaaatatgtttaaaaaagtaaattttaatttgatttatgagttagataggatttagcatgttctatttaagattgatttcattgttgttcttaaggctgtagaattatgccattttattattttgaaattacttgttaaactttagttccatctcccatgaagattaatgctgaccacagtctattacaattggttaagcccctactgcacttgacttccttcccattttttaaaaatgtttaacaaagggtgattttctgtttagaaataatttgataagcagctgattggtaagaacaaatatttcaaatggtttagattactagatactgatacaccttcttgaggcacttataaaataattttattaatataccgtttctgggtacagttatctacattactgattttggaatgtatgccaggacaatttgactgtttcactggaagtattttttttcttataaatcaaatataccactctctatttataccataaaggcagtatctcttaaaggctaacatatcatttggaaacacatgtttaatcaatttttgaaaaggtgttttaaagttcattttaaaaattgagaatgctagcctatttgctacatagagccagattatgttgaagtagatttaggggaaaaacaaagaggtgatcacaatacagatttttgcggtagagtacttgaaacagtagccttataatttaagtaactctaatggtatgtgataattgaaagcaaagacttccacaaaatttttctggttatatttcaacacaatatcccagcatatcccttatgtagagtaaggctgaagataacttaattggttgtataaaaatggatttctgaagccaaccagtaacttttttgtgctcaactggatcttttaaagaaggatttagagatgattcacaaactaacagtaaatgatgtgttaattatgttttatatcttccattattatatcacctatctaaaactccaatgatattcctcttcagaaatacagaaacaggccattagtcctctgtaaatgatacaaaacaaagaggtggatataaagccttataaaatgtctaagaagtatagtctctacaaaacaactaattttactttggggtattttaatctaattaatttcagaagaaaaaaggattacttaaattagaattttctttcatgtggaaaatgttacagaatagtttccgtggtgcaaacaaagtgtaaaaatggaatttattttttgcttatcagataaaaaaataaatttcattttatcatatgagcctttatcacatgaactttcatttttgaaatgataaaaatttttgttatgaaaattaagtatgcttttaaatgcttttccaaaaaaaatcacaatggattcaagttaagatgttttaataaaattggtactgaaattttatacagctcttaaaaggaaagaaaaaataatacagaatatatttttcaaatgccaaacatactaatttcccaatgtttttgtttcattttaaatctttaaattgctgtattcattctttctttgattaattttagtaccatatttgggaactcatggtttttcattgcaatttatcatgtcacattatatgttatgcattttaattattcatgccattgtgttaattcacatttccatgtctaactataaatttgctgatttctttcttttgtttccatcattatgtgcatttaattcattgaagaacaagaaaaatataactcttccacaaaaggtaaatattaacataactttttaaccatttaatattgttacttttaaaaatataatatacaagagttatataactgtatttattgaaataatgagcaaaattaacaggtagctattttcctcaaatgattttgtagtgtatttgatattaattatttcatattctatgttcacatcaaagaagagaagattactttaaaattaatgttttttaaaaattttatttaaaattaatgtttttttaaaaatttatttatctatactgacaactagaaaacaattctcctaggaaaatgacattttctttgtttctgtttgtttgcatttccctgctctcatagataaaagatttaattctattcagggtaatacctggtaaaagtagaaaatctctggattttactttccagatagtggtaaccttagtgaatgttctggccctggctgcagtcatacatctgagaagctgctgcctaaatgttacttctgtttgcctcaatactgttaaaatacccattaattttatctttctgagagtcatgggagaagaaaaccattcagcatttttggtctttgcacttgaatttcaaataggttgcaggcttccccctacagtcatatgctgcccacaccattttctgttcagagttgctgttggcctgataattaactatttgaacatgagttttcagcttaatgtgataaggttaattatatttaataattatataattctgtataatttaataaaagtacattttctcaatatttgaaagtggactgattgaattaatttgttgcccatagtaacaacaaattaactcaaagctagttctgaaagtaacatcattcctattttaggaataaggacacaagttcagagagattatgacatttgcccaaactgcttgtcagtagtagactacaaacccagatctttttactttcgaccttttcctctacatgttggtgtatcctattttagtaagtacaaataccaaatatattatttctcacccttagcatatttagttatgcattatgtatctcggtattacaaagagaacagtttcaattacatatttgatctgtatttataaaaatgtatttaacaatatttatattcaggcactatacatatatatattattctggcatagtgtctgatatattaggcaatacatatattaattaaaaaattaaaaaattcagtgagatcaagatgttttggccatagattttgcatagatttctagccatcttgctgcatttttatgtcagatattgaaaacacaacattagattcagtagtacaagaatgaccaatgtactttacttaggtcagaagaatgtagttggatttgcaagataaattttagtgggctaaaagtattagattcatattagaaatgggccatgatctaattcctttatccaaaagaaagaaaaatgtaataattcttcatttagagccctttccatatatattactaggcaaaagctgtacctagctaaataaaacaaaacaaaatccataagtataacctaaagtctgcatgaaatatgcacatttagggcctctgtgcagaacatgtcagtttgtttttatacagtcagtgtgtcctggctgagaggtgtcatcacccctccaagcgttccttggaaacaggatgtagaaatgcctcacagaatagaccacatttttagaaataaccaaagaagcacatcccaaaatgcgtccaggaaggtataggtcagaaaaagaatgctgcgcctctccttagggatttaagataacacagtttagccactgaacgtggctctcaaaactttgaaagaatagaagcaaggtcaagaaatttcattaaaatcgtattttaagctcacgtaacccaaaagaaaggaaaagttcacagcatagaaatcctacttctgtgagctgaagtttgtctttgctgggatctatcttattagagaattcaggttattgtgagtacatcccggataaatgaagaccagtacacaagccaaggggttcattagggtttattttttattaactgtagatgaacttgtaggacaaccagtggttccagtttgtcagggactgagggttttcccaagatgcaagactttcagtgctgaaactgggacagttctaagcaaacgaggatggttggttaccctatagggaaccagtctattaattttacagcatatgtttttaaagtcacataaagagaagtgtaaaatactcaaagcattactaatggtagataggctatattgagcacttactatatgtcagtgactctactaaaagtgttacatatttatctcattatattttcacaacaacttgagacctaactattagtatctttattttcccgccgaaaagctaaaagttaggttaaaaacttggccccttatcagtcagtatttcattttgtaaatgatagaataggaaacgagacacagatccccctccagggaacttgttctcatccactttgctctgtagactcttcaacattcagacagcatttactgagtaactgctttgcatgcatcaccacgtaattatagtaacacatttacaactgcaaggaaggcttttttcacccctgttttattgaaatagagtgaaagaggttaagttgaatgccaaaggtaaaaaagctgctgtgaggcagaaccagattttgaatccacagcccatgttctgtgctccacaccacgttcctgtaacaatcaccactcagcactgggattttggagaagcccacttagtttctcctccctttccctattgacccaattttgcagcattcagttaaaccttctacatctggcctgctcctccaattgccatacagataacaaatcctttggcttgaaagttaacaaagctaacaaagataacacatcctttggcttgaaaagttaaccaagggactataaatgttcatagtactttgtttacattttaactccctcttttatgttgaaagctgaaagaccatatcattttagtcttcacaaactgctttataggcctattttaaattattcattctaaaagtaagccaatttttccctctctgctacatttcttggacagttttaaagagcccatgaatgtagtttgggggcatcgaaataatgatataagaagatcaaaactgaaccagaaattaaatgacttcaaggtgagaaaaatgttattgtcgtaataaatttatgatttatatgcctttagatactattttttaagtgcattaagtttttggctcttggaagcaattttgaatcataacaaaacacatcatattatctcttctacaaatatgaatttccttaatcataatagtgtgtaatttatacacatggagaatgaaaggcaattaaagtaagtaaattattatttataggaacaaagtaaatagcattttggtgctttttgcttttctgtttcactaataaaatatgtgataattattgtaactagatcatagagattgtaactagatcattaggattgtctctagtcaactatattttttttaagtaccaggtttctttaataagttctcaagtaagttaactgtgttttccttctttaaatgtcagcaagaacagtttgaatgctaagttatgcaaactatattttccatgaaacttatgagcattaactttactttagtggaattcaagtaaagaagcgaaaaacattaattttagcattttttgtacagttgtataaataaaaattaagcacatttcaatagcgtactgtggttgtgaaacactataagaacaaattatgtactctttttaaaataagtaaaccaatttttgtgtttttcagaatcagcattcttttaactgtcattaagtagcaaaggtctcagttttatttacatttttattagtagtagtagatgcatattagtccaggtgaatcattttctgttattgtgtgttaagatttcaaaaatacaagtttcttaatattcctgggcattgcttctcctgaacacttattatgaatcttaatgaatatttactcataaatatttagagctccattaggaaaagtaatttatccatctctttttttggcacaatctcataaatatattgtcattgtagccttctctttaaacttcaggatcccagagggttaagcagattgattagaaaaattcagaagtaatgcttttgaccctgttttcccatttggtgattcagatgtgtttatttatagtgtcataggcttttaaagcttcaaaggatttaacacatgttaaccaagacacaacttgcaagagagacctaattgaggaaaacaaatgtctaaccatggacaggctctttgatgtattttctctaaagttgtatatgttccccaaatattgtaaaacacaggaaaagactttcaaaaatcaaatttaaatttagcagaattgtgccaatcaagtctttcaggatagattctgtatccattagtattattggagtaatgagaaattatggctaaacattttagagatcacttggtataaataacatggcttcctcagtgattggttttgttatcccccaaagaaggcttaattacacaggttgctttttgtaaaaattgtatttgaagtgcatcttatgggagatagtgttccctctcaaaacctaaacatgcttttaaaaattgtttaactttgtataaccctaaaggacaagatatataacaaattcttttataagagcctgactttcttacttgccaatgactagtattttcagtgacactctgagaattggcagttttacattgagaaattatgtctggagttggacatcctgagcttcgttttagatagttcaatgggaataggtgtgctaaaacaggagatggtcttgtggttttggctgcagtgagacttaagtgattatatatacaaattgcctctttcacctatgccaatgttaaatttcacttatctaaacataggtactttgctttaaaagtccgtaaggcaatgtggtattttcacttatgtgttactcacttattgcattttctgtttctcatgctggtagatgtatgctttattggtagatgatgggtaaatgtttattttattggtagatgctggatagatgttcttttattgtttatattactgtagcataatccttaacatccaagagaaaaggatgttataagggaaaatgggaaactacttggaacatttttacacttacaagttgaaaggggtcattttattccaagaaagtgtgccagaactagggcatttctatgtagtcaaaatattttaaaatttaatctttatgtataatatatatgtgtgtgaagatgtagaagttggatatgcactacatcaaagtctctcactatgtttgcatgactccaaaaataaggatcaacatgaaaataaaacattgcagttggcccacagtatccatgggttccacaatggtggctttaaccaaccatggatcaaaaatgtttggggggaaaatgattggtagcatctgtactgaatatgtacacacttttttttcttgtcattattctataaacaatacagtataacagattcatgagatttttttaagttgtaagccatttaataatacgaaagggatagatttagaaaaatgcatataggcactatttacatgacattttccttgtattagctcttataagtaacctagagatgaaagtatatgagatgaggtgcttaggttatatacaaatactatgccattttatataagaaacttgagcatccgtgaattttggtacatgtggtgggtgggttcctggaatcaatcctgaacagatgttttttaaattgggaaaataacatgatagaaaatagtggtgtaaaatacaactggtgaatttttttcctcgtgatacctatagtcaattggaaaattttaaaatctggaaattaggtaataaagcaagagacaaagtcattgagattcctatttttgcaaatataagaaaagtattttaacaataccctattgaaatactatagaatcatagactacaactgctggaaggttctctgagcagtctcttctttttacagataaaaattctgtaatggagggatatatcaggaattgatcaaaggaacattgaggaactgatgaatggtgatggatctaggactgtaatctatgcctagtaattcccattcctaggttcttactattttgccacattgattccaggtatatgcagaatgcttatccatataaacaattcctatttctctaaagtctaaaaaactgtgggcagagactagtattgtatttttgaattttcaaataaaccatctttcttgatatattttaagatatagtttatacattaaatatttctgatatttaatgtatcagatctgatcttcctattcagtcttggtatagtctatactgattcaattagctaaacctttttcatcttttcttgttaatctcagctttttttttccactgcagtcaataactgaagcataggaggtgtgtcatttatattcttctgtctacctgacaacttccaaataagcggtcatttatcactgctcttcctgagagatgtactggaacaagaatgggactgcactatcatggagctctcattgtgttgctatacaacaaggaagcagagatgctagttttttcattcacaaaatatgatagcacatcatagttaactagacaggcttaaatatcctgtccaggtgttattgtgtgtcaactttgatacatatatgagctgaccttgttaaaaaataatttttacattaatatatttaataatataaaagttctacttatttctgtccttttacagtcatatttcatctaatgcttgaaaatattaggaggtttaacaatatatcaatataaattattttttgcctataaacacaaacgtctgaaatttcaaattcattttaatttcaaggtgcatagagagaaatgtgaaagatttaaggaattttgagatccaaacaaatttatttttatataaattaaatttatgaatattttaaatatattactgcaagtttaaattataagcgttctaaactatgtataactataatgtttacaatattttaaagcaaattacaaatatgtgataagtcaaagaggtttcctagaaaattactttatctctttgaaggaggttatattatagaaaattttaaatgatggattagggaagatttattaaggatttttgagggttttttaaagtcataggccttttaataatatgaaagggatagatctagaaaaatgcatataggacaaacaagattataaaatgattttagtttcttcatagatttattaaagatcattgataacactaaattaggaatccttagcaaagaatgtgaaaagagtagttattttaatatctttatttttaatactaatactttacatttgaaaattgtaataattacagtactttgtaaattatatttatttttcttatcttgcatactccagtcagattccttcttgttgagctttagaagacaagaaattatttcacagatatggttttcatttaactcttaaaaataagttccagttttatactttcttaattttaacattgaattgatttgtgacatacatagattaatattaaaaaagccatagtttggaaagaacaatgtatataaagttggaataaataaaatggatcttgttcaataaatacatttttgtaaactaataagtgctttttgaaagtaccatttttttaaaacataaggcacataattcagttggtaccttatagtgaaatatttcaacccttcaaccccatttttataaaattgtaatattacatctgaggaactaagatacatacattttgatctataatcacaaaatctataattaatgctgaaatatagtctatagtaaatatctttatctttcgactttattatacataagctaaattttcattaaaagactaaatgaaattgcatgataattacatttcttgtaaaaaatgaaagttattatttagctcttgattatgtggcatttatgaaatttttaaaaataaaaaccacagggcctcccagttttaaattttctataaagaaatagcaactggcattttaatgatttagttagtttacaatactattaacattcagaatgttcctaaaatgtgaatgtaatgctaggatttgtggggtaattggaaaatactttatttactattttagttttgctcttgggtttaaaattgttaaaataatataaaaattttaaatgacagtaatctttttttaaaggaagatatttgagctgtctgagttacagttaattttacttatactaagatactagagagacagtcacatttcaagaattcaattaacttttaatcattactactattctccatataaatcatataacttattggaatcgtgccttctggttcaaatttgtggtaattgtcttattttataaatttgtcttaatatttggcttgacacatctgcaatacagaaataatgtcattttattctagatatatagttgaaaaataaacatggtaaaatctttagcaaagttaaagaatttccacatttacactgaaggtttttcagcgattatgaaaaaacttttactgaagcacaataacttgtataaacagttatttcagaatatgcactaaggcacatgtcattgggaaataatgaaaagtactaaaaaaagtgtgtgatattatgtaattatttggctttttgctacgagtaaataatgataagctattagcattttggttttgttggaatccgagagcaagagtgaggatagcatagcaactacatctttgattgagagtcaggggagtctactcatcattttgaatcataatgttaatttggagatttttttttcctttcacagattaaataaggtcagttttaacttcattgggagtaaatatagtatagtaatgatttgagggaggtaaaatgaaatcatttagaaccatttttagattcatgttagttgtattaccagtctttttatgatttagttttacattttgcaaataaagatttaaatgcagctatagcataagctaagtaatcctattaatgtttagagaaatgaagtgttgtcctagcaaggttcagtccctagatctgtgtcagactgcttctggccagtagctattgggatataattatccgtgtctaagtaaccatctaccctgaaaattacgtggcactaaaagtgaagcttgcaaagctgtgggctaatcaatgtcaacatatttttaaataaagttaatatcattttatgagaatagttaagctaacaccatttaagtctgtttttattacaaattgagattgttttgagttgctttaagctttaattatagagcagaactaaatttgcagtccatttgacttactcagaactcaaagcaaatgattgagcgtgtacccagaagtactcacaccataggcaaaagacagagaacagatattttcacattttctatattgcatatgtcttttgtaaatataactcacatttttcaataactgtctcagtttctaattactcttacatagcattttactgtataatactccttttaactccttatatgttgccaagtaatgaatttctgaaccacattgctcaagctctccattgaactatcctgtaatggtaataatagtcaccatttattatctctgaagtcaacattattaaagcaggggtgtatcattgcttagtttgcataactaagggttgttagggatttgagattggttatctaatttgctgaatttaaacaaagtgaaacattttataatttactgataaaagtatgattaaaacacttagccacaaattccaaattttattatctcttgggctattggtctgcacttgaacacaataaaagttacagactgatttctttttttaaagtgtgtgttggcgttttataatcaaggatgataggccacatttagtcattgcaatggaaaaaaaattgtcagcaaatatctttatgaactccttgtaagagataaaatcagcagccaagtcaatcaaacatatcaacatttccattaacttgtaaaccattagtctcttggcagaagttcccactacatcagtgaccaataagcaattttccatacacacacacacgcatgctcacacacacacacacacagccctacaacttaaaaatctgaatacttgttgcagaagttgagttgtctgggaagttggcaaatgttgtataaagtaaacataagtctcatacaacataggtataagcttttgagtcgtttaccctacacatgactgtaccttagctgtttctttctccttcatttgtaaaaatgcaaaatttaaaggcaaggttttgaagtgatgttgctgatggtggattctaacttagaacaattcatactttatcaaaggctgcaattcttgccctcctctgctacttaggagattaataaaagcttaaaagtattctttacatattataaattaaagggctgaaagtcatgtattcattttcaaacttacgaatttcatttatgtggtccggatatagccataaggaatagtgagctaatcttttagtaagtcagttttaaggactgggaaatagtcatgagaagccacggacagaaattaaagatttataagaatgcctcaataaagtagatacttattaattaaaacaatttttaggtgactactgttagctgagggtgttaagtgggtgtgtgcatgcatgtaagcatgtgcatatagtgcgatgtgctaagtatgcatacttgttttctctatatatgtacatgcaacaaacagttgtttaaattgaaaacattcttacaattaaatttggtttcgcataatcatttatgaaggaaattgaaaatatttcatataaaatcaagaaatagagtatattttgttactaacatttacgttccccattctgtgtaatttgaatcatgttcatctttagattaacagttgctagtactgtatattctgcatttttgtttaatttattaatcatgtgttatttctaaattttatttaattgaagtcatttcaaaagcattgaaatcttaaaccattcagttcctgaaaggttcttcacatgttttaataggcttccattatgtgtttttgcagcaagcttagtagtggaggagcgaacaagacagatgaaaatgaaagtgcatcgatttaagcagacaacagggtctggttctagtcaagaacttgatcgcgagcaatattccaaggtaaaattagtagtatccaacaaatagtttcccttttaaaaatgtgtagtgtgtgtaccaggcaggattagaaagcaccgaattatataagagaagttatcatttgggccgggcatggtagctcacacctgtaatcccagcagtttgggaggccaaggcaggcacatcacctaaggtcagaagttcaagaccagccaacatggttaaaccccatctctactaaaaaatacaaaaattagccgggcgtgcgcctgtaatcccagctacttgggaggctgaggtaggagaatcccttgaacctgggaggcggaagttgcagtgagccgagatcgcaccactgcacaccagcctgggtgacagagcaagactccatctaaaaaaacaaaaaaagaaaaggtatcattaaatgatagtcctgcatcataatttctaccaaagccaaaaaaacaaaaaactctttcctcttgatattttcgtgtgatataacttcattgaaatattaacttggatttgatttttttctaaaaatatgtaaatatttgatattaaaatcacttaatgattgattagcattagtcaaattcacataaataagcaagatatatgaagccattttgttgcttgaacattatttaaatattccatttaagatattaaggtatatatttatagtcttaagtacaactttggattgatatttgactattgatatttgtgaatgataaaaattatgtgatttgagatttcttacagctctgtctttagtaagaaaagtaactgatttcaaacttctagaagctgaaatttacacaatttcaagtgctaataagcatttaatttttatttcaataatattttctaaggaaacaccaaggagtttataaactgctaatatctgataattttaaataaaatagcatagatttttgttcttcatgaagtaattttaaatatattatctggtttatttaaaagctttttttctttatagaatactacaaaagtagcagcagccattataggttgacctttgttgtaatttaatatcaacaaactctttgggaggtaataagctattagaaatcaaaagtaaataaaactacactaaattaatattattagcttgaaatatggacctagaaaaacctacttatttttaagcagtgtaagtggttcattatctttccagatattctgtgactaataaaaaaataaaataaaaagaggtggctacaaaatacgatttatcaccaagactaccatagagtcatgtgtgtttgatacagtctgtcactttacatgttaggttagatgcagaagggcttccaaatgagacagtgtggagggtcactgtgattcagtgatgctcaactccctaagagtcttaccaaaaaaatggtaagcaaaataacctgatgtcccgtagtattgcctatttcagctccatacaggtttatcttgtctgcaacttgttatttatggtattatcacctaatcagcctacttatctgtcttcatagatatcatcatcgtttttgttttcttactacaaatgcagtgagaattagaaggcagggtaatttggggttttgttttccctctacagttggatgcagttatttgaaagtttctttaaactggaaatgctccttttaagctggaaatttttatcagtttcttagctttatttcaaaagatgaggtcaaatagaacagcaaggagaggtagagccagtataggaaacaagaaagaggcgagtaaagaatcagggtaaaatactgaaagcctttctggatcatcctgagctgggattctgatcattaattagtcgatccaaaaaatcgacaaaatgaagtactcagaagtctaaaccaccactagtagtcatagtaaaccaaaggtaggtgtgcagactccaaattctctgactcataacttaaaaacttgaaaataactcaaaatcttctactccagctcacttatttaccaaatttatgacaactggggctcagaatgaaagaggtaattaattaaaatttgtgttaaaattagtagagcctctctgtatagtgaagaggcctataacaatggatttgggacttagggtatgactttgttctacttacatcattgaaatgaacacattactctagattgattcaaaggtctccatgtggctttcaatttacctaaaaattagattagcatattctatctttcctccctcctttgcataggcaccctttttcttttcctctctctctttgcatttgactattttaaaacctattactttcagatatagtactatggctcttactgaatagatactactatgttaaataaaattgtaataactaaatatgagatcaaagatatggtagctttaaaaacttgtaagaatataggataggaaattatataaaataaaacaaatgattagccttttcttatatgtcaagtagaagataaaatactctccacatctctaatatttatattatatactaacacatacaatagaatttttttgttttcagtagccatttttgttaattcaagccttttgcatatacttgagaaattatctttttcatttttattctacatcaagtattttataactattttataaagatctatttttatggctataattaagagccagtattggcacaaattttatattcattaaattttgaactttattctgttattgactcttttttagtatcttaatccatttgacattttggacgaagcaatgaacattagttgaaatttatgccaagccaaagttagttaactattctcaaatacttttaaccaaccactagtagaactggactttttttcagggcaaaacattgtcagacaactgtaattcctgagatgcttcttgaaacctagtatgtcttttagaagactaaatgaccctaacatccatcctgagtaaggaattaggactaactttgcttttgaaaaagcacaacaatgctgtttaggtatccttgaaatgtgtcaccattctattttttttttattggtggtatacagagtggcataccttaatgatgaagtgaaattcataattagaggtgaattcacatttaggtactcacaatttaaagaatgtttatgtttgtgtttatgtaacccaggaacagcaaccgagagtgatgtgatgggttttgtaggtagctgaagagtgtttattattacttacttctaaaaatagtagtgtttaattatttctctcacatcaatgacttatttgccctctgtaggatcggtagaaattccttctgaggaattatgttcctcaaaatatattttatgtatttccattaaaatattaaattgttacattcaaaatttaacagatcatgcctgatgaaattcagtgattaaaatgttaacatattagttaaaagtgaatataaaagtatttcactttcttcaaataatcaatgtgaataaaactgtgatatcatatcagaatgatagattattctttatctcaatataaaaaatgtattatgacataatttttgaaatccctttttgtccactttctggaataacaaaggtctgtatacaaaaaggttgaagaaaagatggcttaagtaaagccatcttttggcttatttccaactaaaaatatttttgttggaaaaatattttcatatacattcacatacctttatgctttagtgtacactgcttaatattgtcaaatatcaaataaggggagcatttgctctgggtatcagcacaatgctaacacccaaaacagggattatttcatattctgtcatgggcaaggtatcatcccaatacatttggagacaataattacatagcatctctcttttagcacagtgtttcaaaaaaccaataatacaggagttgtgtttgtaacgcagcaacagtgttaaattcaggttctactctttgaacataattgagtttttagcacatatactctgtaaattgaaaacagatctgattaaaatgaattgtgttagtcagaatcatgttattaaatataactgaatttgctggtaaaccatattgtcacattgctttcagtacattgtcttaaatcacattaattttagatcaaacatgaaatcatataaatattaatagctcagtttagatataataacatatgaatttcctttgaattctaatttggcatatgactttgagagataaatcacacaattatgaaaaatccttgggaaaactaattgtatatatatcctatatgttgggaattattttcatgcctgatatgaaattcttttatcaacacatacacatgagaggtaaagaaataaaaatcacatttagggaggccgaggtgggtggattgtctgaggtcaggagtttaagaccagcctgggtaacacggtgaaaccccgtctctactaaaatacaaaaaactagccaggtgtggcaccgtgcgcctgtagtcccagctacttgggaggctgaggcaggagaattgcttaaatctgggaggctaaggttggagtgagccaggatcgcgccactgcactccagcctgggcaacagagggagaatctgtctccaaaaacaagaacagaactcacatttaatgtttcagtcctaaactactctcatgtaagaaattattaaataaacatgagacctttctctagggtaatttttaagtgttattgtctaatcttctttttagtacctataaatccaggttgtagcatcagttaatttagtatgttttagcaagacagttcaaattcattaaaattcctctgacatggaacatcacaaaggatagatgactttttctacaggtttaataaacatttgatatttcatactttatttctcataaatctaaaattaaattgcttgctaagaaacaaacacccatatgttattttgttttacagaagaagttatagtatcttaccttccagtatctaagaaaactactcacattttaggtatctttcagttatttatagttatgtaacctatttattacaattataacatatataaaaataatatgtaatatataagctattcactgtgtggttcatcacaataagacagtgaagtagaaataagagtagcttaactgctttgacagctttgcatattttaatcttttatttgatgattcctaaaattttaggaaatgaatatcagagacaaatttaaaggcatctttgaataaaagatataatgtacaatgaaattttaataaggatccagtattctacttttgattctaagttagtaggttaaatctgaaactgtctaatgaagccatagtagaaagctaaagaccagtcactgcctctttgctcagtttatatcagcccttgtttttgaaaagttatatatttttaagaaatgttagagacactataatgtcttagaaagtatttaactaaattgactagttttagaaagtatcaaaaactatatacaggtggaagcagtctatacaggtcaagtatcccttacccaaaatgcttgggaccagaggtgtttcatattttggattttttcatattttggtatattttttctatatacattatatattttccagttgagcatcctaatctgaaaatccaaaatgttccactgagcatttcttttacacatcatgtcagtgctcaaaaagttttggattttggagcacttcagattttgaattttttgattaggaatgctcagcctatactttgactagagtagaaggtgaataaaatggacaagaatgaaaatgaaaacaaaaaagagaagcgtatgtactagaaaaaaaatgaataatacacttttgaggttctaaatatgtacaaataatttaatgacttttccaatcaggcatttaatgattgtgtttaatttatatttcagtcttcataagccatctcttaccactcaaaggataatgtttttatattggaaatcatatggtagtatttggattattttagatattacagctactcttatgaaggtacacctttatttggtgtgggctaagtagtcattcatctcaccatctatgttttttccattgtctaatgatggagctcacactttcttgtttttaatctttagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcaggtgagttggcaatactgtttatataaactggatctttatctgtgatataaaaatacaactagcttcctgaatattttttctataatacagtttaggtcacagtgggttaagtatttatcgactactatgtagtattgccaacagaatgtttagtattgactactatcagatacagcttataaccctagtcacaattttagagatcactctgagtcacatttgtagtagtttcctctaatatgattaaattcccttcctttagtccaacatcagaaagtgtattctttaaagggacagacagtaaatatttcaggctttgcagaacagtctttgtggcaactactcaacaatgtcattatagtgtgacagctacataaataaatcaacatgggtgtgtgtgtgtatgtgggtgtagtggatgtgttaacaaaatagacatccctagttacgttatgagttgaaaggcatttgcgtcaattttgtttaagtcaccagtagtgcttttgtattcttaaaagacaaataccctgctgaaagggaaaagaccccagacatccaagtgctatctaaactaaagcagattgattatggacaaaacatattttgtattagttctttactagttttcagaagtcaaagtttcatatagttatagtcgtgtaacctaaaaatttattacaatttaaggaattttggtgttgatgagaggtccaataaatataagtgttaaaaatatgaacaaacacttttccaatactctgaaaggctgatgttagtgcacattttgatgatgtacaatgaattgaattttgaaaattctctcttgtttgttgaagcaaattaaaagtaatcatcctgctgttatttaacaatttcatactctgataatctaacatgagcaatttcaactgataaagatattagtagaaaatcttttatctttacttttggtgttctcagcatctgactctaaaagaatataaagttctttaaaatttaaggaagaattataagagctcaagaatgtagccatattaagctaagatcaaggggtaagaagtattcttatagattcctttttattgaattcttaataagatagaatgttttttaaactgttgaattaccaaagaatgtaataaataggatgtaaccaaggactttttttttaccttattcactgaaaacaatttgaagtaatttttgtttgtattcactgtagagccaagtaccttgagccctatgctttaaagtagtactagtgaatagaatttgtattactaaccaattgcatagaataacttgtgagttcattttcattctcctaaaatttcagaagtaggattcttcaaaaatttatcttcctataaaatttggctatgtgatttcttttagaaagaataggaaaacaatgacaagagactatgattttatacaaggagaatggggaaaactacatgttagtagtgtattggaaccagtgttactttgtggagaacatggcaactcaacaaatcagcatggactataaccatatcatgacaagaagcaaaagatagaggatttttttgcttcattgcttcgtatgaattttcatatttagtgaagatggtgagaagaggggtggacctaaaaagagtataaataaacttcttagtgataaatctattttctctaagcacttttttgttttcagcttcctttcccttctttgtagtttaaaacccatataaactgagagtttattttatgtaagtggattatgtaaatttaagcactacagctaatagttaaacaagtttccccttaagctaacataaagagctacttttcttgtaatctcatactgtatgtcagtgatttgtcatatgcggtacatatttgctcttagaataattaggaagaatagagagaaaaaataagatgtgacacgtcttctcttctgacattcgtagactagttatcccttcatatgcattcttctgtctacatattctcatagacacacatgcagcagtacacacacacacacacacagagacacacaaacacatggagttattttgcttccctcgtcaatcctgtggtaaaaacctgagaggtgatagtttggaatgataaagaataaaatgacatcagcataaaagcatcaaagtcctgtgaacaagcattgcaggctcttcagatgtaaatattccctgcccttataggtaacactatgaggaataatttttcttaatatattactgtttcttctttattttttagcaactaacatctgcataatttctatagttgtttactcagctaattaattataatgatagaatatatttacatataagttgtaataataagcagcaaagttttttgttcctatcatgtgtaaggactttattatcttctttttaaaacaaacaaaacaaaaaaaaacattgtaaattcctgttatcttccccaccaccatgaccatgtagggtccagtctactccctaacctttttcccaaaaaaggtgctacctccttcccagacagatgagagagggcaggacttcaggctggatctaccattaggctctccctcccccagcttggagcacaggaggggaggtgatacctggtgacagatggatgggtggtggacagagaagaggagacaaggaagggctattccaggctcagccctgctcctccagccttgcctctgggtataggggaaacagaggcatgaccaggatcagggtcatgcccagctggccacaaccacgcgtggggtagtccaataaataccgtggatgctcagcaaggctgctacctggtgttttgaggctgctgtggttgcagacaccctcctggccttggctccctatcaagaagctggggatgggaggtggagggaggaggagcccctgccttaggagcctcacaggctgcaccaagagagcaaccagcctggagcaggagccaccaggtcccaagcatggctgacccaaatgtcatagatgcttttattgggtggcacctcctggaagagggtgtctagatcccagagcagcctgggggccctctggtttcagaggccactccctagtaggcagggccagttgacggtagacactggggacagtaggtgggtggtggtgccaagggcattaccacattgggagtgtagataggcaagtaggaggtgggcagctgcccccagggggaggccctgtgtcccccactggacagccacccaagaactgaggtgtcctgcagtagagtggagagaccaggccctaggctctgtggagagggtcgagggcccagtggctccctgctgggaagcctccccctccattcttatggggctgggaagagggcagagaggccacagaggcctctcagaggagggcaggggtggggtgggcaccacctcctccccactgctccccatgcctgaaggagctgggctgctctgtggcaccagtcccgaccagggtgccccctccccagagtcccctagcagggacttgatgctgaagccctcacggggtggcagcaggggactgggagcatctcgcagcaagtagggccgcaggtccttggtgaaggctccacatgcaccccagttctgccagcacctgcacagggctgtgttctgccaccatagcgactctgctgggatcaggcttatgtcgaccgcccagaagttgcccttggcctggagctttgcagggtccacaactatacatttagtaaaatttggcatttgatgtcagtaggcataataatcagtaagcatatactgaaaggaatgttcttctatttatttgaggattttaaaacaatatagattaaattattttatattttaagttgtgataacaaatatagaagttaatatattctggaatgtcaatcttgatattacagttatgtttgaaaagtgttatagaaaataatttcaaatgccccttatttcacaatagttcttcaattcagtaaggcaatacaggataaaattcaaaagtaatccttggatttttgtgatgcatatgaaaatcttgagttagagttatctatatatccaatacatgaagcttattatctacactgttccgaacttcaattgctttactactcttttgcctattcgatttggtatttactgaaaatgctcagttaagatctatgaagaggatttgtcaacttctttattattctgtccattttttcttatatgagattacttaattaggttcaagttcagaattattttgtctttctggcgatttaaccttttatcattatgtaataaatctctttattccttataatattattttgttttaaagtcagtttttcttacatgataacacaagctattttcagttagtgttcaatctaactattcactgttcacatctttttgtgtcaacttttctatgaccaatgtgttatactcacataaacagcaaatagctaggtttaatttttttctgaccacacaatctctatcatttaattggctagcttatcaatttgcatttattttgattcttatagacttggaattacttctatattggtgtatgcttttaatttttcttattctattttttctctttcctgatcggtttttaattgaattatttttctttcatttcccccctccattacactggaaattatgcagtttctgtgatttttactgactagtttctcaagtatataaattttgttaagtagtcaatttaaaattaataattacctctactttctcctaggaaaaaaaatgactgtcatatgcttcgctgtgctactatccctcccccatttgcatattcttgtacaatgttttaattatagattggttcattttccccttattgcatgttatttttttaaatgccttatattaaaccatatgtattctagtttctttgctaaccatttttcgtgcatcttagaccttcattctggatcattctcctctctgagaaaagtgcattagaaagccaccagtgagggtctgtgagagcttagactgagacacacgtttttccttgttgttctttaagggtcttgactcatgaggatttcagttctaactcctcactagacctgaaaggtttccaaagattcatcattcacttaccgacctgttttagttctcgtttggtttttggctaaggacatatgcctttctttcttgtgacctcaagttggtattttaacaggcatttgttgtaattttcccatcataattactaggcatttggaagtgaaaggattttttagaatcagaatatatcatctaccatactgccagaaatagttcatatttgatgtgttaccattttttaaaatttttttttaaatttgcttacttgaaaaggataatatttaaaaataattaataaataagaaaaaacatgtaggtgtgaaaagtaagaaggatcatggccctagagactttatcccaagttagagggcaaatgccaaggcagagcaagcagagttggatgttaaactggaagtaatatctaaggggcttaagaaaaataacaatcaggaacatagaaggagatggtgaagggagccaagaactggaaaactttcaggaaagaagagagtgccagcagagacaggaccatttcagtcatgaggtgtaatggaaggaggagaatgaagaactaatgtgggaggtaaaggttgatacagctcaaactgagaaagagattctgaagtctcagaggatattgaatataagggagaagaatgaagtgagcctgaagttaagggaatggttagtgattgctgaataaacagcatcttgtgatcagagttcctatgccaggacaatgtgaagactaccagcctgcccttaaagactgcttttgactcagatgtgaatctttggttctgtcagctatggctcagtacttctactaaccaatattgagagcttcattcaacaagtgtacaacttctttagaccttgattttttttcacttagtcatagatttattcatttacttattcaccagtcatttattgggtacatcttatacgcaggtgccgtacactatctagtataaaacaaaacacatgattcctagatctatgtttttagtggattttcatacaagtgtaataataatattaaatgtatattcatctgaaaaatgtgaatcatacctgccactcctaccttaccagactgtttgagaataaaatgaaatagtgtatatcagaatactttgaaaatatagcattttgctttataactcagttactgcatacatggtatgaagtattagataagttactttatacttttaagtcatccttgaatgtcttctgagagacggctaacacataatatagtgcaacggcatttaaaattcgaattttgattactaatatttaacttatccacttcacagtgcttcatggtgagttggatgaatttaacagttggatttgacacttgaagagttcagttttattcgagtgtttttcaaagttatgcccatggactgttggtgttctaatgaaccttattgtctccaagaattgcctgatagacaggagaaagttgtccaaggagcaggagaaaaactaaacggggaggagaattcctagactgcaggacttcagcaacttcaactaaagcagttctactagtatttgtttagtacaacagaagtctgtgaagtagtttatttttaaaaaggaagccaggcactgctgctttaaaaacatattgtaaaccaaaatatatggcacagtaaattctagtgctattacttccaaggagaaaattaaaatatgagatgtggttctacttctctagttattacctgtttttaaaattcagatagtaccataatttggctgaaggattatgcaatgtatagtgaaacttcagtataatacactaagaaaaaacaaattccaaagaaaaagaaaactactagaatgttctatattggtcttagttggtctgtttttctactatatattatgtttattatacacttggtatatgagataaatacttattattgttttttagcattttagctttaaatagcattatatagattgtccagggaaatatatattatttccaagctcattacttcagcttgtacagttaatagactttatactatgcttttttatactactcttgatatatgttcaatttaaagcaatatagtaaaatttttaaagtatatttttactttatcttttttattcatttagaaagtcatcatttaaagctttgtttctttactcattttaacatatgattaccttgatttcagctagactctcttaaagcatagacatgataaccaagtgcggattgattgatatttgctaactgtatacgtactacttatgcagcataatgaataaagaaagcatagaccttgatgtatcctcaagatggcatatatgctatttccttataattagtggaaatattttcaaagctttctgaatcactaatacaacaaattagttgtattatttgttactttgtaaactacaacagatatatcaaggcagcatttgtgtgtattcatctttaattttatgactttattatttgtgactcatttatatagttttatggtccatacatgatgtaagtaattgttttctcatgttttggtattcactgagtatgtatatcagcttttgtttaagtatgcatttgtttttgtatgtgttgcatttacaatagattagaaatacatgagcagatgtattcttaactggttacttgtaaaacaacatttattagaacaagtatgaaaacattatcggcttgtttagtattttaacagaataattatatgctttttacaccattatccacccagttcccaaatcaaagaactggaagccacccagatttttacctctccccagtcctcttcctaattcaatatttctcaatcctttttattatcactcccctaagggatcttttaggtgttcctttcctaattgccctccttacatgaaattttaatactagagacatactatttatatactgcaggcctttggaggaccactaaccattgtattatctaagatttttttgttccctctaccttcaccaagaatcagttatccccttctggggacagtatcactcccaatgggaatgcatgttcaaatgagtcatcaaggcctactcattttacttctcaaagagaactcatgatcacagatttaaagttacagagaacagatgtgtttactcacctcaattttataagaagactaaaaagactaaaaactccatctaacatgaaactaggatttaaccacatctgtaaataataagctatagaaagcaattttcaaattcagtgaaatctgaaccaaaatgagaggaaatgccaaaaatagttgcttacttgttcagctattgaacagaatgtgaagctctctaaaataaatgtcacagccttaaaaagtccaatgaaaaattcccttctagaatatgtaagagctaggggaagttttagccctggagcaccttgaaacagtattttatacctcatagtagcagactacatggactcagaagaggaccatctcaggtctgccattctgtggcagaagcagggtattgggggactgtatataggaatcaatgtggcaaaagctattcagtataatttacaaataaactggtatagcatgattttaacgtatgtcttcattatgaaatcctatgaacattttgataacaacataactggtctaattctacccttattcaaaaataagcaataatattacatggtcacagttccccaggcatgacagtatagtttatatcagactaacttctccacatataaaactataaaagctgaacaagaacaaataatgaacaagaacaaataatgaacaacaacagcaaaaactattggaaggcctttgagagcaacaaagcaggcagaaatttgagtagtttcaatttttgaaaggaggggaaaacacaaggtaagtggtaagttcatcctagtttcctctgaagttactttccaatttggtgacataggataatagagccgtaagcagagagcagtgttcttacttactaggctgagaaaataaatttcacaattcaggaactgacagagaaactggaaattgtgagggtggaaggcttcaaattttgctatagaattccttcatacgttgaccagtgacctgtctatgcacagggaagtttccaggaaagcaaacaaaaagcagcagctggaaggccaaagagccaagcacaaattccagcagctgccagtgctggggagatggattggacttcaagttcccatagttagaggggtatgacaaacacttttgatttcttttaaatatctcagaagggccaaactctagaaataagcattacactctgtgaataatagcaaatctttaaacccaaactctgtacaagaacaagacgaaatctttctgtcaatcaaatgagaattttacctattttggaggaaaataatatcatacagagcctccacagggtttcatccacacagttttacatctgattaaaatttatgagtcatgtttaacaacgagaaaaaggactacctggctaaacactaacaagagttatcaaatagagagagactttaaaatatctgtgattaatatgttaaagaaatcaaaggaggatggattatttaacagagacctggaatccattttaaaaaattaaattataatttaaaaattaaaaaaaagtaatagtgggtttaatgacatatgagaaacagtaaaaccaaggattaatgaactagtcagtagaaagtataggagttgatgtacagagagaagagacagaaattggaggagaatataaacaagttgaacatgatgaaaaattctaatgtatatagagtcccagaaggagaggaaatgacagaagcaacacttgaatactgaattacagaccgacaattttccaggactgataaaagacatcaaattacaaatctgaaatctttacatacccaataatatatgtaagagagaaaaaaatcagcattattgtaatcaaagtacagaaaactaaaggaaaacatttcttaaaagaatctcaggggaaaaaagagataatatctttggagaagcaaagatatgactagctgaaatttcagcacatattatgagaccccaaatttgatggaatggccaaaagaaagaactctgaaaggaaaaaacaaaaatgtccaacttacaattttatgcttagtaaatattacccagaaatatctttcaggaaataaataaatgagtgcatgcatgcatagatagatagatagatagatagatagatagatagatagatagatagatagagaacaaagagaattcatcatgaggtgaccagcactacaaaaaatactaatgggagttcatgttgaagaaaagtatctccagttggaagcactagccttgaggaagaatgaagaacattggaaagagttcataatgataaaaacaacatcttgtggtagttaaaacatatgtagacgtgaaaaatatataaaatacctgagtgaaaggtgggaggggagtaaatggaagtaagttattgtacagatcttgcattattttgaaattggttaaaatgtctaacttgaggatttaagtaagtcaaagtgcatattttaatctttagggtagtcactaatagcataatagaagaatgcacaactcagatgctaatagttgaaaaaatgtggaataataaaaatacctaattaggcaaaaggagaagtaaaacaacaaacagatgggatgactacaaataaacagaaagtggtggatggaactacatctgtatcaataattgcatcaaaagtaaatgtactcagtaaaaattaccaatatcatagaatgaaaggggacaataatacatattatagatatataaatgatattgtaaacaacttacgatagtaagtttttcaattcagatcacagtgagcaaactatggccagcaggctaaatctggcccactgcctattattgtgaataaaggtttactggaacacatctatgcccatttcctaatatatcgtctatggctgttttcccgccacaacaattgagtggttgcaacagagtcgagtagttgcaacagagtcagtatgaaatatttactatctggccctttacaaaataaattttcctaaccctgacttacatgaaatatacaaattttctgaaaagtacaacttactaaaaatgacataagaataaactaaaaagctgaagagttatatatttagtttcttaaatgattctgtaattgttttcaaccttttcaccaagaaatatcctgacccaggtagatcctgataattacaaatatttaaagaataaatactcttatcttccacaattttttcctaaggaacattttgaaactcggtgatggcagcctttccttgatgcatttggtaaggacattacaagatagaaaaaataggacaaaatctctcattaaaatagagagaccccaaacaaaattttagcaaattgaatccagatagagagagggatgataaatgatggatgaattcatagatcattatttacagtttatgtgattatgcatataggaaatatataaaatatttctcttcatgacaaacttagcttaaaaacaattacagtccatttacatatattcaatccactaaaagaacctagaagtctatataaatatatatatataataactattagaattaatgaattttgcagagtcactgggtataaggttaacgtatgaaaaggaattttatttttatgtactagcaacaaacaaaccttaggaaatgaaatttacaaaatgccatcaatgtaatatagtcagaaatataaaatacctagaaataaatctaagacctaggaataaactaacaaaatgtgcataagccctcaacactgaagactacttatagcttcacataaaactcaacacatgtatgtgtgtgggaatgagatttaataaaaattacagagatcattacttcttaaggtccagcttacttgaagagattgaatataaatagtgatctaacttgagttcattttttagttctgattcttattatcaaaataggtccaccagacacctttaggaggtatttaatgccaccttgattattaatcaccagtccctgtgttatgaccactgaaaattataggatggatgcctggagatggcttcttaatattgatcaacaatattgatctactgtttgtggttagtaacttgtgtattgatccagatgtaagtgtagggctcatataatttttgttatttaacttttaaaatttttgtaaacatcattgtgaacttatatgcattattattctttatactacttgttccttcttaaggcttacaatagaattatggtagacttctaggttcttttagtggattgaatgtatgtaaattgattgtaattgtttttaagctaagtttgtcatgaagagtgggaactatcctgacatagcccctcgtgtcttctgaaaacattcttgctttctgaaagaaggtgttttaggacttctgttttttatcctcttccaaaacgttgtgtcagcctccttacattgtaataatgggccaaagtctggcaaatgaaggtacagatttgattgtcttacattacccatcacttctgtatctataagtaacagtctatgtttgggaaagtaagcttctgatgctttaatgttattttattatttttaaaaattcttgtttaaattggtttcttgtttgtctgttaccataatttaattgattttatccacattacttgtttgtattttaccatctatacaatcagtacatattctacaattgatggcatgtcatcgtttaattagcatttttctttcttaggagagagactccatacccccattccagaattacttggtctgataggcagaacaatgtgcccccgacaaagggttcctatatcataatcctcagaaaaatggggaattggggtgtcagatggaattaaggttgctattgtctgaatttaaagtagggagcttgtacaaggttatccagtgggcccagtgtagtaacaggagtgcttataagtgaaaaaaggagggagcagagtcagtcaaagacagagatatgacaatagaagcagaggtcacagtgattccacatgtatgcaaccagccattgttccctttgatgacagaggaaggggccatcagttaaggaatttgggcagcctacataaactagaaaaggcaaagaaacatattctcccctaaagcctccagatgaaacatagcccagctgacaccttgattttagggcttctgacctccagaactgaaagataataaatttgtgttgttttaagccaccaaaaaaaaatacataaaataatgatgtgtcttaatactgatggcatctttgatttggctgaatgcgtatagacactttatcaccttttccatttaatgcttaattatttcataccaaatcatatgtgtaatttataatgtggaccaaagtgttattaccaccagatctcattttccatacctatcagtatgaggtccccaaaattcatttctttttatggttgataatatttcattgtatggatttaacacattttgtttctctattcatcagttgatgggcatttgttttgtttccatccactttttgacttttgcgaataattttgatatgaatagttcatatatgtttgtgtggatatatattttcgattctcttgagtatatacttaggaatggaattgctggatcatatggtagctctagtttacctgtatttaaagtgccatcatattttctaaagcagctgcatcactttacatccccatcagcaatgttgacggctccagtttctcctaattctagtcaacctttgttattgtctattttttattatagccatcctagtacatttaaagtagaatatcattgtggttttcataaacctgctgttaagccaaaattatcaaactactttgctatcttcaagaattcactttgattctactgagttagcaattttttgaaaagggaattttcttaaaatggtagcatttttaaagtattagaagttcagtttctttcttctctgggattctttaattctctatgctagaattaggtaagtactcacctgtacagatcaatcagaacagaagttctattaaatgtaaaataccattctactataaagacacatgcacaagtatgtttattacagcaatattcacaatagcaaagacttggaaccaacccaaatgccaatcagtgatagactggataaagaacatgtggcacatatacaccatggaatactatgcagccataaaagggtgaattcatgtcctttgcagggacatggatgaagctggaaatcatcattctcagcaaactaacacaggaacagaaaatcaaacaccacatgttctcactcataagtgggagttgaacaatgacaacacagggaggggaatatcacacaccaaggcctgtcagggggtagggggctatgggagggatagcattaggagaaatacctaatgtagatgatgggtttgatgggtgcagcaaaccaccatggcacgtatatacctatgtaacaaaccttcatgttctgcacatgtatctcagaacctaaagtgtaataaaaaaagaactccccccaaaaaatcttatgtaccccataaatatatatagctactatgtacccatgaaatcaaaaattaaaacttatttttaaaacaaaagtataaaaacaaaataccttgggatctaatatttgctacttggacaactatccctatggtatacacaaagtaagaatgtttttgtcaccaattaaaaatatttttttttagcaaacagaactagcaggttcagtgttaccacacagctatagggttaaaattaacgtagtaatctaagcctatattttaaagggtttttcttctttcagtatgcacaatatatttcttgagtgatgtgagtttttagtagcattcaaaaaaaaatacttgcaaaaattctaccaaactagattttctgtcatctgccacccagctttcaatgtattcctgacactgaaatctgctggccagccgtctgacagatttcacccataggtagattccctattgttactgccactagttgggaaagtattattagtcataagcaatgcagaatcagagtcagtcttgccaagaactggaaccagaaagaaacaaaacaaaacaaaacaaaacaaaaacatgcatagaaaaccagagtcagaaaaaaagaaaacagaaagaagactgtgctgttgcctcttgaggttaaatctagaagccaggaaaaggcatccttgggcttatagagcccatgaaatgccctgcttggacaacacagctaattggcttaagtagggagttcatttaagtgtctttggtgggacttccagtactatcagaacataattctccaaattaaaacactaatcaccagaaaaatagcaaatgttggagctttaattaattagtgagaaaaccgacagtataacaagctgtttccaaagatgatccaagaaacccttgtaattttgtacatgtacatatagttattggggaaaatggaatactaaaattagattactaagttagattcaaaactggataatgtattctaagtcaatgaaactatgacttaccagttatccactctagagccagatagtaatcatatgccctttattagtttttttttttcaaattaacatctaactttacaaagaatataaaatgtttggactacaattataagagtaaatactaagtcaaaattttacacttctgtagagagtcaaatgacccttaggtgctcttgttagccaatgcacaagcatgttagggaatgctcaagaaaagtggccagaaaaccaatttggttggttggttgggtttgtcttacttccaagattggatattttgttcttactctgagcagttgggtagatgggtgcctataatgtgatatggaagattggagagggagcaggttttttgagggttgaacactttatgtttgagagccttattagatatatccaagcagatacgtcagttgacagctggatatataaatctggagtccagggctgagtacaaggtgcaggaaaacaattgggatctgcagcatatagatactacataatgcttggaaccaggtgagacatctgtggagttcagttcatgtagaagaatataggccaaagggctgggcattgaggagctcctacatttagtgataaaagaggatcaaggtcctgccagtgaggcacaagtttggaaaatccattagaataaagtatttcaagacaagggaatcaaattctttgacaaatgcatgacatattgagaggtcaaaaggataaagactggtaagtgacaggatttgctgtgtggagttattagcgactgataaaagacagttttagtgaaatgttagggacaaagcctgattcaaattacttcagaaaaaaataggagaggatatataaataactacttgagatttttcagcaaaaagtctacaagaagggggggatcaaaaggaaagggattttgtttgacttttaaagatgggttatagcacagtatatttctatactgatcactttttttcacttcctactcataaatctattcattcagcaatgggaagggggctgtagcagttttagtggtgcataaagtgcatgctgttatgaaatatcagaatcccaatataaccagtacaaaatgtaaaacaaaggaccaggagacaacagtcatgaagctagagagactgagtagctttataaagcagaaaaccttaagatgtgtcttaaaagattcagatatgtataagcgataggaataatttttcaagaaacagaagcagaacaaatgaaaggtaagaaatggggcagtagaaagcatatttgtgctgtaatcttcagattgattagattaatctgactgattagattctatgaactgcctcctcagttagaagaaatgaaaataccttaaatgtttttcattgaatattataatattatagactgtttaggaagctacacaggtcctcataaaagaatgcttttaagcatctggacatatattttttgagaaaaaaaaactcatattttattcagccaatcatttttcatataacttaaccccctcccaatgataacacttgttatacatatttttctattttttccagaacttttatttgtcaaaattgtagaatatttcactgctaaaattggatacccgtgaaataaacttttgaatcttcccagttcatcttaaattttaataataaaatatgatagtagacatttccctatactcttaaacttctttataaactaaagaacattgcccagaatttcacaatggtgtttttttgtgactgatattagagatggaaatttcaagctgtaatagaattccatctttatggaaataatgggaagaaaaaagggtacatgttaattaattcatactttcctttaaaggttagaaaatcatcagaagagaagttttcaataaccattgtggagagtgggctaaaataattgatgagagatgagaaaccactgctttctctgttgtaggcattcgattgagcatggacattgtaactatgaaattgaccaaatcctgacatttctgtagattctccagcagaattctgcaagtaaaatagtaaagaaaagcagatagagtagccttaaggatgggtggcgtattagataatgcattcaaatatgttggtgaagacacagaagaaattgaccataatacttatcaggaaagaaagtctcctggagttgggaatataaatcccacaggaaacagtttgggattgatcatacataataatactctcatttgtgtctcaaaaaatgtacataaaatgcatagcaaaattatcagatttgcaaatgacttaaaattttgagttaatgaaaaactgactggaataagttgaaagaataagaatcatttattattatcagaattttgatgtggacaagttcaagtaatgcagctaagtattaaaaattacaaattgtcctcatcaagtagaggtctcaattttcaattcacaatccatgaaggatcctaaggaccagtcttacctcttttccgtagcttataaactctccttgctgatcttgctctcccacctttatgaactcacctcataccaatttctctctcattatatatatgacaacaaacttgttacataatcccaacactttctgttttataatttataatcatattaggattttttctgactcacatattaaatgtcctcactgttaaagatgctatatcagctagtgtgtattttgtagttcaaaacaagaagtagaaaatgaagaagatcaaaatggtaataagggtcatataattagtttttgcaaatattttgaggaaacataaaattaagagggtcattttaggtgtatcaaaccaggtttttattagacagaaatgtactggtctagatggataataaagctgcatatgcattgtaatttaaaaggttgtaagaatcctaacatcattctcagtaaactatcgcaaggacaaaaaaccaaacaccacatgttctcactcatagatgggaattgaacaatgagaacacatggacacaggaaggggaacatcacactctggggactgttgtggggtggggggaggggggagggatagcattaggagatatacctaatgctaaatgatgagttaatgggtgcagcacaccagcatggcacatgtatacatatgtaactaacctgcacattgtgcacatgtaccctaaaacttaaagtataaaaaaaaaaaaaaagaatcctaacatccatgctccctgcttgcttgccctacctctcctcaactctcagacgtagtttactttggctagtagaaaggagtttttcccagctaactttctatgctgcataaaataattaacaataatatattctttggggagagaaggaatctattcaggtaaactggtacaagctggtaacatagacaagttttgataggaaagaaaaaaataaaaagaaatcagcctacatcatgcgagtgtgaggcactgaaagaaggaaatgagatgaagaagtttgtgtggaggaagtggagcatgaggggacaaggaaggaggagggaaaacttaatccaaaagcattttgttgttgttgttttagttttagtttttgctttctttgcagtcttagactcattaagcaagatgtgttagttagaatcccaaagggaaattagaacaaatactgttttcatttcttaagccttgttatgtggcacatttaaagagtgtacgtttttaaaaatatttttctctctggaatatatatgaacttttcttaataattgaaatattttagtttttctctggtaacatagtaactatactgtttacaaaattggtcagtaacattcatctccccatgcatggcatttgttgcacttatttttacaatctttaaaaagattctaaattattccatgttgaaatggcattgttttaagccatgtctagtaataaatactttgcaggtggtggtgtgatactaaagtatttgtaggtatagatccactactcaactgcattttctccctaaaaatgtgtctggattatttcaaaataaattagatttagaatttcagtgatgctgacctgtaatttatggatgcatatatgtttttactttgtaaatatagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacaggtgagtgatgtgaattcaacctaaacaactcaattcttttatggagagaaaaacttgatcttcatgctatggcttgtgatggaattgtggcatatttggttcttctttgaaaagaaaatttatttttctgtctctgaaaatctgctaaatttatgggtttattttttctgtacagctctcttcacaaggtatcacttttaaatctgtaaagtggacagattttttaattaaaaaaattaaggtcatatttgcaaatatgcaaggaaatgcaaagaagtattaaacatccaaatttatttacatgcaacgaaagcaacagggttctctttttcaaaatgttccataattcaattacttatttttggctatatctatactttttatagaaaagaaggtcagttgtgcaacgtgacatatactcttcaaggtactgtataaatataataattgaactgtacttgctatagtttcaatgtaagtaaaaacccagcagtgatttttactttagaaaaatgggtcagtggttttatgcaaggagtaatgttttaatacaaatatgtgtttcagatattttctgctgcttataaatttaaaagcttaatgtcctaaaggtatatatttaaaaagcaaatacaaaagggagagtggctatttttgtattgtaaaatataacaaaacactgcttaaaattatataaaattggccagacagattagattattcattactatgctcaatactatgtaaaatcaaaggtaagtgaaatattgaagcaatttaaatagccagcaactgttttttctcttaaaaccaacattggttccattttctgttccttaatagcaagagccttatcacaaaatttacttataccaaaaagctttcacaaaatcctttttatatctcactcagcattctggaaagtacctattttaaattattcattctactggatatattggcaaataaattagaagtaggaaatttgagtcatgtcttaaaattacaggattagaatgaacttagaatagctagcatccctgtgatagatctgcatctttgcccttccaatcagatgagctgttctatttgttatgaaggagaattatttgtcttctttagagtcaagttcctttacagtaagtataagaggcatttttcatttgtgttgtttcttttgtttaaattttttatggtggtgcttcctggtttttggtgttttgtttgtttgttttttaaattacactttaagctctgggatacatgcgcagaaagtgcaggtttgttacataggtatacacgtgccgtgatggtttgctgcacccatcaacccacacctacattagatatttctcctaggcctcctaggagatatttctgctatccctcccctaggcccccacctgctgacaggccccggtgtgtgatgttcccttccctgtgtccatgtgttctcattgtttaactcccacctataagtgagaacatttagtgtttggttttctgttcttgtgttagtttgctgagaatggtggtttccagcttcatccatgtccctgcaaagggcttcatccttttttatggctgcatagtattccattgtgtatgtgtgccacattttctttacctagtctcattgatgggcatttgggttggttccaagtctttgctattgtgaacggtgttggaataaacatacatgtgcatgtgtctttatagtagaatgatttataatcctttggatatatacccagtaatgggattgctgggtcaaatggtatttctggttctagatgcttgaggaatcgccacactgtcttccacaatggttgaactaatttacattcccaccaacagtgtaaaagtgttcccatttctccacatcctctcaagcatctgttgtttcctgactttataatgattgccattctaaatggtgtgagatggtatctcattgtggttttgatttgcatttctctaatgaccagtgatgatgagcttttttttcatacgtttgttggccacattaaatgtcttctcttgagaagtgtttgttcatattctttgcccattttatgatggggttgttcttctcttgtaaatttgtttaagttctttctagattctggttattagccctttgtcagatggatagattttattggtattgaagtaattctttacagcatgaggtggtggagaaggttttgaccaccagacttcaaaatacttaaatgaaatggaaacgttatttgatgtccttgaaggaaaccagtgtttcctatgtgagagattgtaagtttacaagttggttttacttcttccctcaactttccagtctgtctttttctctctcttctccctctttaccctcttttcccctctagctagttagtaccctatcattcattacttgagcatagttttcttataaaacacagcagtaattttgcataaaaactatacttgtggctcatctttgtattaataagtaatgggttcaaattatggtcatcaaaacacttagcctctttgcttttttcatttatgttttatctcagttatggtcagatgttgacttcaaataacatcttccttcccagaagatgtattgttaataacttcatggaatatcctcttttcagagactggattccagtgtacaggtggaaaaaggaaatgggattatgaagccaagataccaaaatatgtagttctgttccaaagtgactcaacgaatgaactttgacttctctctacaactcagttttcttatataatgatgggttgaatgggatgtcctcctgtgaactttctatgtgtaaaattttatgcttctctttctacataataattttacctttcatttgatagcctatccttagatttcaatcttcttgatctttctaaagcaagtgacaaatgttgataaccctcaattatcactcctctttgttttagtgcatagcctgatatttctctttcttaggacttcccctagtgatttttcccattcatttaattatctttcatctctcctacagagatttaacaaaattcagaattattctaagaaatgttagcttttattgcttcagattctgcattgaccatgagatctgtatttctggattcctcttcccctatgaaatattacttaattttaatctcccataagaaagcccctcttagatttctctcttaaaataacttcggattctcttaattttcagcccttactttcaatatagatagaaagggtatgacgtagtaaagaatggtaaattttaagaaaatgtccccaagccagaaatattttggaattgaatgaacctccaggtaaactgcaggttgggttttaaaatgtaaagtttttaatctctgttgattttagtggcccagcctgtgtaatgtaaggaattgtctcccctcactcaatactaactgtataatattccatataatatcctatatcttctcctcacttgaaaatgaaggcattattgggaaggttctacaaatctgtgcaaagtcatttctaaatacacttttgaaattatactaatcagtatcataagaatgataagtattcatgtttctaagtggataaaagtaatatgtctacatttctagagctttttccatgctctcttaagttatgtttgtgtgagtgtatacaatttcactccttcattggtcacaagaaacttatgaaatgttattattcccatttttttcttttttatttcattttatttattttttaaattatactttaagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacaggccctggtgtgtgatgttccccttcctttgtccacgtgttctcattgttcaattcccacctatgagtgagaacatgcagtgtttggttttttgtccttgtgatagtttgctgagaatgatggtttccagcttcatccatgtccatacaaaggataagaactcatcgttttttatggctgcatagtattccatggtgtatatgtgccacatttccttaatccaatctatcattgttggacatttaggttggttccaagtctttgctattgtgaatagtgccgcaataaacatacgtgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattttaactggtgtaagatggtatctgactgtggttttgatttgcatttctctgatggccagtgatggtgagcattttttcatgtgtcttaagaaaacctaggcaatgccattcaggacataggcatgggcaaggacttcatgtctaaaacaccaaaagcaatggcaacaaaagccaaaattgacaaatgggatctaattaaactgaagagcttctgcacagcaaaagaaaccaccatcagagtgaacaggcaacctacagaatgggagaaaatttttgccacctactcatctgacaaagggctaatatccagcatctacaatgaacttaaacaaatttacaagaaaaaaacaaccccatcaaaaagtgggcgaaggatatgaacagacacttctcaaaataagacatttatgcagccaaaacacacaagacatactattcccattttaaagttgaagacactgagacttagagggattgggtaatttgcccaaggtctcataactgattgggcctgaatttaaacccaggctacctggtgccaaacccatgcttttaaccaacttgtgaagagagagagagagagagagagagagagagagagagagaaagtgagtgcaagcacatttgagattttgaaataagttcaagcatttattgaacatctatgtggttagtacatgctaggcatcatgccaaggcactgggataagagctagggatgaagggatgaatggcatactgttcctgctctcaaggatatcacagtatcatagagcaaatcacatataaatatttcagctcagaaaagacaattatattaaatacaagtgtcagagtggtagaacggaagcacaggaaaggacgagaatcattccaagaggctttcttgaagaggtaaagcctgagcataaaaacacaaataaatcaggataagtacacaaggaaggactttgcacaactgagggaagagtacttttttttcattttctgaattatttatatctttttttaaaattatactttaagttttagggcacatgtgcacaacgtgcaggtttgttacatatgtatacatgtgccatgttggtgtgctgcacccattaactcgtcatttagcattaggtatatctcctaatgctatccctcccctatccccccaccccacaacagtccccagtgtgtgatgttccccttcctttgtccatgtgttctcattgttcaattcccagctgtgagtgagaacatgcagtgtttggtttttttgtccttgcaatagtttgctgagaatgatgctttccagcttcatccatgtccctacaaaggacatgaactcatcattttttatggctgcatagtattccatggtgtatatgtgccacattttcttcatccagtctatcattgttggacatttgggttggttccaagtctttgctattgtgaatagtgccgcaataaacgtacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcaccattctaactggtttgagatggtatctgattgtggttttgatttgcatttctctgatggccagtgatgatgagcattttttcatgtggtttttggctgcataaatgtcttcttttgagaagtgtctgttcatatccttcgcccacttgttgatggggttgtttgtttttttcttgtaaatttgtttgagttcattgtagattctggatattagccctttgtcagatgagtaggttgcaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttatataaggtataaggaagggatccagtttcagctttctacatatggctagccagttttcccagcaccatttattaaatagggaatcctttccccatttcttgtttttgtcaggtttgtcaaagatcagatagttgtagatatgcggcattatgcgagggctctgttctgttccattggtctatatctctgttttggtaccagtaccatgctattttcgtttttgtagccttgtagtatagtttgaagtcaggtagcatgatgcctccagctttgttcttttggcttagggttgacttggcaatgcgggctcttttttggttccatatgaactttaaagtagttttttccaattctgtgaagaaagtcgttggtagcttgatggggatggcattgaatgtataaattaccttgggcagtatggccattttcacgatattgattcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaattcttgtggtttttgcacattgattttgtatcctgagactttgctgaagttgtttacagcttaaggagattttgggctgagacgacggggttttctaggtatacaatcatgtcatctgcaaacagggacaatttgacttcctcttttcctaactgaatgccctttattcccttctcctgcctgattgccctggccattgattaaatgttgaaaatggtgcttagtttcctgggatatgagaaagaaatctgtgtggaatctaaaactatatgaaatacttctctaattccagtggttacctcatctcaggacagatctcaaatcaaataagctccgtacaactgagactatgatttctaatagaacttttaaattttatgaagaagacatctataaatgtaaaatatcagctttataaactagaaattactcaatttactttaacttgtactattgggtaactgtatctgcagtactatcccaggcacagtgggtgtttcaaaaatagaagtatcatttacactggaaggaaatcattcacacctgaaatacacatgaaccaagcaacaaagtgaaaaaacataaagtaaaatgcccgaaataataaaatctagttctatttatgtatgttatcaaaggtagtggggagacaaattggtcaaggatctaagtccctaggatgagggcacatacagaattggtagatgatttgttctaaccatttagtaaaattatttattatatcattaacagctgagaatactttgttagcataatatcttttctccaaatactgacaagatgttgatgtttatattctaattatggaaaatattgcaggactctttcacaattttcaaacagttgtcaattatgatgtgctatgaatgtgttaaaaatcacttgtatgcttctttagtaataggtattctgtacctttccaatatttttccactatcaaagtttatttctcccctgtgcagatcctttccttcaagaccctgtttaagaccctctaactctatatgttgtccccaattatttgaacagtttgtttttctgaattcctaaatagagctctctgacttcactgtcaacttgctgcccactccactctccattttgtcattcatttcagctccttctctctgaccatctcattcatctctatcttaattcccctccacaattagatttagcacgcagttcttgtcatgggtgggaaaggctagaacaggatgtactctgggtgggagcccaaggggatagggctaaaaggtctacaatgggttagagtgaggctgccttcaccatccctaaaatctgttcacatgcatggtgctggggctggcaagatggataaatggaggtaactcttatgaacttttcttcagggagcttagcattaggaaggaaagagatcaaatgtagcagtccttttttctttgattctaccaacatttattagcacttttcttgtaccagactctgtaattgagggagtagtaagagtaagatgggtgtgtgtgtgtgtgtgtgtgtgtgtgtgtgggcatgcatgtttcagaacaaaggaatctgatcatttttccaggtgaagagtggatataacacctctagatggagagactgaaagatgatacgaataattttaattgtgcagagttccagagaacagaggcgataattcaagaacacaagtttattcttggagacagagaaggttgatttttttccttgagtatgacagaaaagaggaaatggctgaaatacaaaggaatattgcaatggggatattgaaagctgaaggagcttgagtcagaggctgcttgatcttctcagtgcaaatgaggtattaacaaatggagagagtgaggatatagggtgagcaatgttgtaagaaattaattggtatgaataaaatcctgctgagcagcacttatccagctaagtttggataatgcaagtcatgtggaaagtaactttaaaaaaacatttatcagggatcaaggcctcccttgcaggtatctggttcacattagctattcttttgtctttcaagattgtcatcccctgcctttgtgcatctccagtgtccttgccaaggtgtctgaaatgaccataagattctttgagaatatattgccacattctttaagacttagagaaaatatctggttaagtctagattcttaagcccatttaatgattcacctgtcttgggctgctatttactgtttagtttgactctttttagcatgcatattattattattattattggagaaaattgaagctctgctctttcattcttatctattaatattgtgtcttctcaaggaaataagaaaatcttactcctttcttttctttcttcttcttcttcttttttttttttttttttttttttgtgtgtgtggtcttgaactcctggcctcaaatgatcttcctgcctcagcctcccaaagtcctgggattactggcatgagtcaccacacctggctcattctttttcttaatatggctctaaatggctttttattttttttgctttggcaatttatttctaggaaattaaataattctttcattataatcaagggaatgaaagacttcaggaggtccatagtggagttcaaaaccatatggagttcactattctacaagattatacaggcaataatataagtattctaaggtgttttaggtagatttatagatgttagatttcaaaatgggttaataagtgtttatgaatttccaaggtgtatcactaacttctcaagatgaaatcatatatagaaactatcaaaattttccttgttctactgtcaagaaatgaataatatacactgatataactgtaactcacatctaaagggatagtgcttgaataagctaatttacaatgagttcaaggtattattttaaaattcttatggtccttagacaataattatgccaacaaatgtgaaaaatattaaatctccttctgttaattttttccagttttattacccaaaagtcacacaggtaatgcaagtcatgaaataaatcaaatgagcaccttcctggagagcctactttatttaccttgggaaaatggatgacatttgccctaggacttatttttctccttctaaccaatacagtttaccaaaatgttctctggtaattttaagtctggtatggctttgtgaagactctctgccttttctcttagaaaaataatgttatagctgcagggaaggaaggctaaggtggtgtctttgaacattctaagaaatgttttcttggctctgttgattattaacaatataagccaaaaattcttacaaagtatgtaggcccttccaagtttcagaaactgaaagctacagtggatcaaaatattgctgaaatctaaattccttatttgtgccttattgcctcatttacttgattcatttaatggcacaagaaaaacattctgaagaatgtaatatttcatgttctttgtttcctgaacacaaaatcatggtaccagaaatgattctcaagttggcgaaaccatcaaatgaatgtaagcatgggttcttttatttactgttgctgtctgccttaggaattcactactgttaatagagattcaattcagctaaagtaactcatcttctaaagagatgccctaataaggattagtattttcaaacatactccagctggtctatgtttgttcttttccttgctctgaaatataaattttacgtttggctaagatatagatatacttttaggttggcttggcagaaaaaattattgatttcagtggaattaatttttataattaatttgtatttcagggtttggaggagggaaggaaactaaatttattaagtgccttcaaagcacaacacttagcactaaaataattacacatgttgatatttttaactatactaagatgattgttaagcatgagatcagtttcaaaataggtgtcacaaaacatttcaggcagctaaagatgtaacaagaaatgtgtctgattatttttaagatgaccaattttaatacatccttatttaattcagagtgttttttcatagagatttttgttgattgattttcacattttaaatacagaaaggcaaaaagaagatatataaaactcctgtggtatcaccactaattgcaaagtcagtgtgaaaatgatagtttattattggataatttttctatgcatttgtattattaatattgataaaaccattagcaataatagttgtgatttagtgagcaattattacatgccaaccagtgttttaattttttacatgtgttaattccttcaattcacaaaaaacagccatgaaatactcttattatttgcattttacaggttccatgacttgtctgaggtatcacaactcttaaaacttgaagtagagcttatgttctcaaccactttactataattccgttccaactgtatgttcacacagagagatacctttttgatagagattttttaaacaagcatagatttataatatttaattttgttttataatcttgccttttttcactttaaaaaatgtgtatttaagaccacttagtacaccatcacgggatgcttgtactagggtggaactggaaggagcttagaattatgtcttagaataaacagtcttttgtatctgagcatttgggcaatagggagaagaggaatattagagataaggttacgtgatgttaccatttactaagagggtggttgttgggaaaggaccacatttgccaattctggcagtgttgagcttgggaccatcataggaaatgtgttttaggcaatttgaggatcaacaacatagaactggcaattgaaatcaatgaagttacttaggaaagaagtataaaatacaagtaaagaggatctagaagaggctcctgcagaaaacaaaaagttaaaggtcctttttgaccctccattttcgcaactataatatggaaccataaatggtacctacctcagaagactgttgtggagattaaataaatgttttaaacaatttagcaaagtacctgacaagggatcagtaataataattagcagttttaataattctggggaaccaaatacaagggtaagtagataaagaaaaggtatcagtgacatcgttcatgaatagcagtcagagttagattaatccagctaatatttttatctgttcattacatgtagttaatagaatacaagaatagaatcttaagatctaacgcttgagttcttctaagtcagtatttctcaaagttcctcaagtcaagtccacctttgaggatctggtgaaatctgttagtcctagcctcagtaaattgcacttgttcacatacgccactgtgtaaacaaacatgaaagatgtttatgaactcccagaagtatgttcatcccaaattaggcataatctgccagacagaaatccaagttttctttttgccagttccctcccttctgctctgttactcagccttcactctattaggttagaggtcaccaaagtctggcttagagtctggtttttagggcccatgagagaataaatatttttatgttttttaaatggtttaaaaaaataaaaatgagaataatattttgtgatatgtgaaaattctgagaaatcaaatttttatgtcaataaacatagttttattgaaatacagccatcttcattcatttacatgttgtctatggctacttgtgtgctacaaagtcagagaccgcttaatccacaaagttataaatatttactgtctagtcctttaaggagaacattccttaaggtctgctgtaggccaacaacttagtgcctgcaatgcagaagaaggtattagtgaacaataatcatttctatcattgttctctgcttctcagagtcaggagttaatttaccctacttccatgactttatttttttccatatacctgtcatgtttacatttataccatacgtctattgatatctcttgttagacacagtgattctcagaacgaagacttatgcccccatagataagactctttatatcttcaactttgccctaaaattgatacctggcttagctgtttacataaagtagtaaaagcacgtcactcaaccctaattttcccagttgggggctcaaggaccaagtctgtgatttcagtgattgtatcccagtatgtagcacaaagcctgtaccacatacagaaaagttttctggaatgaaagaaacttttggaagagttttctgtattccctttctttctgaggccactcagtccccctcactgcagtctgaattctgtctattcgatttccccaaactgttcttagtagatcacagaaagtttatagatatgaacttattttaataatttaacttatggtgtaggccacagatattgtgcacatgtgaaaccaatgtgatgtatgtaacagaaaaatagtaaaaaatgtccacttttatttgacatgagcaaatgattcttatttatgttccatctcttaaatgtgtaacttcatttctttctatgcatcagacctatcttcctggggttcacagaacacaacttaaagcttctttctttgtacctctctacaggtgctctacccagaaaattcttaatctgtcagtttgtctgtcaaaatctttctcttcattcaagccctacccaaatatcaacttcctaccaggaccgaaagtaatttttttaagtcctataagacttttagggagttctcatgtggtgctgtttacatctgtagaattcatgtcacaaaatgaactccgaagtaaatcaagggtaatgaccacgcaacaggttttttctggtctttcacaacagtgcatttaatgcagaagaatcttgataaacgtctgttagataggtgaatgtgatgtttgcttagtcaaaacataatgctcaaatggtaattaattgatcaaatcatggtataatatttcatttaacattgtgacaagcaagctcttcttagtgggtaaatttttcttctatgtttggtttgttattcttaggaaataaaaacatgttttttaagttgtaacaagtacagttgactcttaaacaatgcagtttgagcttcgcaggcccgcttatacacaaatttttttgtcaaacaaatgcaaatccaaaataaagtattcatgggaaatattatagaaacctgcatatgcggagggatagctttgattttggtatacatggtggtcatcctggagtcaatccccaacgtttactgtcggacgactgtagaagtgatttgtctattactttgcaacctcccttttcctttctttctcttctttgcttatatatcacttcaaaagcacctgaacattgctctcgatagatttaaccagttaattctaccttattgcttttaaatattaactcttttataagcaagaataaataattatcattttaagattttgattttttaatagattcagagggtacatttgcaggtttgttacatggataaattgcctaatggtgaggtttgggcttctagtgtacccatcacccaaatagtaaacactgtacccgataggtactttttttcagcactcactccctttactgccctctcccctttgtggaacctccagaattggtgctgatttaactactttaccattacagtaaatgtcaaataaagtaatattttattagaaaattattgaaagataaaaatgtacatttatgagaaataataatgattgataaagatattaatttacaacatccttttatatcatttataaaaggtttattaaccttatgaaaatacttaagtatttaagcaaaaatgcccagattttttgggaatctttcttttgttgggcatagggccagaggaggcttgtgaacaaaggatctactgtaactgcttttcaagtaagctagtgaattcttacttgggaaacaaacctctgatattgaagcagtacattgtgatactcattacaaaatcatttatactgtaaagattattttcttacaaccgaaaaatgtggtacacccaatgattagtcatagttttagtgaagcttaacagactttatgttctaggtctacaaggaggtaaaaaacattctgtgttccagattcaaagtcagtgccataggatgtttttgtaaatggaaataccatacttatttttctcttaatttgaaactatgaagattctgacaagtaatcaaatagtaaataattatactacatttaggaaagtttcaactgaaagagattaaaacttatttgtaataactaaagttacatttataaataggcatatagttgcattgaaacactgctatatctagtgatgtaatgatgtaaaagtatattagttgggaaatataaaaattaacatatatattaatatttttatcactctgaatttgaaattgtaagaatgaatatttgacctgtctacctgcattatggaaactgaaaatggatgtaaatactctaatgaggaaggattctttaaaggaaaggatattgattagaaacttaccggaaagggttgattagaaacccacaggaaaaataaagccaaaacaaagttaatcatctttaggtaacttaacctgctgctgaaaatactagttcctgtttatagtttctaccttgggaagtacactcaacctattattcaattgtttttaaaaaggaaaaataaaacagaagaatcattttaagaaaatattacataaaatttatagagatttataactagtgtaggattctgtgatcttcggctaatcaaagaagaaaacatactaattgtcataggttttggagacttattgagaagattgttgtgaatagcaaggaaaatagtaggaaaaatttacctttgaagtaaaaatttactctcacttcagttctttggctttctataatgcttaataattctgtcttctcatggatcattctttattctctttcaaatcacagtttgaaaagtatatttttgtgggaaaaatatttaataaatcacagaattttaaaaatctaatttttgtacacagaaaaaaggaaggaaaaaagactaaattcagatattttgatgttgcagtaaatgtgttgaccatgataataaagcatattttttccagagctgcttgaatttgctctcagtgcaattgcaagtattgactttaatttctgagaggtttgtagcttcaatgatgagtcccttggtgcctaaatcaaagtggctctgtaataagtgagttctgttgtctcctttctgctgatggcactggaggcaacagcatgtcttctagaggcctctgtctgtgcttttcttttcatattcagcatgtcctagattcactggcccagatagcacaatacagcaggcagctttttactctgtaaatggcttagtgacattatttaaagtaatgccagttgtctattcttttgttctgcttttatattttcatagttgttacccattgcataccctttggctgaagcgtttgaaaatatcctatgccctttagaatttggcactgagcactctttatggtacataagaagtaaaagcatttatcttgccctggagttatttacaagctcatttactaagtagtatatcaacaggcaaagagagattctttctttatagaactttagcttttacaaagccctttcatgctcaccagctcagagtgcaaaattattgaaagcttttaaaataaaaggctgatcagattgggaaagattaggaatgcattaactaaggaaagcgtctggaagaaagtgacttttaaagtagaatataaatatctgctttttattcctcaaagtttccataaattttaatatattcttaataattcactttcttctcatctaaaaaataattgtgagaattaaatacaattttaaaggagcataaacatttcatatttatatacatggtatatgaaatgtaattttttagagaatttgtttttagtaacatatcatattgcatttatcttatttattcttagttgtatcctactcacctccccaagatgtaaaaaaaaaaaatgccattagctctgttttaagctttacctttgttcccaccattaaatttttaggtcagcactgcctgaaaccagcaatcatttccactgaacttaaatggctactgtttttattttcactcatcactgacagtcatgtttaggtgatgtcaaacatttatttcattcattccacagatattgatcaagtgcctaataattactaataagaatggctaagagttgttcagcccatattatgtaaactggtcctttgtaaggcttataatgtgtattgtcacatttaaccctgtcagcaaccctatgacattgatacaagagactgtgacacaggaccctgacaattggctggattcttcaaggaaaacacagaagctgagagaagttaagtcacttaaccattgtcacacagctagtaagtggcaaagaaataattagaattttagtctgtgcctatagcctcagtccttaaccactacaccacatgccttcagtatgtttaaaatgctattatatactagttaaatgtataattgcctgtaaatatccagaatcttcagtgtcgatggtgagcattttgtcatttataaccagaaaaatatttaatttggacttcatttttttacaaggagaaaattataacatgtatatctatataattttataccctaagactaagctgaagcacaccactatttttcatcttcagtgatatgcctcactttattagtcccatttacttatgaggaaattgaaacacagagaggtatgtaacatgcctgagttcacatagtaagggcagagctggaattggaatccagcagttgggctacagagtctgtgctctaaatggggcatgtcattgaagttggccgaggaggtggcactgtcagtgaaccttctgactctgcaaacgttttactgtacaaccatgccagcttcttggtagactatcttaaactgttcagaatgtttctgtatacttacaagaaaactggattcatttgttctgcttatttagctaattcactcatccacagggataagcctaattgtagatattaatgaagactgggtttatcaggtacatacaatgagtcatactggcacaattctagcactctaaaacaggtaccattattatcatcattttatttagataaggaaactaaaactcagaaagattaatttgcccaggatcacatagctaataactgataggcacagtatttgtgtggtagaatttattcttagccatcatactattatatcatcctcaagtaatttgatatattagctaacgtaattctagtttttataaaaatttaccctaaaagtataaaggctcacatttagtaaaattctatttattgttaatttaataatttgaggcagatgctcatggcaggcagtcaactctcctctgtgcagtggttcaggtgcccaggttctttacatgttatgcatttttgtcatttgaatccatatcgcaaaagtataaaagggaaatggagaacatatatctgactactaaaagccttgttctagaagcatcacacatcattcctattaatgctctattaatgacagttaatcacatggccaagcctagatgctggggatgggacccgagaaataaaatccctgacttagcaaccacttactatgaattctgtaactggaaaggggagaaaccactaactgactgtcacacacacaacttgaaaaggctttcattataaataattaagtcatttgagagtttacattcttttttcttttttttttttttttttttttttgagatggagtgtcaatcttgttgcccaggctggagtgcaatggcgagatctcggctcactgcaacttccgtctcccgggttcaagtgattctcctgcctcctgagtagctgggattacaggcacccactaccacgctcagctagtttttttatttttagtagagacggggtttcaccatgttggtcaggctggtctcgaactcctgacctcgggtgatccaccagcctcagcctcccaaagtgctgggattacaggcatgagccaccacgtccggctgagtttaaattctgttctaaagtaaagtctgaaaatactggtgctttcttatgttactgtaaaatttgtgcactgacaatgtaatttgagagcccctttatccgagtttcaaagcctgtcagaatccaaaactgaccccacaatttctattcattcgtcagttttaaaatttcctggcctcttttgactcttagagtccaggttcccctgttcaatacaacatagactgcataaagcttagccatttccttgctttataaaacaaaacagaacaaaaaacgtttgttcatgtccaggctttatgagtttaatagactttgatgaagaaactgttagtcatggggggattggagggaaggtgattgggaagtggtcacgtcacaaagcacacattattttgctctttttctctctcttctctctcacctctgatactcagttactacttctggcttgtttatgtctacaaataacaggcatgtacatttatatatcatttactcttccaggttgttttatcaacactatttaatctttaaaacaagccaatggaataggttctgctaacatttttcctgtatacagtaaggaaattaaggtatagagattaagtaactgggggttggcagagctagtattaaaacccaggctttggccgggcacggtggctcacacctgtaatcccagcaatttgggaggccgaggaaggtgaatcacctgaggtcaggagttagagaccatcctggccaacatggtaaaaccccgtctctactgcaaatacaaaaattagccgggcgtggtggcacgtgcctgcaatcccagctactagggagactgaggcaggaggatcacttgaacctgggaggcagaggttgcagtgtgctgacatcatgccactccactccagcctgggcaacagagtgagactccgtctcaataaataaataaacaaacaaacaaataaataaaacccaggctttgcgcctacatattctgtcttcttagctactccatggggacagttttctcactatggaaaattctagctcttaagctagaactctattttattaaatttacttctaacactaagcccaattttttttaatttttgtatgtacataaaaggtatatatatttatgggatatatgagataccaatttttaacctactcatgtatttgctgtagttaaaataattgtaatgattacagagcacatctttaacaaaaagaagtaaaatgtgtaatatctaaaatttggaattgcatacattttgtttcttagatgctctgtatgctatgcccagtgttactttttaagtgagagagttgctgttgattaactataggagacttgatttatttctaatttttcctagtactgttttgctatgtagaatataaagattctgatgggtatattcagttttattcaccttgtatttgtaaacccatagaacatctacccacatctaagtgtagttggcaaacctctttagtgctttagaccttttggggttctgttaacataagtctaggccaagaagtaagtctaaacatcacctgaggtctgccctgttgctactttatacataaaacccaactgccaatgttagattttacttttttaattcttttttttgtgctcagtggcatgtttaaatattaaacgcgaggaatgttcatagacctatatagccaaattggtgtggggagaactgttatgtgttgtaatagtgcaccgaaaatgctatcaaccaataaggtagacaatatcttagaaaggagagtgaatacatgcattttgtatacttaactaaagttttattttctgtttttaaacaacagttgtgtcacttaataatttttgacaaaatgaaaatacgggttaaagggacatacaactatcttctagtcaatccatagttgattttatattgtctctaaacttttatattgtctctaaacttcatctttcactacttacataaaaatccctgtaagtattacaatttatcatacccttaaaaaatagtttatttagaggatttacttgtattacaactaaatcttaacttctcaaaacaagaaaatatatgtatttacatactgttgttagagcaaaaataacctggaaaataatagcattacaatatatttggggttgtaaagatttttaaattattaaaattattgttccttgattgttccttttttccttatatccaaaaggcgaattgtgttattattcctcttttgtatgcataaagatgggtgaaaacacctttagaacaagcagctgattttttacactgaaaaattgtgcagcagttatgttatcaggttagagactgccagttcgagatgttggatatttccacctcctattctgcatgatattttaataaacatacatgtctcccatctagtttcccagtggtttattgcttggttaaatgaatcgttgagctccctatgaagtcttctgacatgtctaattcgatacctgtcatttataaccatctttccttcctcccccaacaataacaaaaatatcataatgagcataataatcagatttgctgataaaatacacttttgacgtttctgtgattacacataacgactcccactgttctcagaagattctgttgttgcgttctagatacttatttggcttagacatctcaaaaagtacaaagaatattgtatatcatcattgacgtaattcttccacataatctggaaggtgattccagtctactatattaagctttcctgtgataccccaaacacaggttaacattatatatccagtcagttgacacaacaatctctaaattatgtccactttatgctgacaactgaccttaacggtatctttagaacataattatttcctatctttggaacgtatgaactaaaaactactttaactccaaatcactaagcttcaagaagacttgaaattctatggcttgctttttggaatttggaaatgtactgccaaggtaagtttaaaaaaaaaaaaaatgatgttctgtgtttcttaaactcttccactgaaaggcctctaatggcaaagggaagtagtgcatatctccagaaagacagggcatagcctcaaacagcagctaaaagaggaatattcttttaagtcttcaattttatctaaaaaataatgagatgtgtccaggcacggtggcttacacctgtaatacctgcactttgggagtccgaggcaggtggatcacctgaggtcaggagttcaagaccagtctggctaacatgatgaaaccccatctctactaaaaatacaaaaaattagctgggtgtggtggcaggtacctgtaatcccagctactcaggaggctgaggcaggagaatcgcttgaaccccagaggcagaggttgcagtgagccaagattacgccactatactccagcctgggtgacaagagcaaaactccgtctcaaaaaataataataataaaaaataaaataaaataaaatgagactttagccttctgcttatcatatactaatgtttactataaaaaattttccaaaatattttagtataaaagagcattcttctctaaattctacctttatctttgagcttcaaatatcctctgaaacactgcttaattcctcctatgaatataattcaaaattttaaagccagacatacatatctgtgggtgaacagcaaagattttttattgcagctataggatctgtgactacaggataaagcacagctaaataccacagatatcaaacttctttttacctggcaccaaaatttgtctaagctattcagtaatttgtattgagttcagtttagcctgtgggccagagaataaagattattttccatggagcctctagagaaaatatttcccattaaccttgcaggtttggggtggctttgatgtttaatcctcaactaggttcagttggagggtgagtgggaccagcactttgggctgaaatgttctcatagcagcccaagggcatcctgcaatccaccatctctttactcagatgaaggatcagttctgctgctgagtggtgcacatacatgaactgcaccagcctctcatcctgggataggaatattttatgggtagaatattctaaggtgtaacaaatagacttaggggattgttctgtatttatgtttacttgtattagaatatgtaccgtactgagagtcaacagacctggatttcaggtgcctctctgccagaggctagctatatgactttggcaattttcttttcaccttttcagccagttttctttgcagcaggttcatggcattggattctacagggtctctaatacttccaagctcttcagtctatggttctgtaacttgtttttcacaacagtgactttaatcaaatccttctttacttgatttttacatacatatgatattcaacatttagcacttctgtaagcttggaaccaaacttgctcataaccgtatctcagtcataattccactctgaaattttctgaaatttgcattattggtaattgacaatgctaaaagtatcacctaactttttaattttctctaaagataaacatatattaggtctggttcttcatagagattgagacatcaaaaaatagcagtttctgagtgatgctcaacgtctttacatttcacttttatgcaactataactttcacacattatacattgatttcaaacacagctggtgcccgttaggaaacaattcattttaaacagtatcaccaccttgtctgtacagcacagtagagtcccaaaacaattactggatttatatatgaaattattttttcccttttgctgctcatagaagtaagtaaagaacagaaagaaaaaaaaaaggtgctgatagattagaagcataggtactgtaaaatataatccaacaaaatataattaaagactatggccaggagtcaaggtagataatgaaagtgatagagaaatctttacaattctgtttttaagatcattatttctgaaacatttcaatgagtatttttctctttttttaagtgagtacttttctcttttttttagtgagtatttttctaatacaaagtaaagttctcatttgtatgagaactggaacaaatattttgaagtggctgctgagattccagaattactggttagcaaagactgctttgataaattcaacagaatttgtgtttgcaaaatattacactttccagagattacgtggggacagagaaagaagacatttgtttaaaaattgttctctgagatatgaacaaagaaggggaggcagttaagtttgtcaaggaaaagcatgggttttgaaatacttatattctattgaaaggaagattttaagataaaaagatgagagaattaatcaatagagccttgtctattgattgaaggcaggagggatcacatccagcaagaggaaagacaccttttgcattgttacaggagagaaagagggaaagaatagatgtgggaagtttagtggtacagtgatctgacacatcaggctccagctaactacctaggtgctacctaagtccataggtaggtcttcagataatacactgactgccctcagagggcataacagagccttagccataaatatcagatcagatgagacatcttaaacctcaaagaggccacctaagggtcattctttaatctcctatttattgtgttctctaggcttcatctttacttttaacttacatcattagaaagcaatgttctgtgttgagcaagtaaatgcaaacctaccaccaaaggccaacagagctgagaggccaaagaaagaggctaacaaatacagtttatcagaaagaattattaactagggacttacaaacagaagtgatgtctcaggtggctgcaagatggtggatccttgcaccaatctccagaaagaattctttatatagcaagcttttaatgtgctggtcacatcttcagactttcttaccaaatgaccactggggagattagataaacatcttcatgattatctatgctgcaggcattgtttaaagatgttactgagaacacctttacatgtgggagtcaaacattggttattagggtggcttcacttcaagatagaatcgctcttgccatgcaacaggctgtttccctaaaagcaatttgctttttttttttctttaatccagagactgacctttccaaatatcacaaagccagttaggcacgtcttcaatgacctgccttaatattgaccatttcacactataatataaatagcaaagctcattaaattaacatatagcacccatagagtcatcaaaacgtccctagtacaagaaaattaattgactactatattttgatgtgcatttcttttaactaaatgtgtaaaatagcaagggttcctttccagttgaaaatctcccttcaagggtcatgtgagagaaataacacaacacataaatcacaaagtgcatcccaagtttgagtttcaaaatacgttattatgttttaaagtgatttcttcccatgagcagatatctaaagaattattgtccaaaatcatgacaacaacccaccatataaaatacttgttttacccaactctctgacagcatcgtgtactcttttaactacagagaccttaacatggagacttaaaatgcaatagttttcatagatttctaacacaagttgtataaaatttatcagataagtttatttgccttaattggagtgattgggctaaaacagaaaaatttacaagtcagagttttgttcaccctccaaattcaaattgtatagccatctcaaactgccaagcagagactagtttctgcttactcactgagtgactcctgcatttcatcccttcctcaccataccttgaaaagcaagaagtagcatctagcttttgtagtattttgatttgtatcaaataatagactataaacaccctctgaataatcatagttaatgctaattacaagtttctattttcataaaattaatctatttatcacataccttctgaccagagcactgtgtctttctgtacaatagtctttctgttagcatctgctttcaaacatatatggaaatgttattacttggaatctgtatttgtgagaaaatgccaaagggtctacagtacactgttattcaatggataaatctatcatttccattcctcccaggaaactgagcaatttccactttacttaaaaagaaacttaaataacttaccaaaagtcgtatcagtgctagcatttggatttaaatctagatttgcaaagagtcttaataaaagggaaatacatatctacatgtatatgtgtgtatatgcatactatatttatatatttaatatattctatactatatatgtatactatattttttttactatatatataaaactgtggctacagtccagctatctaaaaaagataggaaaaaagacggcgttttattttttgtgcgtagttctttaatacttaataaatatttgactaaatgcattctaattacaaacaactctattttccataggtgagaacataataatgggtatagtggatatgtttcctagccttagaaatcctctgtttaagtggtaggtttttttttttttaaaagttatttggaaaccttcatattattctcaggatttggatcatgagatcatgagatcttcttataaataaaagagaaatttagggaggttccttttgtaaagtgataactttttgagtaatcttctgtaggaacgggtctttctttcttttttttttttttttttttttttttttttgagacagattctcactctgttgcccaggctggagtacagtggcacgactcagctcactgcaaccaccgtctccggttcaagcaatactcctgcctcagcctcccaagtagctgggattacaggcacatgccgccacgccctgcttttttttgtatttttagtagagacggggtttcaccatgttggccaggctggtctcgaactcctgacttcaagtgatccacccgcctcggcctcccaaagtgctgggattacaggtgtgagccactgcaccggctgctattactttcttattgctgcttaataaattaacaaaaatcacaaattttatatcttattccaggggtcagaagtctaaaatgggtcaaagtattttcaagtatttcaagtattttcaaagtatttcaacaacacagtcaaggctgtgttatgagcttggcacaaaagtaagtgtgttttttgcaattatcacccttaattaattaagagtaattataaataccgcgattgcttttgcaccaaattattacttctggaggctctaagagagaacttattttcttgccttcctagcctctagtggctgcccacattccttggcttcttttatcatcaaagccagcaatgctaatgaagtctttctcacatcacttctgcctccctcttcctcttataaagactcttgtgattatactgccttcactcagataatccaggataactttaactgtttggcaagcttaattccatctgccagcacaattccccattgccatgtaacatagcataacatgttcataggttgtaaacattaggacatgaacatctttggaggaccattactgtattgtattgtattgtattgtattgtattgtattgtattgtattgtattgtaattttttcgcccaaattaatggttttatttccatctttaatgctagcagaggattccaaagcacactgatatccatggatatagtttaaatgtaacaaagagttgtactatatacactgagaaagggaaagggatttttttttcataccaatctttccctaggtcacagtttctgaatagtagaaactaaacatattgttttcttaccaatttaatttaggatgaagtagtacaagtctgctaatcaaccacttaagttttctttaaggataaagcataaagaaattttaaaatgagtattaccatatttattactggactggctccatggttcccttgctccaagtcgggacatcatggtatggaggagattattttacttaccagagacagatttaggttttacagggtcggaattttgtggaaagccctcttgaagaaaatgaagaaataaaattatgaatacaaaattagacactaaaatgtatacttatgtgtaatgaggggggaagacaacaaaatacaaatttaaaaaaaagcaaactgcatctcacttaatcccaactaattttatccccagttgtttaatatacccatatagtagataaaacaactgcatgataaaatgcttcattcagcacttctatatcttttgactaaattaaaaataaataggtagaactcttgtcaaaattttgtcttcaaagtttgatttctaaccatctcttcatctttattcatttatttatgtcattttccctatagttcagttgttcaattccatgtgttctgggagttgtagcacagagaatatagaatttgggaccagaagaccttggatcaagtccctcctcatttgttcattcaaaatatatttattaaaaatctggtacatgccaggcactatgctgggcttagagaatacagtaataagcaggacagacatggtccttaccctcatggatcttataatgtaacaagaaaacagaaacaggatggtcatctcaaatgcattaaatgttatgaagaggtatagggccctgtgagtgtcctacacggggacttaacctagactggtggcaatgaagtctgctacttcaggacctgagggattagaaagggtgtgcaaggcagaagggagtagtgcaagggaaagaagaggacctcatacaaaaggaatattatagataatgacctatgatggaaaaggtgaaagtaattttaaggaagtaaaaaaaggtcaaaaaagtagagtatagggagaaagggaaaaagtggcgcaaaaacattcttaagagcaagttagggccagctccagtaaggctttgtgaccatgtttgcaattttggtttcatctaaagtgcagtagaatgccattgaagggttttgagcaaagatagtgcataatttgattcgcagatttaaagattttcctgtttggagaatggggctggggcaagaggaaatggcaagagtggatttaagaaaatgagttaggatgaagagaaatatttggagttgaaatatataaagacaagttaattagcttctaaaaagaattctgatatgcatgccttttcattgacaatgactcttttttaaaaaatattatttattaagcactactggaaacatacaaaaaagattgaaagcatacctcattgactgcttttgtgctgagattcatttggcttgtttctttaaccaggggtttgcattttatttcaaattgtataatgaaaacagtttccctaaatacaggcatttcaggcatcaaccaactggttaaagggataattcgggtattaaaaagctccttctcaaatcacaccaagatttctttaactgattttaaagattatttgatttagtacttggtggtagtgtgggggaggaaaggcaacctcatcccacacagcttcccgttcctgtgggcttaaacactccaagactgctgatcccagaggcaccatgccttcctcaccagattccatggaacatgaggtgtcttgagatgagtcacctggcaccaactcctccactctgggcctttccttttgccttttcaagcctggcaataggccaagccctctcttttacttctattaaaataactctattctggctttcctgtttttctgccctaatattgccagtgacatcacttgttttctctgtggtttttgcatatctttatccagctttttacactgttttgtaaaagcttactgccccttctgacacattataacgaggaaatgtatcactgggatacatttctctgttgatcaagatctaattacacctttaaaaatagtcaagatggatagccatataaaaattattccatagagcatgagtatctgaaggaggctgtactctatgtgcagtccccgcatgctacctgtgaaatgtgaatcgtttatagtctgtggcaaataaaagttatgtcattctaatctttataaaatactaatcaattgactaattcatgaaaaattctcttatctttctcaaatattggctaaaccacatagtcctccagccttacaaagtagagtaagcttctctttggcaactgtgttggtcaggctcccctaaaaacagaccctgaaacaaagatttgagtgcaagtagtttatttgagagttgatccccgggaagcacgagtattgattgtggggaaatgagacagggaaaggaagtcaaaatacggtgtttaattatcagatttctgctgtaggcaattggggttctatgggagactatgagaagtgtttcctctgagcgtgaggaaattgtaggatttatccaacatctctcatttgtccttggctatgggactgcttgcagagtcactgacttcttcaggcctgctttccttatgctcacagctgactacacaattggaaggaaccctcagcagagggttggaggtgcttccagtaagacagcatccttgcatacaggaacagtgaatgtctacggggcatagccaggataccaatagcatctgctcccgtagttttctacccagagtctccacctaattgtgtggtttggtctttgcacagaggtgcccagccagtgaggggctctaaggcacaaaagtgctctttgcccaaccacaagttctatgaggttatttcatttctgatttgttcaaatttgcagtatgtgcttgaggaagccattcttttacgttctttctctgtgccttctcttccctgctggggtcctctggcaggattttaacactgtttatattccacctttattcagggcacccaaccatggcattccacatggatatggcagccttctataaacccagataaatactccaagttctgagaggcagatacattgtttaccaaggtaccagtaggctaaacttttgaattacatagacttcatcccttgccatttcaattttaataccagtcctgtcaaaattccaaaatatcacttgcagttttgaggcaggtttagtttaacttgtattgctctaccacttatatgtctattgactatataatttagcatccaaactggaatatctttgtaagtaaaagagggccaccattagtaatatgctagaacaggcataaaccaggattatcctggttaaccatgaaaaatgatcactcttgctgacttttactccttcatgctgttgacacagccctggagggaaaaagaggaaaaacagaacactctagactctaatgtttttaattccttagtgccattatggaggtgaggaggagccacacagaaatatgctcttacggtaaaatcctgttgtttccatattccttccatgaacatgatgttataaaaagagcttaaagagcttacacacgtttgaagaagacgggccttagaatttggttgtgttttggagggttttgttttcacttgtggtggtagctgtgacacttactacttcttaactctctgaacctctcatgcatgtaaaacatagcaataccaataccagagaattatgataagggttaatggaaatgtgtgtaaagctctaagcataaggcatggtatgtaaaaagtgctcaacagaagttagaaccttttttttctaagtttttctatttccagtgttctagtgtttttctcgtggcagtagggtgggacgtgaaacgacacagggaaagcagctgaaacctatcagtgtttaataagtatatattgaaagtgataattttgacagcttaagtgtattaaatgtgtattacaagtgccaagtgagtacaacacaagagatcgatatagaaccttccccttaattgtgtaaaaaccttttaaacaaacttatcctggaaatcacgtattagccctgagctttacttctctgagatttcttacctaattggagaagctatattatattcaataaagtaggcaacatattttcatttcatttgatttaaatgtctttgttacatagtttgtttaaaatgttgtgactgtggcagttttcaaattgtggccctttagcagttttcaaatttatgacacatggcaaatttgcttagtgatgttacacttcatggtcttacaataagctataggaaagaagcactcttgacagaagcaatttaattatattctgtatatgcatgagaaggagagagtgtcggagggtgagggaggaggagagagaatgggagagagacagagaagacagttcacaggcagctcagacagatattccagccagccaccgcacaagttatttaaaccaggtcaaagcttctttggcattcagttttccccagagaacaatttaatgctgatacttaattttttcaagatagacaaggtaagtctatgttccttatatgtatttactaagttataaggggagtttgtttatttataacttttcataaaacctagccaaaagccaaatttctatatttgtctgaagctttcagtgttgtttaacagttttcaaaggtagtgttatacttcagattgcaaataattaaatgaaaatgaaaaaacataaaaattatgcagtggacgaaataattaaaaaatgatgttgcaacagtagatttatttatagcattgtaatatccaaatatgattaactttaaagctagacttacaggattttaaagctggatttgaagttgagcagtccttaaactcattactaccaaaacataaatcttaacggtatcataaagttatatttttctttaaaacaactttattcttatttaaaatttgtcagctatactgtatacaatatagcccttctaggtacaattcagtgcaaatatatgagcatttcttttggaaattcagaagtatatttactttgcattttgaaattatcagtcacattttctatttaggcttcctaaattttgccttttattttgttattttcaggcaaggaccagggaaatgtcagcttttagatccaaaggaaacatatgtgttaataatttgatgaaatttcaaaaatagatttattttgtgctttcagaaaaagtgtgggtagaagtataacctcataatttatttctagaatcattttcttattcactgatactctgatgtcacaaacagcctggctgaaattgaaagtgtacagttgtcaccactagagtttgaaaaggacagtcttacatacatatatatattcaaaaacagtgctgttctccaaagactaaacatataatctgtgcagtactatccatatttatcagtaacttcctttcttacttctttctaaaagaactgtcaatcaaaatatgatggagaatacttttgcaaatgaagggtttcatagattatccaagaagagtcatctacatgttgcttgtgttttatttatatatttttttatattctgagtaatacttgtattaaattaattcctaatttcaattttatttaataattaccttcagaagcagggcttatccgtggaataaaggtataaatgtacttaggatggctttaatacatttgtaatttatatttttgcctcccataattccaatttagtttcattcatttgtcttaaaaggaatcttaacatctatttggttttatgccatcattatgcttaaccaactgcataaaatgtcctcttatttcttatctgtgcttgttataatatttataggcagcaagaaattatttttctacctaagtaaaaaagtttcttttttcccccttatgttataaacttggtgtaagaccaacagtacagaatcagtgttgtctgatttttttttttttttttttttttttttgagacagagtctcgctctgtcacccaggctggagtgcagtggcgcaatctcggctcactgtaagctccgcctcacaggttcacgccattctcctgcctcagcctcccgagtagctgggactaccacgcccagataattttttttttttctatttttagtagagaagggatttcaccgtgttagccaggatggtctcgatctcctgaccttgtgatccacccgcctcggcctccactttgggcttctttgaagatacatacacagttaatgttataagttttagttactaaaattcagtcaccagctcactcaatgaagatgcggtaagcacgagtcttcacaaagcactctggcaggagtgtgttgaggggagagatttagaagcatataaattcagatgacaagttagataaaagggaaagattttatttaaagtttattgcattaatctgttttcatagagtagttcatggtcaattatttatttacagggaaaataatataggagttcagagagcagtatcactacagcttagggtggtcacacttggttgttgggaagatgttttgaggcaatcttaaaggattggtaggggaaacacaggaagggacatcccaagtaaatgggataaggaaaagcttggaggcagaacatgtcagctcatacagaggaaacaggatgtaaccagcttggttggagcagagggttgctgtcagggagtaggaagaggtaaatatggcaaaggtggtgtgaatctagtatgggagcacagtaaatgttatggtagactaggagagaaccagtaaaatttgaacaagagatcaatatgccatctctatgaaaattaagctgttatggttgtaccaagccaattgaaatgataagaatctcaatatgggaagaccaattgaaataagaagggaggaacaggtagaggagataaggcagttaagattaacagtcatgttttgatagtgagaggatagtgagtgatagagagcagtgcctttaccagaaatgggaagttcataggaggccggttgggtctgtatatctcagtcagattctacccagtgaagcagaatctgtaggacatgtatattaaaagatgtgttacaagaaactgccttatatgactgtgagaagtggctaggcaagtctctagggcaggtcatgagagaagggtacactagagctctcaggcaccggctaaagctgcagtctgcaggtagattttcttctgtcagggaagcctggactctgctcttaagggctttccactgattgaattaggcacactcaaattatctgaaataatctcccttacttaaagtcaagtgattgtagactgtattcacagctacaaaataccttcacagcaacacccaaatttgcatttgattgaaacccccaattaactggcaacagtagcctggccaagttgacacatcagaaaaccccaaagtattgtaaacactaagatgctggtaggattgctaggcgaaagcagccagaagtctattggaaattatgatttgcaactcatgaaagctatggagattagagataccaccctgggagttatccacctgaagagttaagaagatcttcagagagttaaggagatcctcagagaaggctgtagaacttctgcatcaaagattaattcttggaagaaaccatttttaaggggcagaagaaagaagagttaaagggaaaaagattaaagagctaagaaaagaactaaaatagcacatagtcatagttgttcctctgtttgctacactttctccctggttttccaagatttccagtggggcagggaacacagcattggttcccctgttttccacctgtatttggggtccttgctaccaaagtttcagagaaaatttgacctgagaagaggctagtggttttattgtgaactttgaaagtacaatttaagtaagattgttaaaagggtttccaaatctcaggtatttcaagacacagtagataataatgaattagaggtacaactgttatgattacttagtgaaaagaccattcgggacctttgcccccacagtcatgaatgccctttgcctttctcatctgtctagcaagttatatttaactttcaaattatagttcaagtatctcctcctcagcaggaagttctttaacttaccccaggagagatgctaacttgatcccctgtctcatctctcacttaggaatattttttacttctgattctactgaaatagaattgcttatgtggtttccttcctcccccaccaggttgtaagtgtcttttaatttttaatctacagtgcttataacaataccatttaagtgctgcatatatatttggggagtgaaggtatgaatatttgtacatgtatggatagcatttagaaagcagacataaatatttataagcagcttgtgaaaaaagaaatttggggagtactggggcttaaagagtacaaataaagagaataaagtagagaagaaaagggaggaaaggaactatatgataggaatgctgcagaggaagaggagggataccttctcccagtacagaaaaggaggagaggtttgatgtagagaagaatgtagttgggaggaagtatgggagaaatttgtcttcccatgaaagttaaagacaaacggatatgagaaaatctgccttctcctaaaaatatgagattttttatatgaaaaacttgaaattttaaaattatatttgtcaactctgatcaaaagcatttaaagcatttataacaatgaaagctattccttttctctcatatctctgtgtgtctgtgtctgtatgtgtatgtatgtgtgtatgtgtgctgtgtgtgcacatgtgtggtctggagggtctattatgggtggttcttatgcaaatttatttaattgatatttcacctatgtgtgacatccccccagccatatgctatcataggattaattacaagcgctagtaagtcaaaatatgtctttgaaaaaaattcgtggattattactctggtaaaataacagtactctcctggagaaacatgatttctgcagatgctaagatgtgtaagcaaactgtcatcctgtttttctttctagtagagcactactttaaagtgctctacttaaaagagacaactttaattaagacttgaaactttgtccatatttgaattttacagttttatgtttatttgcatatgtagttgaagtgtgaagtataccctgaaaagttgactaacttctctcccaaggacaccagaaaggtagaaggaatcaggaatcagttgaaggccagagttaggaagacagaaatgtagtttgttaggtcacgtcctgaagtgctggccagcattcaagaggaagttaagaggcaatgggcaggacccaaccagtccctgtgtagatagacgagccccttagccatagttcacctggtgccttttaaggggcaaagcttttggtaacttggagctagaagccctgaatgtgagttctaattctgccatttactggcgatgatctcagcaaaataatttaacctctctcatccttggtttcctcatccaaaaaactgaaaatatttatcaaatagtggaattctttatgaatataattattctactctgggttgcagtctaaccaggaaacagtctagatcatcttgggctcacagcaagtcagaatgtggagtattagaataaaggcagcaatcttaaaggctgtttcaaaacaagaatctaaaatacctgggccaaggattctaggcctgtggttctagaagcctgtttgaaatttctggatcagaatcagacctcataatctgtgttggacaggccataaacatgtgttggtgagaatcatgaattttcatgtcaatattatattgtgtgtggtttcttgaaaggaaaataaaaggtaaaagtatctcattcaacaattgagattgaagatatatatttccatggcatttaacctttacaaaattacccatcatttctcatcaaaattgttaatgtactcctgagataattatttttgccatgctttctagggttccatctttttaatgttttaaagatttttttatgtgtttaacttagcaaatggtaggtgaaacattaaaatctacaaaaatgctcttttttcctgagattgatttagaacttgactgcttattttctttccaaaaaatgtgaacttattgtacagagaaatacagccaaaatcaatttaccaagaatttagagtaaacagggacatacagtacttttctcccttttgtacctttgtaggggcaatttgaaggagcatacttaagaattaggtttgcaaacaaaatctccctgtttctaagaacatcggaaagaactaaaagtggtttctctggactgtgtctaatcttcagcgattggtttgctattcattgttgggaaactatatatggctgccgccaggttgcatgacctgttacataacaatttattgaagcagggagatgctaaagtcactggaggttggacttggcctgttaagagtgtgaacaaatggagtgtaacaatgtgtgtgatttctgaaacaaacaatcctgggaataaaggacacagtccactgctttcataataagacaattcttttttaaacaaaattaaaattaaagttttatctacagtaaaggtcaaagacttagaagtggaaaaattaaggctctaattttcattgtgttggtaaggagctaagtaaccacaggctaagggtttaaccttactgcaccttggattctttgatcagactttggattccgtcatttatttttaaggtttcaatgctaagtttctgatctgttctattctaaaatggatcaatttaacccaccgataatttgaatttcagggttttcagctcagtgcttatttttagtactgctttagtattgcataagccagtatttaatattcttataaatatactcctgctctaatgaaaaagtatcaggtttgtttttaccttgtgaattacagtgttttccttctcaggaagagttatcaattccacattcatggccatgttcattcattcccacttattgaagtgtggctgaaccagaatcaaacatttttgtgtgtgattaacactgaacacacctcctactcctcaaattatcaggattgtcattgtttatagtcaatttaggacaatgccttgagagtaataagcaaactggaaagaagagaggcagaaagtaattgattctgctaaggatgtcaaattaaattagagtcagtaatacgttatcattcttatctcacattttgttaacattttcattcattaaagcttagacatctgcttaggcacatttttttttctcccacagaatcattaaatactgtacttgaagtaatttagtcaattccttaagatacagtaatgcagttctgaagattggtaaaccttaatccaccagattttttcttcaccagtatactttttattgtattgcatatttcaagttcatgttcatctaatttttaaaagatgagtagtgagatgaaaactaaagacctaattttattatttattttttatttttatttttttgagttgaagtctcactctgtcaccaggctggagtgcagtggcgggatcttggctcactgcaacctctgcctcccaggttcaagtgattcttctgcctcagcctcccaagtagctgtgactacaagtacgcaccaccacacccagctaatttttgtatttttagtagacatggggtttcagcgtgttggccaggatggtctcgatctcttgacctcgtgatccgcccgcctcggcctcccatagtgctgggattacaggcgtgagccactgcgcctggccctaaagacctaatgtttttaatacttcattgtaccaattctcaccaccaaaccatttctttttatgtcctaagagttttcttttggtcttcagatacgcaactatgttttgttatttagtacctattctaaccacagtcagtggaaaagcaaccagtcagcagtttcccaaaacccttagggcacacaggctctaattaagtttttatgcataagttatattcttcccagtcatggaatgattcttcattggtgtcacacaacctgccctcaaattactaccaaggcctgtgtggccaggcctcaaattagcacaatttacattatttgcctattttctctcttgtcatatccatactttgagctagagtagatctcagtgccagtctgaaatgaagtggtcagagtattttgcgttaaaacagcagtcagcaacctttttggcacaaaaccagggaccagttttgtggaagacaatttttccatggaccagggggtaaagggggaggatgatttcaggatgattaaagtgcattacttttattatgccctttatttctattattattacattgcaatatataatgaaataattatacaactcaccataatgtagaatcagtgggagccctgagcttgttttcctacaactaaacagtcccatctgggggtgatgggagagagtgacagatcaggtattagattctcaaaaagaatgcacaacctagatgcctcagatgcacagttcacaatagggttcattctcttatgagaatctaacgctgcctctgagctgtcaggaggcggagctcaggcagtaatgcaaacaatggggagcagctgtaaatacagatgaagcttcgcccactactcacctcctgctgtgcagcctgcttcccaacaggccacagactggtaccagtccatgaccctgaggttggggacccctgctttaaaaggactagccagtcagaatcacattgtgctgatggccaccctcactctcatgagctctttgcctcatcaagtttagcgtttctgattttctcttggcctctctaattaattgatttttatctctcttcttacattttacagaatttctcctgtatttactaataactcgttctatacctactaaataatcttgatactttttttctcctctaaaagcataaattacctttctgatcactcagtaaatatataactttttttttaagttttcattacatttcctctagaataggtatgtcagctggatgttagaaattacactgatgaactaacttgtaccagccacatgtagttagttatcataaatccaaataagcctccaattatgatataactaaacagagtgaaacatttctagatgataatattttgggagagtgcagctaccttgagtagttattgcttttcacagttgaatttgctttttctatgatgacagaatctcctagagttgtatgcaggtacttctggagggagtggggcaaggtttgggtacacaagggacccaaacctggattggatttggattgctttgtaactaagatatggcctgtaggggatctctgcagtttttgctggcttgctccttgggagcttactggtgaaaatgtttgtaatctttgcctactgaattatctgccaataaaattccaaatttcccttttaataaaatggaaatggaatatttttaagttagcagtggtaaatatctctgaccacattcttgcctcttggttttataaatgcaagagaaaagagatggtttctggtacatctgaatttactttttcatgaaaattctgaagttagaaaaaagactatatgatttccaataagttttggagggactgaccctagcaccccaattttcttttaatctcttcttaaatcaaatctttgtaaataatgctttcacattctattaaaaatgtatagagaaatattcacccaattatgtgaggatcgtaaaccagtcattacaatatgtgctagcatacccttgttttagtctgtgaagtgtaagttttgctaccctaaacctctgactaccctgctgtcatcctgcctcacttccatgaggaatattttgtctgggtctatagattttcccagtccccggtgtgttaatgtgagaattgagtctccagtaagagctgttactcttccacatctgctcctttccttgtaggcccccaagtcttctgaactaaggagagaaaaaaactctataaaaaagaagaagggctgggctccgtggctcattcctgtaatcccagcactgggggaggccgaggcaggcagatatcgggagctcaagaccagcctgggcaacatgatgaaaccctgtctctacaaaatcatacaaaaattagctgggcgtagtgttgcatgcctgtagtcccagctccttgggagactaaggtggaaggatgactagagcccaggaggcagaggttgcagtgagccaaaatcacatcattgcactccagcctgggtgacagagagagactctgtctcaaaaaaaaaaaaaaagagaatcagattttgctactcatataagatttccctgggtttttaatcacagaaatttatcacaggtttttcagagtctgaccaaaactccaaacaaaattatgcaacagacttgttctaatgatagttccttcaaatggatcaaaataaaggattcattgtttacgaagcatgggacagttttacgcttgagagattctaggcttactggaggccctgagcaataaatggaagtacacattcatatatgccatttaaaagttataaaccaaactaacaaaatgccaaataaaaggtcttttagtctccttccttgacaaaaatatctttttaatgaccaaggaggtcacatttcaatttagaattctcaggctctccagagttctgtgcttgggcttggcttaccccacctcctgctgaaacctgtcacccaccttcttctgttcccaaaccttggctccgtcctgtaccttgagtgtccttgcgcacgtgttcaagctgtgtccactgccacttggaatttagggtgtgcacactgctgatactatccatcctcaggagagtaaaccctagaaagacatctgggctagctctgggattggatgcagggccattgaggcaggaaattctaggattccatggatctgaaggttagttcagaagggaacatgggctctgagtgggcatggactctgggtgggcacatcctcttggccccctcttggtctatgggacagggaaggctatatgctatgtgaagaggtaagataagaagagggcagagcaagacccttgaaagcaagaacagagtagggccccaagcagaggtttgaaggccaaactgatactatcttttcatagtgtcttgaacataatatattcttataaactgcctgtattgattaactaactcactgattccatctttgtgaatttttattttatatatacagacatatattcatcttgttcttaggaaatcatggccaatcctgatatgatcaatgtatacaactaaaagatgtaaaggaatcaaaattcctctttacacaaactttgcctttaggagatcatcaaacttattttattctttccttgtaacatttaactacttcatatgaacgatattaatgttgacttctcagtaatggtcgtgtaagttgttctaagtgtttacctcacccatccttacaaaagtatacttacacatgctgtctgcctctccattgtgaattgggaaaatcataagcactcaagaataaataaatacctgctctgctgttgtttcaaggtacattgagtcccccaacaggaaactgcccaattatcccttatcaccctaccatttagagtacctgatgctgtgattttgattttcagtgtgggggcttctttagtgataactaattacatatgccacatctctcctagatcaattgtacttctgtttcaggttttctcaagaattgctgcctatctctttaagttgccctgctgggtctcccaacaggaatttcacaatactgcatagcttctattctaaatcaaaccaccccaattttgatgaaaatccatctaatttattttgtggaatgtggtaagaagtacagagaatctattccattttacagaatatagaaaacactttttcttaattttctttgtgacctaaaaccctctcttctatctataacttgtgcagtacagtcatttccacacaataattaagaacttcatacatgtgtgtttgtttcagaatattaaactattagaaaaggacacctcagggcaggtgtagtggcttatgcctgtaatcccagcactttgggaggccaaggcgggtggatcacctgaggtcaggagttcacgaccagcctggccaacatggcaaaattctgtctctactaaaataataataataatagtaattagccaggcgtggtggcaggtgcctataatcccagctattcaggaggctgaggcagaagaatcgcttaaacctgggggatggaggttgcagtgagccgagatcatgccacttcactccagcctgggcgacagagtgagacgccgtctcaaaagacaagaaaagaaaaagaaaaggacacctctgtttattgtaccctgtggggtgccatgagggtatttaataaacggtgtttattgctagaatcttcccctctaacccaatattctctgagactttgtggggaagaaaaatttccattaactctcttattagaagaggagccttattcttccagacatgaaactgtagaggactaaaatgttctatctgaagctacagaactgagagtattctttattattcctaaaactaattttattatttcaaaaatccacactgggtttgatttagaatattatcttctgtggtacacgatagggtgctgtaacaaggcacacacagatagtgtttaatcaagactcttacataatagtcccagtggtcatcccagtctgggctgttatggcgactcctttatgtcagaggactaggcttcgccagcttcatcaaattctcctatcctagacccaaagtagctgctctagctcccaccatcatgtccccatgccttcaagagcagaggagggaagggaaatgtggtcagtccttaacttagaagataggaagtttaccagtaaaacaaatggtgagaatgaatagatattgggggcacatgtaattatctgtgacatgttgcagcttaattttacggcattctaaatagcatttggaattaaatgtgaggcccggaaagaacatgtgctttgaatggagcaaggagaattggcattattctacttgaagatgtaatctgtgcagaatactttgagatcttattctgtaacaatagataactttaaataggttccaggcactttcctgagtgctttacatgaattatctcgtttaatactcaaccctatgagctaggtattttgattcccccatttcatagatgaggaaactaaggtgtaaaaggctcagtaggctgcctgcaggcacagaactagtaagtggtagagctggtacttgaatccaggcattctgagtccagagttgcccctcaaaccacttctggtccaggctccacttggaatattagtctgcctgttgagattggataggaggaaagattccccaaaaccttgagtttaaataaaagtttttaaaaatatatattcacaatagcaaagacttggaaccaacccaaatgcccatcaatgatagactggattaagaaaatatggcacatatacaccatggaatacttgcagccatataaaaggatgagttcatgtcctttgtagggacatggatgaagctggaaaccatcattctaagcaaactatcgcaaggatagaaaaccaaacaccgcatgttctcactcataggtgggaattgaacaatgggaacacttggacacagggtggggaacgtcacacaccggggtttgtcgtggggtggaaggatgggggagggatagcattaggaggaatacctaatgtaaatgatgagttaatgggtgcagcacaccaacatggcacatgtatacatatgtaacaaacctgcatgttgtgtacatgtaccctagaacttaaagtataatatatatgtatatgaaacaatgcaataaagcatttgcttctttctaggcttcaacctgaagtattactttattattatagtcagggtggtagacagtaaggagatattctaggtttatgcttagtaaatgaaatccagcttcatctgaggtattaacttagaccaaagaagagtaaagaaaacgaatgtgaagtaaatgtgctatttttactactactgagcaaataaaatctgagcctttatcttcctgttgtcaagagttgttaataaatgatttcagtatactcgtgtaatacttcagattacttttttttaaaattgagatagggtctctctgtgttgcccagactggtcttgaactcccagactcaagcaatcctcccacgtcggccttccaaagtgctgggattacaggcataagccaccatgcctggccttcggaccacttcttatttaaggcaacctgaaaaacaagtccattccagtatttggggcttaatctcatcctcagacaatttaggtgattatttatccccacatgcttaaagtatctcaatcatcacaattattaaataacatgataaaataataaaatccactccctaaatgtgtttatttactagggctgctgtaacaaaatgccatagactggatggcttaaagagcagatatttattttcttaacattcgagaggtcaaaagctcatgatcgatgtgtcagcaggtttggtttcttctgaggctctctccttggcttgctgttggccaccattttgttgcgtcttcctagggtggtccctcttgtgccggtggcccctggtgtctctgtgaggcctgatctccagctcttataagaacaccagtcaaattggattagggtcaactttaatgatctcgttctaacttaatcactgctttaaaaggccttttctacaactacagtcacattctgaggtacagtggttagggcttcaacatgtgttttagagggacataatttagctcctaacactagaaatactttggaaacattgaagctgtgaaatcaaacaatttacacgagtgagaagttcagcatttggatgtttcccgctctcttatctggctttagccaaaataagaggtagtacagatggtatgtttcagtgtatacaaatctctttacttaaatatttttgggcagccttattaagtttaatatgaagattatttaaaacatacgaaaagccatgttgaacttgctattgtttatactttcaatagctcagcgaatggaaaaaacaaagttatgttagctaacattttgctgaaaatgtaagtgtaactgagtgatttaagtagatctgacaggcaaggctttatagtcaatcatagcaataccaggtttttaatgaaagaatagctattagccatggaagagctgaaaataaaaataaaggtcaatgttcgaacagatgaatccttttctgaagtagtatctgtaaataacttaaagtacattgtaacaaaataaaacattttatatcttttgggttagggaaatgcaataaaagtggataagtacatcactaggaaagatttgaaatattctcttgaaggaaaatatcatcaaaagaatgattccatctatctcacaaaaatactcagaatgatactgtttttagtttcttgaccactgtattctttcattagaaatatctttggaaaatgggaaaatggaaggaaaatagtggagtttatgactgataggattaacctggagaataagtgagagaaaatgaggaaaacaatgaaagccaaagaaccttgtgccattttctaaaaataatcctccaacctatgaaatttttacaagttgtacttatctggcttaggataaaatatattcaaaaaccttggcacaacacaaaaggaacatttgtgtttatttgcttaaatactaaagaaaatgatggcactattagggaagactaataaaaaattccaactatatggttaccacacattggaagcatctgacatcaacaaaggagagctgctgcatattttcttttaaataataattgttggagatagatgacaatattactatattatattgcatgtaatacaaactacacacaattgtatatgggtaaaattgtataaggaagaccaggaccttgagattattaaggatagcattaataacactacaacatcagttcaaatgatatgtcactgtgcaccctgagggccttagataaaagaccctccagtgtttacttctctggcttcacacctcactatcttcaatcaccattaaattaactctggtgattcaggaaatgtagttaactcgagggaccatactctttctcttcaggacctttacctatgctgctctcctggcttgaaatacaactatacaattcccttccaccctgcctccatccgtcctctacctctacacagagttaaaatttcctgtgaaaatctcttaaatagcaatctacagtctctcaataagtccaatactgtctgcttttacacagtttgactacattggtgctgttttgtttaaatccagataaagccattggcttgcttttaggcagcctttttttagaaatcttcataaacacaagaattatcttgaggaactgaaacaaagaagaagatttgcatttctcagctcatgatctctccagtttacatgctcattaagtggcattgcaagctgcgactcacactcactgcttgaattattctctccccttctcttcttctcttcatatcattgaatttacataacataaatacataaagttaaatacatataaaataaacccactgcacagcacttataccacatcacaatgagacttttacttgtctatgtctccttctagactatgaaatggttgatgggtttctttccttttcacacttacatatacagtattggggcacaaagcactaaggaaatagtttgttgaatgactaaaggacaaaatgaacaagtataatatactaaccacaacaattttttttaaactgaattttcaagttctcactgcggttccacaaaaagaaagaaaaaaacaactgaattttggccaggcacagtggctcatgcctgtaatcccagcactttgggaagctgagatgggaggatcacttgaggccaggggttgaagaccagcctgggcaacatagcaagaccccatctctaaaaaaaaaaaaaaaaaaaaaaactaaaacaattagtcaggtgtggtggcatgtgcctgtagtcctggctgttcagaaggctgagaggagaggatcgcttgagcccaggagtttaaggtaacagtaagctgtgatcacaccactgcactccagcctagtgatggcataatcatagcttactgtgatcttgttactgagacctagcaagaccctgtctcttaaaaaaaaaattaatttttacaaaataactgaatttgtcacctcaaaaataaaaaaaatatattatttcagaataaccaaaaaggttatacttacttgatactttgtttttgtgagttaacaaaccattattgcatttattttggacctaaattgcttaatcaggtgatactcttttattgatttttccaattaattgatggagttggatagtgtatccagttccatcagagactgctttggcctcagagactgctttgattggaagatgatttatctgatgttatctatctttatacatctctccagccgataatgttaagtctaacaatgtgtttttccctgttcatctaattattccaatctacatagaaacaagctctactaccacacatcttaaagaaaaggacaacctcccctaatactgtgtgactttccaaatactacctctcaatcacaacaaacctttacaaaatagtcataggagctgtctctatttactcacctctcattccctcttctgactggccactcctttcaggcacctaatcttactgcttcactgaatctactcctctcagtcagttatctccatgaagccaagcactgtggtcacgtctatatttttttcttactaaacctcttaagtagtaatcaacattatttttttagttcttgacacacttacttcttctgatttctgtaccattgcacttactgcttttcccccaccttaaaaggtcctcctattcagcctccttgacagtcctgattttcttctgtacctctaactgtgggaatattccaagctccattctctttactctttatgtgtatttcctccccaagttcttatatttaccagcatagattttaattgtatctgcatgtcaatatattctatctctctatctttctagccttgacctgtttctcatggtcctaacttaaaaatacatgtttactgtattccctattctatcttattactgttgtatctgaaacacctagaacaatgcctgtatcataggttcttggtgattaatgagtatttatagaatgaattaataagtcagtggatgtttctaaatataacacatatctctaaataagcaaagagagaaagagttcacctgtaaatatgacatcttttggaatactctttgagagaaagtttgcccttccggaacacgggtgaaatattgcccccagacattttggattttagtaatttttcatgtgactagagaatattaaaatgcactacttttctaatcttttttattcttaatagaatacttcagatggtgttcacaaatcaaaggtttcatgtcataatttgtagtagactttatgtctttataaggttaatgattcttcaatggatacaaataattaataacgatggcattcctaaaagcataaaagcattttctaatattgtatatattttaatggactatattgacattaaacatattacatagatgtaacacatatttgttataattacagtatatgtacatagatgcagataattatacatttgtgcttgtatagaatatatgtgctttttaacaaacttttacaaactaacttgtaaagccatatgtgaatgtatacataaaaatacctgtgtagataaccattgttctatttgcaaaataaataagaccagactttacattttcctaaaatgttgtataatggaatgattgcaagactaagatttagaaagacaggtttctaattcagcttttgctgctaactaatgtgatgttaagcaagtcattatatccactagaatgtaacctccattggggcagggattttgtctgttgtgctcattgctgtattaccagcatctggaaaagactggacccagagtaagggccgaacgaatttgttgcatgaattctgtttctccagatttacagtttccacatctataaaacaatgtttcttctaatcctcacattccaaattaatattgggacccttatgaatttaaacaaggcaaatttaaaactagaactgtttattgagcttctgcctggacctttatattgcttaatcaattgaagctcttttcatgaatatttatttatatgaataagacaacagttagatgtcagttcatctgccatcttcattcagcaggactaaaacaaaaactttaatattaaaaatattcaaattcacaaaatcaagtaaatataaaagaaaattcaataactagcccctcaaatgatatttttcaagcatttgtgtcctttacaccgtggaagctattaaagtttaaaactgctgtaagaattttgagacaccctgtagatatacctttctttaagaaaacttgatatcccaactaaaatatacaaatgaataaagattattcacttttaaagtttttcttttcagttttcattttcatttgtcaccaaatatgtaatgaacaacaatcatgtgaaacctgtgttagataatgcaagataagtcagttattgacagtctgcacttcaccgtcatctggactgccagcaacacacagagcctgagatcactggtgacagagcctctgggttggagtcaacatcgacattacaaagactggagaggaagcctggggacctgtgcactacttgcaagactgcagccctccccttcccctctgccacagccaccattactcacagccttccgtcagcaggactgatccccgcagtgtactgcttccctctttcctcatagcttgtgtcgtcacttccccctgccctgcttaatcagaccctggctccttttcaaacaaaataattcccgctctacctcatcactctctacccctctcatcctgcctaattttttccctatcagcgatattgtatcttcgtttcactgtctttcttttttttttttttttttttgagatggagtcttgatcagttgcccaggctggagtgcaatggcccaatctctgctcactgcaagctccgccttccagcttcacgccattctcctgcctgagcctcccgagtagctgggactacaggcgcccgccaccacacctggctaatttttttgtatttttagtagagacagggtttcaccatgttagccaggatggtctcgatctcctgacctcgtgatccacccgcctcggcctcccaaggtgctgggattacaggtgtgagccactgcgctcggcctattcactgtctttcttgtatacacacgcaaactagaatctacgctcctttaaagcaggaaatttctcatccatccatatatctccagcacctcgagcagtgtatgacacataatagatgctccataaatatttgtaggatagatgaatgaacaaaaaacagaatgaactaacactctaacctgaacccgccatattgttgatcctcttaactgtttctcctccagttttcagcagcacctcaccgtttagatttaatgttcctgcaatttctctagccatgatcctcgtgattttcaataactggtgttctatgcagattttattatctcatgctgtcttggataaacacttgtaattcatcttggctcaatactttggtaatatacccctggggcttacccctgtcctttaagtgagatctggccagtatgtggccatgagtggccactgctctaccatagtgacttcacaaatgaattacctctagaaaggaatcaacatataaatgaataaataccaaaactaaactaaacagcatttacaatggccatagatgaagtccctgccttcggtaagtgtgcacgttccacaatgacaagtcaagtggacaagacagagtccaaaaaggggataggaagagaattcttgagccataggtaggtaagtgggaacatccatgtgactcttggtaggagtataaatcactacaatgtttctaaaggggaatttagaaatagctatttaaattaaacagattcctaccctttcagtagcatttcaacttctagtaattcattctgtagaagctctcctataacaactggaaatatccaatagcccatcaataaagagatggtttaatgatgaaccacatagtcataaagtggaatagtgcaatctttaaaaagaataaatatatacctgtttgtgttacattatattaaatggaatgtgaaaattgcacattagtatatgtggtgtgatttcactatcaacagtttatacccctgttctagatacgaggaataacagtgaacaatactcacaatgaccctgctcacatagaaattaaattctaattggaaaacagaccacaaacagataaaggtttaatggcagatgaagcagtgctgtgaagaaaaataaagcacagcaaagggatactatacaaagcctccctgaggagacagcctgtcttgaagcagaaatctgaataaggagcaaggcaagaaagtcagaagagacaaacagaagtaaaaaaggcccagaagcagcatgcttgcaggcttgaggaaatgcagggaagacagtgtgactggagagcattgatcatatggaatgaggggcagaagatgagatgtgaggtgtccaaggaccagatgatatggcatttcctgggccacgataacaattttggattttcattttactttggtgattaatcattataagatcttgagcaggggaatgatatattcagatttacatttttaaagactcaccatggctgttatgtcaagaatattctgaggaggaaaggaatagaagcagtgacactagctgtacgggtatggcactgctcttttgagtgatgatagtgtctggacatagggttggagctgtggagaggaagaagaatgaccagacttgtgatgcattttgaaggcaaagccaagaggattcgctgatggattgggtgtggggtgtgttagaggaatcaaagatgattacaaggatttaggccttatcacccaagtgaattgtagtaccatttactgtgggaggaggatttagtagtgggaggtggtagtgtggtggaggtggggaagagttctgtcttggatatgttaatgttgaagtgcctatcagatctgtaaatggagctactaggcaattggattaatgacttcagcatttatgggaaaggttaagaccttgatgtatatttgggaggcacaagggcataggtggctttgttagctatgttaaagctatgttagagatcacctaggaagtaagtgtagaagaaagcaaaaggtctgaggcctgaggtctagggattgtctatttctaaaaatctcaaagaggaaaaatccagcagaagagactgggaagtaacaaccaatgtcaaagaaggaaaaacggagaatgtggatcacagtagccaagtgaagaagcttgtataggtataaagaaaaaatagttcccaaattactaaccattgtcttccttgagtggtgaaattatagggggcattcaatgttggcaatttctgtaacatttaaatattttgtaatatacatatattgtctttgtaagcaaaaatagcaataaaaaggttaagaacaataaaaaataaaaatgttaatgaacatactaaatgtgtaggaaggatcagcattaagttcatatagcataacctattatatctttgattagacaatttacaaaaggaatccagtgaccaaaaatgagagggaaaaaatgcagtgtttcaaatggcttatctaagagtgtatttaggtacctgctttgtaaaggttttatgtggattgaaaagttaatgtgtttatatagtagttatgtatgtaattatgtatatagagcatttttcatatattattaatgggtattatatgatactatacagaaactaaagcgaaaaccagaaatttatataggacgtatagatggaataaagtctaacagttttcctaacctattgatactgcttatacatgtaagcaagtaaatattttagaatttatttccatgctatgaatagaatgctggttagtgcatttcaaagtggctcaagaaaattcctctgagcttatcaagaactgaaatgcaaatgtatgtaattcccagtacaaatggaggtgtacaccccaaactgccagtcagaactcatgcagctgagtcaaaaggccatgaggtagctgtgtagtctttgaattaagataaaacctgttacacctaactccataatctatatggagtagaaataagtataaatattatatagtgtatgttaaagtgctgcaaaaatcatcaattaaaatactagtttctcttcatgaggattgctgatacgtgacagtaaaactgtggtatttttcaaactgggttccaaatgcaccttctccttaaaagaacacgacctgtcctttgggactattcatacacatttagtgaattccgtattaggagaaacctattagattgttcaccattatctttccacagaacagttgggtgccaaattcagattttcattgaagttgtcaccatcaataatacaatgatttcattttggctgattgagatttaggcagtcactgaaactgtggccatggcatagcatccagtggtactccccttagccaagcatactttggcaaggagcctgaatcaagcaaagtactcccttaggttactatttttctgattaaatttgtaattatgtgtaaaattaactattgtatttgcaggatcaattgatattcaggagtaaactgtctaaataaaacttagagtttcttttactctctcctgtcagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaagtaagtgctgtcagcacgtctgcatggctgtggaaccaggaattgtgtactaatcagtaagataacaaagccactgagtgttactgtgcagcttctctatttaatcagaagttcaaccatccattttaaaccaccctgatggcttataagtaagtacacatggacacacctctacacctggtcattcatacctttcaaagggtgaagaaattctgagtccacatgaacaaattgatttcttgcatctaggaaagcccagactagttccttactggatgtttagtgtacaaatgccacaggtaatggactctttcatatgggaaactcatagtctgtccctgtcaccaaagtccaagttaaaatttataagtaaggaactgatttcccattttcttaattttctccaagctattttggaccctaagcttttctaagtctaacactgtcatatatgtaagttacattttcttgtttttaaaacattgctgactcatttttaccttaggaaataatccagggtctatcagcttcattatttttctgactaaaatgttttagttaattctgaaaaaatagaatacgatttttaaaaatttactcttttcgattctttttcttttttttttttttttaccatttcatatggatcctgcacaaaacctgcttcttcctatgcttgagaatatttctggtaaaattgaatttttattgaggtagtggatcttacaaataagtaattaatgtgttgttttggattacatggagattcaccacatataaattttccataattatttgttcattaccattcacattactcatataccaatttgatatttctaatttcttgtctttactggaatttttctatattgtttagaaaatttaacagaattatgccaagttactgtttgtgatattccttcccattcctgaaactagttggtctctgtttagttggtcaaatgattggcttgttatgcatgtttccagtaaggaatataagaacaaaaatcagcaggtatgaaagttacagagataaacttactgacaaaatacccatatttgatgaagtagcataaagtaatatacaaatgagacttgaacacatcattttctgatataaaaaagtaacaaataaaatttgcctccatcataaaccatttaatctcttggatttattttcatggtctctggatgggattataatctgtgtcccatttaatttccttggttaaaagaaataatagatgtgaaagcacaatggaaagagtaagtctctatagaaatatgctcattcaaaaaatgcttattgaatgcctatcacataatgagcatagttgtcattacccagtgataactacatcagtcaacaagaagagaacaggcactgcccttgtgcagcttacatcctggggctatcaggaagttgtattataggaagaaatacagattttttaaccaattaatttccattggaaccaaataaaagtctcaaataattcatctttgaatcaattaaatgtttataaataagaacttgaactatgttataacatttattcaagaaattattggccactttaaaaatttagcatgaatgttacctaatgttcatgagcaagtatctgtgtgaagtttatgatataaaaattcgcatcttatgtttttttgtcagcaacacatttatataaggatttggaacttggtatattaaaaactataactgagccctcttgaatagagcattaggtgttaaattgagagtttacacctttcctcagtcaatgttaagcctcatatgcttggctcaaaggcaatgcaaagaatcaattaaaaaaacagattgtctaagtaatatttatgtttcatgatcataattagtcaagtggaaactagtgaaaagaattctagaagatttcatgggttttttcctttggtttttatccttttgctgatagtttaatatttcctggagtgcgactgggagctgacagtcaattcagtgattttcttgatggattgggaccagcccagcttgttggccgccaaacccttgccacccctgcaatgggtaagaatcattttttttttctacaagaaaattgatgttttgtgtttgacaaagtcatttaaaatatttaaaattgtgtaatagcaatacaagtgagaagcaacattttagctacagagttactgtttgcaaacaactattctaatttcaagtgcatttttctaatttgagatgttatgaaaaaagaagtaaaattagctataaatatttgaattaccagaaaccctgatataatagatgtaaatgtaggacatgggtggcatttcacagcatggaaaaaaaaaaaaaaagactgttcagtaaagtatagtaacataactatttacctgtgtgaaaaaattaatggaattccctcacgcctacacaacttaccaaaaaagttagtattttagactcaactataaaaaagaaaagggaaggtggagaaaaacactaaaaagtactggagaacacttaagttaatctgtctgtaatcttgcagtgggaaagaacttcagcaaaatgcatgaaaatagatcagcttgaagacacaacatagtggaatttcacaatactgaggcttgatagaaaatcatgcaagcttcctaagaggaaaaataattttacaaaaaaactatcaaaaatcagattcttgccgggcgctgtggctcacgcctgtaatcccagcactttgggaggccgagacaggcggatcacgaggtcaggagaccgagaccatcctggctaacacggtgaaacccccgtctctactaaaaatacaaaaaaaattagccgggcatagtggtgggcacctgtagtcccagctactcgggaggctgaggcaggagaatggcgtgaacccgggaagtggagcttgcagtgagcccagatcagggcactgcactccagcctgggcgacagagcgagactccgtctccaagaaaaaaaaaaaaatcagattctcattgagctcttcgtattttcattggattcttcaatatactggaagccagaagactgttagcattaccttcagaattcggaggaacaagagatttccaacctagaatacaaaagccagccaaactatcaagtaattttgaggctacagtaggtacatactcggccccaagcaaggcctcaaatcattttcctcatttctaacatttctcagaaagctacttgaagatttactttgaccaaacgaactaaacgacttttcaaaattatgaactaaaaaaaaaaaaaaaaaagatggaaccaaaaaacaaatgcttcctcacaaggtaaatatgattgggatacccaggatgatagcaaaggaagaactaaagatagctgcagctaggtttcaaagcagcgttcaaattgggtcatgtcagacttcatgagataaaatctatagaatacctaatgggtttgatttttatggaagagataaacaaccaggagaaactaagatttgaactagtgaggtcttcataaaaatgtaagcaaatgcttttttaaaagatactaattaagtgtagggaaaaagaaggtctgtctaagaaataagaagtagttataatattctagttcacaaagttatgcataaggttacatagtcaaaataatataaatattaatattgggagaatgggatgacagaaattgtcaagtatgtagtaggggtaggaaggcagtgaaagagatcaaaattgaagtcaataataatatctaaaactgcaaaaaggaaaatataagtatagtgcttagaaataaggaggcaaattccagaaagtaaatcagataaaaatattgaaaattttggaagcaataatttttggaagacaagaagttgagagacaggtagaagttagttatgcataaacataacaggttttatagaacaattggggatatgtgtgtgatttaaaaagaaatctttaagaaacattaaaaggacaaaaagagaacaaaagacttctaggaactgaggtctaaaacagaattataaaactaatgaatgtctagaacaacaaagttgatcaactgaccagacaaataaagagaatccatgcctgagaaaatggaaatgattcaactaagtaaaaataacttagaaattttcagagataaagtatcatataatccacagagaaaaacaccaagagattattaaacaaaaaggaagtatatatttttaagaaagaaagttagagaatgggaaatatagtgacttaaaatttaaaactctggatgagctaaatagtatactgaacaaagcttaagatataattagctacaagaactatagaataccaccaataacatggcttatataaatttaaaaaaatcttttgtaagagaggagaattcaggatgtaggaagaataaaccaaaaagctcaaacttactctaataggagcctaaaaagagaatagagagacagtttttggagaaaaataatgatgcctgaactgttttaagaaaaacataaaacctgagagattgaaagagcacactgagtggtgaactgaacaatctgtacaaaacaaacaaacaaggaaaagcttcttcatgcaatttcaggacatcatctcaagtcatgaagaagaaaaagaagattacctaaaataaaaaacatgatggagaatttcatcagaaaactcaaatctttaagagcccagtagaaattatagaattgaaaaataaactaaacttaagaattcaatggatgagttaccagcagtttagacagagttgaggagagaattggttaatggttaattggaggacagagccataagaaagtatccagaattaattggacacataaaataatggaaaatatgaataagaagttataagaccgagcagaaaagtgaggtctaatatatgtctaattagtcccagaatagggaaaggagtataggccagaagccattgaaaatataatggttgagtgagaattattcacatgtttctagcataaaagaaaaaacaaatatttaaggtaatgatatcccaattacactgatttgatcataacaaagtatatgaatgtattaaattatcacacatacctcaaaaatatgtacatatattatgtacatattatgtatcaataaataaaaagtaaaatggaaaatagacaataaaatgtaacaataaaaattatatatataattgaaaaattttcagaactgaaaataaatatagtcatactttccagagaccctcatgaaccccaagaaaagcaaattcagcaatgctaaaaataatattatcacaaccaaatgggatttttttttcatgaacacatggttggtttaatatttgaaaactaatataattgatcacattgctgtaataaaaaagaaaaaatgaccatcttaagtatccaaaaaaatgtttgataaaattcagttttaatttatgatagaaaattatcagactgaaaatagagtggagtttacttatctgttaacgtttctacaaaacacacgtgtgtatgtgtgtgtgtatttgtgtatttgcacatcagattgtccaaattgtttaaatcttttaatataagtagcaaagacattcagaaatatgcattctgatacactactattagaagcataatttggtgcagtcaccaattggaataatatggcagcatctagtaaaaataaaaatgtagatgtgctgtgacccagcaatacaacttctaatttacatatcctcaagaaactctttgcagcatttttttgtagcagcaccaaataggaaaaccaagacccctaattggagagtagataaataaatatgacattcatgtaatggaatattatagagaaattaaagggaatgtcctagatctcaacacatcaacttggatggatatctaagaaaatattactaagtgaagaaggaaaattgctgaatgataccacttatacaaatgcttaggctggacacggtggctcacacctgtaatcccagcactttgggaggccaaggcaggcagatcaccggaggtcaggagtttgagaccagcctgaccaacatggcaaaaccctgtctccactaaaaatacaaaatatagccaggcatggtggcacatgcctgtagtcccagctactcaggagactgaggcaggagaatcgcttcagcccaggagatggaggttacagtgagccaagatcacaccactgcactccaacctggacgacagagcaagcctctgtctcaaataaataaataaataaataaagcttaaaatttggaaatttatttaagatggacagttgttaaaaaatataacctaccacaaagaatttaagagtaaatagaaagctgaaaaaacctgagtagaactataactaccagtatttaacattctacttaccaaaaaatggggagaatacacccagatattttcacagatgagttctaataaatatgaactcaagagacatgaaaattatgaaacaaatattttcatgaaataaaaaggaagggactcattctagttgctaatctaattttgtatcaaactatacatgggctacatagtgctccttaataatcaaagaaatgcaaattaaaatatcgttttaaccagattggcaaaaattaagcatttttttgatactgatattagacatattgctaataccaatgttagagtgtgggaagcaggaagagctatatttctggtgatagtgcaaactggaacaacctttctggaggagttggcagtatgcatggaatttttggatgtccatactattagatatgaaaatttaaaatcttggaatttgatgttcaaaaaataactgatacaagaatgcgtacaagaattcttataaaactgttcattataaccctatttacatacactgcactataaaatagtttatgtaaataacctttatttccatcaataggagtctgatttaataggtaatgacatgtccatgcagtagtccatacagtcaataaaatgatggtgtatgatcatgattgctgatagatagataaatagatagatagacagacaggcagagagattgatagaagtataagaatgctaggatattcaccaaatattaatggtggctttctctggataatgaaaatacatatggttacaattttttattatatactggatgaaataagagtaagaaatcttattaagtacaagaattatagaaatactttagtgttgttatagtcatttattaactaatttgcaaatctcataagaggtattaataccagaaaaaataagagaatggtttccaaatttgatttggaaactgagaaagaaaagtggattgtggagtgaggggtctaaatattagtttcttatcaaaatcatgaagataaaaatctgtagtctgttacgggctctcctttttgttttaactgcacataactgcaaagaagctgaaacacatcttgctcctttccatttgcaggtgatatacaaataggaatggaggacaaaaagggccaattagaagtggaagtcattagagcacgaagcctcacacaaaagcctggttccaaatctacacctggtaaggagaagtattcctgaatttggtgaagggactatttaataggcaaacaaataaaaacatttgctgcatttgaatttcatatgctctgttttgcatcatctgattgattaaaaaagcagtgtttctgtgttctttgatgttattaaaacggatttgggttttccttgcacagttattctttcagaaggtgttaggaagtatgttataatattttttttaaagtttagttatggtcgtttcttagcttgtgtcaattattttctttttgcacacttagaaaggcaaaagaaaaaaagaatatagttctaatcataaaaaggtaacaatgagctttaagatataaacctgcattgtaacccaagtaagtcaaagtcttcaaataactttgtatacattgagtcaaaatgaggaaaatggcagtaatggtaacatatagatttaaggaacagaatttatggagcaatggaaattttaagtaatttaaacagtcaatgggaaactttcagtaagcatctctaattctctaatagggaattctctaattaaaaaaatagttgaatttaaggaataatttcttatatgttaatatacctttgtttagctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtcagtaatagtttgtttggctttttacattgaaatgtctgttttacccatacatcgaagagatggtcaaacacaaagagaataaaatttggtaaagataaatgtaggataatattcttgagtagacaaaattcaaatggttagtttataatataaataatatataatatcaaaaatatttggtgggtctaatagagaacaattttattttatctctctctcttcttgtcttttctctctctatcctctccttctagctttgccctgttcccagccctcctcactcctcactagatagatagatgataaatagatagatagagatatgtcctcactagatagatagatgatagatagatacagatatagcaaacaaaacaatgttaataatagttggttgagcattgctatataccaaacatggggtacaaagaggaagagggagaggaaaagagaagtgtgcagacaccagcaaatattgagccctggtggagtaccagatgcatttctaggtgcttatatacattatttaaattttgtaactaacatgtgcaataagtatcattatccccattttaaagattatgtctgagattcaagaggtaaagtaatttcacaaaattactcagtaaattttaaagacatgattcaccaccaactctgcttgtgtaaaacaggtgaatgagttcagttgagaacctttacagacgactgaagtattagaaaatagaacctgggagtatgtgaaatggaaggcttgtctgacactagtagccaatagaagttgacctagattgtggtaatttttaatgatctaattgaaatattaatcatctaaatcaaaattggcaggcaagtcctcaaaaggtaccagctcacaattattttttgacctaccccttcactaaaaagaccataatacgaaagaaatcaaatgaatactctcattctttgtacatactttctggtacatacattccatggtatactgagttggattgctcatcttgccctcctaaattgcacaaattttaatttttagatttttatggtcctgtacatcgctaattagatagtagttacacaagaaaggtgttgcattcatataaaaatactcttatgtatttatttctttaacatggcttatgtagctaatactcctcattgactaggaacacacaatccttcattccatcagactaaaattattgtgaagtgtctatgagcaccttaaggttagtgtatcttcttatctgtgccttctccttggtgatagttgtattcattattcttttcctctgcttcactgactggcccacttttacagcatagttgctttgagcccttcgaatgtgaagcagagagaagtccaggtaatgttgcatttctctatctctgcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtc

SEQ ID NO: 64 - DNA, 18811 bp, Homo sapiens
acagactatagggcctgatgtctgccagactataaaatggggggtcggactctagtcacccatagcacctgcccgcctgcctgtcctccagcaggaagtagcaagtccccaggtaagagggaacccacagcccagctgagagctgaaggggaggggaagagaaaagggagacagagagagggaggcagagatagcagtgccatgagagtcagagagcagggccatggagataaagacggaagtggagagaggaagaaagggagggagagggagaggggagagagtgagaaaagacagaaatagagagagaagtaaatataattaaaaaggacagatagagagataagcaaagatacaatgagggagagatagtgggggagagaggaacagagagggagagaaacagacaggcagataggcagaaagagggagagaagtaagaaacagatagagaggcaaagacagggaagagaggaggaacagagggagagggtgaagcagggagagagagagaatgagaatatctccaggaaggcatgagtccagctgccagccctgggggagtgtttaaagccacagatgtggtccagatgtctggcctcacccctggtgaacagggggcaccccagaatatgcacagccttcctggaggaggctgggggagggatgtgcttatcccaactagctccgccttacagaatgtgttcgggaatcagcttgaccagagggtcttaatctgtgctagcagggggtcctcaaatcccttaacattgtctccaaagttaaagagagcattatttttgtccggggacaaagttgaggtattcatcaaacattcaaaggagtccacgaccccaaagcaacaaggaaccactggaattgaccaaagccctctccacccaaagcctacccagccccagtcctcattttcagaaccctccacatgcagtaaatacatcctcttgggtcctcccataagcctcagtccccggcctgtatttgcacccatacaccaacccctcagaggaagcagacggggaaaggagctgggagcatgcattcattcattctctgaacaaatgttaattgggcatctcctatgtgccaggtgcagagcaagtgttagggatggacggtgaataaatcagattaagcaaatggcagaatactttaaaagcccagttgctggctccatttccttgagttgaaatcagagccctaccacttagtagctgtttgggcctgagctgggccccttccttctccagccccctgctgctcagaggggatcatgatagcagctactccatcgggtgaggttcatggtcagatgggttaattaatgtatgtcacagtgcctggcacaccttaagtactcccaaatgggacttcttgttattagtctagggaggcaaattggagttgcacaagcaaatcagtgtgataagcagtgtggaaaattgcagggggctaaggaaggacctagcggggtaatggagggtggaacagctagtggagggaaccgcatggtcaaaagcctggaggaaggatatatgtgggatgagtggcccccagacgggaaggtcttggctgggaagtagggatgaaagaaaaacttccaggcttaaccgtttcagaaggagatagagaggaaacgagctccaaggaggctgaaagcacaggatgtggggctatgagggcaggaggcagtttgggggtgtcatccctgaaggccagagtttctttacagacttttgcaggcgggaaccatgtctcaggctgcaaaggcctcggcctcggccacagtggcggtgaacccagggcctgacaccaaggggaagggggccccacctgcaggaacatcccctagtcccggcactaccctggccccaacaaccgtgcctattaccagcgccaaggcggcggaactgcctcctgggaactacagggtaaggacctgggggtgcagtggctgggtgccatgccttctttccttccttccctcctcctccttcttctcctcctcctcttcctctttcacctcttactcctccgcacctctttctcctcctttttcttggcttattttctctcctttctatttactctcccttttcttcttctccacctccccagactcttatcctctgtccctattctctttttccctcaccttggcctcctcctccctcctccttctgggacacaagtgtggcccagccaatctgggagcccataaaatagccaggggttctgacacacttggagaaagtggggccgggcgcagtggctcatgcctgtaatcccagcactttgggaggccgaggcaggtggatcacctgaggtcaggagttcgagaccagcctggccaacatggtgaaaccctgtctctactaaaaatacaaaaattagccaggcgtagtggtgggcgcctgtaatcccagctacttgggaggctgaggcaggagaatcacttgaacccaggaggcggaggttgcagtgagctgagatcatgccactgcactccagcctgggcaacagagggagactccatcaaaaaaaaaaagaaaagaatagaaagaaaaaggggacctatagttgagttgtgcaataacaacaaccaaaccataccgcttcacagctgaagggacacctggcaatcaggctacacctgcacacgcacatgcttagagtttatcgaaagcaagaaaaaaaaagaagaaaaggaagtgggctggcttagcagcagggaaccagctgtccttggaggctcactggggcagcaggatggcctcagaccctcaaaattgctcgaggtggtctgggctgaaaggcatcctgtggagcaaggtgtccagtcccctgggatttggtttggtgtggtttcaacctcaggtcacagaagtaggccattttgcaacccctagttcatgacacgctctcatgtggtcagtgcgtggcaggtttttatttatgtacctatttaatcattagttttatttaatttctaataatgcaatatgcacctacaaacccaccacccatataaaagccaggacttggttaaaaactttctacctaactctaaggtgtctcccttgagtccatcattttcctccccaactccaggaaatactgtcctatcctcaacctgtgtctgtaatctgcttgcttgcttttgtatacaattttatgcattattcctttaaaaatgtatacacacatacacatgtatatttatttacttgttttatttattcatttattttgagaccgaattatgagacgggttttgccatattatccaggctggtctcgaactcctagcctccgcctccccaagtgctggaattataggtgtgagccaccgcaactggccgatttacttgtttttaatttattgaaatatgcaatgtgattattctgggcttttctttgtacttttcacttactatgagatccctaatatccatccatattgttgcgcatgactgccggccattcattctggctgctgcctgatatttcagagcgtgaccatctctttcctgctaagcacgatttcagtggttgctagctttgctctcgtgaacagcatggcttggacgttcttatccctgtctcctggtatcggggaacctgccccgatattcacatagattcttttctatttttcctaagcgtcggccagcttgagaaataaagggacagagtacaaaagagaaaaattgtaaagctgggcgtccgggggagacatcacatgtcagtaggttccgtgatgccccacaagctgcaaaaaccagcaagtttttattagggagtttcaaaaggggagggagtgtgagaataggtgtgggtcacagacatcaagtactttacaaggtaatagaatatcacagggcaagtggaggcagggagagatcacaggatcacaggaccggggcaaaattaaaattgctaatgaagttttgggcaccattgtcattgataacatcttatcaggagacagggttttgagatcaaccggtctggccaaaatttattaggcaggaatttcctcttcctaataagcctgggagagctatgggagactggagtctatctcatctctgcagcgtcgaccataagagacgaccacgcccaggggggccagtttagagacctaaccccaggtgcgcattctctttctcagggatgttccatgctgagaaaaagaattcagcgatatttctcccatttgcttttgaaagaagagaaatatggctctgttctgcccggctcactggcggtcagagtttaaggttatctctcttattccctgaacaattgctgttatcctgttcttttttaaggtgcccacatttcatattgctcaaacacacatgctgtacaatttgtgcagttaatgcaattatcacacggtcctgaggcgacatacatcctcctcagctgacaggattaagagattaaagtaaagacaggcataggaaagcacaagggtattgattggggaagtgataagtgtccatgaaatctttacaatttatgtttacagattgcagtaaagacaggcataagaaattacaaaagtattaatttggggaactaataaatgtccatgaaatcttcacaatccacgttcttctgccatggcttcagccagttcctccgtttggggtccctgacttcccgcaacatcccggggcacacatacaggagtttctcttgggcaaccaaaggtagaagtggaagtgctgggtcatggttatatgaacctcccctcctcttacagctggggaaactgaggctcaaagaaggcagaaaattgtgccttggtccatgtgaatggcaacgttgtcccaacttggaacagcaagtggacaaggaaccaaacatgaggcttagtgaggagagaagattagctcaagttttcccctatgttgtggagggttggatttgcaagtgtctcctgagcatcagctctgtggcaggtactggggctggggctggagatacagaaattgatcaacctcaggccctgccctggaggagtccttggtctttggaggggctgggtaatgggagagagggagtgcagagagagagggagaccccaaagcaaaacagcagtgactgtgtggtgggttagttgtgctgctaatggggagaggacagtgggggatgctcaaccaaggccgatggaggaaggggcaatcagagaaggcttcctggagaaggtggcacctgagcctaaaacagaataacgagctggaatgcgtattagggaacttcagttaggcagtgggagctccaagctggatatgtgtggtggagaaggcattccaggcaggaggaatagcacaaagaaaggcctgaaagggaggttcataagttcctaatgatggcgcagatcttagcttcagaattagggcatgaggccaggtgcaatggctcatgcctgtaatcccaacactttgggaagccaaggcaggccaatcatttgagctcaggaattcgagaccagcctgagcaacatggcaaaatcctgtctctacaaaaaatagccaggcatggtggtgggtgcctgtaatctcaactactcggaggctgaggtgggaggatcgcttgagcctgggaggcggaggttgcagtgagccatgattgcgccactgaacttcagctggggcgacagagtgagactcagaaaaacaaacaaacaaacaaaaaacaaaaatcagtaaagaattgggggatgggaggacaggatcatttcacaaactgtggctcatcacacttttatgtgactcctgcactgctggcttttatttatgtagatacttaatgaatttttgactcccccctcactctgcccttggcatgggggcttctctcctgcagctggtggtcttcgaactggaaaacttccagggccgtcgagcagaattctcgggggagtgctcaaatctggcagaccgtggcttcgaccgtgtgcgcagcatcattgtctccgcgggaccgtgagtactgggcggcggaggggcacactctctgccacagtaaaatgaccacacaacagtagctgccatttctccagcatctgctctgtgcctgcggccgttcgtactcctggcacatacattatgtccaatcctcatatcaaactgaagagggaggaattgttctcaatctcattttacggatgaggaaactgaggctcggagaggtgatccaattagcataagatcacactggcagtaagccatggttctgggctctggagaaatgctgcttctactatagcaaaaactctagcccggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtctgcagtccggcctgggcgacagagcgagactccgtctcaaaaaaaaaaaaaaaacaaaaaaaaaaaaaacaaactctagcccattaccgagggctgagagaggtcaaagagtgaagtgtccactcgctgtcccctctcctgggcgtccagctgcctgggagtaatgataagcatctgtggcacacccaccaggtgccaggcactgactcgggaccacacctagatgattcacagtgctgtaggaggcagaggctattcttatgcccacttgacagatggaaagactgaggctcagagggggtgagtctcttacccaaggtcacctattggtaagtggcacagccaggattcaactcaggttgattgagttcattcctaaagctcttaatcaccatgcttcactgcctgttcctgtctctgtgggtgtctctgggccttagtgactcccatataaaacagggatagtcatccttgggcagagtggttgccctatgtccagcctgtgtgtgctgaggtcagggtggaggggcagccccaggacaagatccacgcagctcgtttgctcttgtctcccccactttgaaagcctgcaagggttccagtcatcctgtattctgagcccattccgagatgagctttgaggtcagacaagcctgggtttgagtcctgacttcccctgtttgccttgttcagtgtgcaagcctcagtttccccatctttgaaatggggagaaggatggccctcaccactcctcacaggattatgctgaggtctgagggagatcatacagcatgggcctgttaccttgtgggcacccaaacatggcaggtgactctgatggtcacgtacccacctccctgcccggtgaatttagccaacttatcctggaggctacccgggaccatttctacctcctgcaccctcagtgtggtcaacgcagcctcagctccaccctcagccccaaaacccagctggaagcagaagctaccggatgtggccagcatgggttttcaggctttttttggtaccagtgactcaaacccagagtatttctcctcaaacaaagatgcagctggtgtctgacgtgtgccttggagccgtgcctgatgggcatggaaacgggcctgtggtccgggggcctgggtctgtgtgggcgctggcagggccatgggaaaaaaagaatgaagagggtgaggtaggcatggggaaagtgaggaggcctgcctgcctgaaacccaggagactgcagcctgacacccaacaccatcatgtgaccttaggctggggacttaacccctcttagcctcagtttccatatcttataaattaaaattcctgccctaccctctctccctgcttgcgggttgaaatgagccatgggagataagaaaaggcatagatataaacatttaaaatttagatcctcactggtcctgctgaagaagataggggagattttagggggacttgggcatggtggcaagaccacatcagtgtctgtttttccagaagcctagacctccagtttccttctccctttaatcaggaacagtattaatttggaggcttactctgtgctgtatctgttccatgcattccctcttttaggccctcataatctcccaacaaggtagatgcaacaaagtagatgtatcatttcttctctgttactaaagcttagcaggtgtaagtgctgcccaaatgcatgcagcaaatggcaaagcttggattagaattcaggtctgtctgtttccagggtctgtcctcttaactcctacatgaaaccaccttccaaggctcccttcttattcacccatgcgtctatccacccatttattcatcatccatctacttacccatgcatctacccattcgtctattgatctatccatacatacatccattctccatttatacacacgtacccaccatgtgttctccatcacccacccatccatctataaatctatccatctacccacccatccatctacccatctagctatccatcaattcaaccatcccttcatccatccctttatccatgcatccattcatctgtccatctacccatccacctatccatctattcaaccatcctttcatccacccatccatccacccattcatctgtccatccatccatctattctcccatttatttctcttctactccagaccagacagggctgaggcaaatgcaactctattctgggaagacaaacatatctttaatttactccagtgtggttaactcatctctcagacaaagacctgaggctcctgtgatgcattctgtctcagcccatggtgatagcccatcatccttgtctccttctggggagagcagggtcccagcagccccctgggagaagatgctagtgtcagtgtcccctcatccgtctcttttttcctaagaactcttgaacacacggggagcaaaggtcaaggagttccttagtctcagctttctcatctacggaatggggattgtcttatctaccccacctgcactgccacaatccctggtccctgtaacacaagctcacttcttgtccttaatcaatcttcactgggaaagccaggaaaatcttccatctaatttcaaacttctaattagtccatgtaaggaacctagcatcttcataagcgctatcacattatattaccataggtatctgagggtagatattaccatcattcccttcccattgcctcatactagttactgagtatctcccgaataccaggccagtatttacccagcaaggatgcaaacacctgtatcaatttttcccttacccctgtacctccgagactgtcgttcatttaatatatttcatttaaaatgatcctgctaaccacaaataaacacattttaaaagaaccctgacaccactttttacaaatggaaggctagtattatttcctataagtaaaaggtatccatacaaaattaacaataaacacaaaagtggtattattatgttgctattacaccattgtctgctggaggttctgggctagtggtcttttctctctttgttacaaaagaaaaaaaggagagattagtaagtgttaaaggcacattaacatcaaacgagcctttctcctagctggcgtcaagtttcaaatgtctatgtgttccttggctccaagtcctgatagtacttgaagcatgtatgaaccttacatctagagaaacagtgtgctcagataatcacacacatttatctcacttaatccttcaccaactccaaggaaacaggcatatgagtgtagatgagaaacaaaggctcagagaggtaaagtcacttgcccatagtcacacagcctgtaagtgtcagagcctaaaatcaaacccagacatgttcagccccctttggactttcctactgtcctcagggctgccttgccaggggagagagaaaggcaagtagggagtgggggcttctactaaccatatgtctcctgtctgcctcatggtccttcttgtatccagctgggtcgcctttgagcagtccaacttccgcggggagatgttcatcctggagaagggcgagtaccctcgctggaacacatggtcgagcagctaccgcagtgatcggctcatgtccttccggcccatcaaaatggtgagtggctctccggctggggctggagaatcagccaggcggggcagggcaggtgtaagtctgagatctgacaagggcaagaaggagatgatggtgggtagggaggcgtggcagcctccgagttgtcaaaggaccgtggattcttgagctcatcaattcatcagtgtccttaacacactcactacatacccagctaggaaccctgggcaaatgataagcacaaaagcttccaagttagagctaaaaacttcagcatcttccttgattctcttgatatccctggctgcacatttagaccttactgggagctttttttttttttttttttcccaaagatggggttttgctgtgtcccccagcctggtgtacagtagtgtgatcatagctcactgcagccttgaactcctggcctcaagtgatcctcccgcctgggcctcctaaagtgctaggattacagccgtgagccaccatgccaggcctgggaaaacttttcaaatttcagtgcccattcgaaacaccaaacatgctggttgcagatcatgcaatggctaagaagagggatattgtagccgggcatggtggcccatgcctgtaatcccagcactttgggaggctgaggtgggtggttacccaaggtcaggagttcaagaccagcctgatcaacatgacgaaaccccgtctttactaaaaatacaaaaattagccgggcgtggtggcgcatgcctgtaatcccagctactagcaaggctgaggcaggagaattacttgaacccgggagccagaggttgcagtgagccgagatcatgccattgcactccagccggggtgacggtgccagactccatctcaaaaaaaaaaaaaaaaaaaaaggagagggatactgtagaaacgcagcttgaacctcttaataataagacaatatactgaattagtttcttataatatttaactaagtcaacttccagaagattcaaggtcaaaatggtggcgatatctccaagtgattcacagttttttccagaattaagttgatgatgagtcatgaaccagctacatcttactcaccaatgttagttgctgatggtaaccgacttttgtcttccatgatgggaacatttataagaattttcatgaatgtgcatttgaggctatcaagtgccaaccaccagctgttttgacatcaccaaatttatcttaatggattattcaaacagatcattcccaacacttttcgcagaatgtaagactgaattatttgccttcatgatgcactctctgtaagaattcacagatgtctctctcaatcattgaatggttcttatatgccaacctatgttaaggggtttgtttggaagagtgatcaaccagggcatttccagtagcttctagaagcttgctattcaacataataggcagtagccatatgtggccattggacacttgaattttggctaaatggagatgtgtcataagtgtaaaatacatattaggttttgaatacatagtaaaaaaaattttaaagaatgtcaacaatgcattgatatcattatattggttacatattgaaattataatattttaggtatatttgtttaaataaaatatgttattagaaatgtttagaaatctcaaagcctagaccccaccccagaccaattaattctgaatctctagggctggaactccggcactgctatcttttctatgccctctaagtagtccgtctgtgcagccagggctgagatccaaccatctaattcaggggtgcccaatattttggcttccctggcccacgctggaagaattgtcttgggctacacataaaatacactatcactaacgatagcggatgagctttaaaacaattgcaaaaaaaatctcataatgttttaagaaagttcacaaatttgtgttgggccacattcaaagccatcctgagccacatgtggcctgcaggccgcaggttaaataagcttggtctaacccttcctctctctgccctgccacagtcctggtccaggccaccatcatctctgacctggtcatcttcagctctctccctgctgggttccctgactcctttccagccccctgtcgtgggaagttagagggatcttttcaaaataaaaaaaaaaaataaacctgaccatcttctacttgaacccagacattttggttggcctgtttctattttcctttttttttttttttttttttgagacacatctaactctgttgcccaggctggagtgtagtggcacgttctggctcactgcaaccttcacctccctggggcaagcaattctcctgcctcagcctcccaagtagctgggattataggtgtgcaccgccacgcccagataatttttgtattttttatagagacagggtttcatcatgttggccaggatggtctcaaactcctgatctcaagtgatctacccgcctgggcctcccaaagtgctgggattacaggcatgagccagtgcgcccaaccagttggcctgtttctgccaggctctggttctaggctctgagtgcaaaactgtgcatcaaacagactaggtccctgtcttcatgggacttaagctacccagggaggcagctatcaaaaagctaatcataaaaatccatctacaattgcaaactgtggtaggtgttacacaaaggccatgcaatctaactaggaaagcagaagcaggaactgggggctcagatattgttagaggtgggagtggtcagggggtcatcagggaagccagctcccaaagtttggaaaccaactcagccacgtgaagagcagatggtaaagccttccagggaacagtgtgtgcaaaactcctagagcaacgatggactggtgggaccaagaaaattaaaggtggccaacaaagctgcagcagagggagtggaggaaagagggaggcaagatgggaggggaggtggtggtggagaccagggtcttgtagggtctcataggtggtggcaagttcagtcttgacccctctagcagtggggagccattgactaacaaccttcccaaggccctcaagaccgtaacagtaataagtaatcattgttgtacttttaccactggctggtaattgcactaagggcatttgtcttgccatgccccaaagggtcccctgtgcttacatccctgcctggcaccttgcacttgccttcctgcaccctggccacacagatattgtcttgcacattcccacctcccagcttttgcctatgccttctctgcctcagtgccttccctcaaccctccttcccttctcagctttgtgcactcctccttaacctccaaggtccctctctagtgtcacttcttccatgaagccttccctgatctgctctgcttttctctggaagaattaaccagttctttcttcatctataatctcctactggagtctttcacagaaggatgcacttacgttctgggctcctcttcctcctagtggtggtgaataacagtagataataacagtagataatcacagcatccatttttaagcaccaactacgtactgggtatattacctgccttttacataatccctacaactgtcctatgctacaggctatgataacatgcattttaaaagcaaggaaactgagactcagaagtagaaaatgactggcctaaggccacacagctgggagttgctggggctgggatttgaaccaaggtctgtgggtttgaacctagacactgaggtccggcatcactctgctatttcctgttcatctctttggctcttcaaacccttgggcctaaaacagtgcatgatgacttttgaaaagatggatgatccctgccctcagaaataacagacgaactttaaaaacaagatacagggtcatgaaagcattaaaaataagtgcaagccagaactgaatcatgtgcccacattcaagggtgggcctggttgtttgtttgtttgttttttgagacagagtcttgctctgtcacccaggctggagtgcagtgacacaatcttggctcactgcaacctctgcctcccaggttcaagtgattctcctgcctcagcctcctgagtagctgggactacaggtgcgtgccaccacgcccagctaattattattattattattattattttgtatttttagtagagatggggtttctccatgttagtcaggctggtctcgaactcctgaccttgtgatcccacccatcttggcctcctaaagtgctgggattacaggcgtgagccaccgcgcccggccaggcctgttttatagttggactgaaccgtgagttgagtagccatgacaatcccacgaagcaatagtaaccccattcttttttgttgttgttgtttgagacagtcttgctctgtcgcccaggctggagtgcagtggtgtgatctcgcctcactgcaacctccacctcccaggttcaagtgactctcctgcctcagcctcccgagtagctgggattacaggcacatgtgattgcacctggctaatttttgcatttttagtagagatggggtttcaccatgttggccaggctggtcttggactcctgacctcaggtgatctacctgtctcggcctcccaaagtgctgggattacagatgtgagccaccatgcctggcaataaccccattctacagatgaacaaactgaggctctgaaggaggcagagtaaaatgtccaagatcaccagtgcataaatgtcagaggcaggatttgttttttgtttttttttttttttttttgagacggagtctcgctctgttgcccaggttggtgtgcaagtggcacgatctcggctcactgcaagctctgcctcctgggttcacgccattctcctgcctcagcctcccaagtagctgggactacaggctcccaccaccacgcccggctaattttttttgtatttttagtagagacggggtttcatcgtgttagccaggatggtcttgatctcctgaccacatgatctgcccgcctcggcctcccaaagtgctgggattataggagtgagccatcgcacccggcctagaggcaggatttgaacctagatctgtgttccaccaatgttccacgtttcacctggtttgtaagaagcatttacaaaagggcaattggttaaactcctgatggcacagggacactgcttaggaatgaagtgtttctctgaaaggttctgcccctccctggctgtgtgatgttgatcaataagcttgacctctctgagcctttttgtccctgatcataattttaaaaataataaatactttttttttttttgagacagggtcttgctctgtcacccaggctggagtgcagtggtgtaatcatatctcgctgcagcctcaacttcctgggctcaagcaatcctcctgcctcagccttccaagtagctgagactacaggcatgcaccaccatgcctggcaaattaaaaaaaaaattatttttttgagagacaggatcttgctatgttgcccaggctggtcttgaacccttggcctcaagcagtcctcccacctgggcctctcaaagtgctggaattacagacatgagccatggcacccggccaataaatgcatttattgagcacttgatgtatgccaggcatcgtgctcagtgctctatatggatacactcatttcatcctcacgaggaccctatgacgtgggagttgtcatcccattttccttatgtctccttccagactagacagcagtggtccctggagagtcccccagcagcctgaacaggctcatctctctcgctccacacccagaaggccccgctaagtttcttctctttgtcccatttgtacttcacacacctgacccggcctctctttccccaggatgcccaggagcacaaaatctccctgtttgaaggggccaacttcaagggcaacaccatagagatccagggggacgacgcacccagtctctgggtctacggcttcagtgaccgcgtgggcagcgtgaaggtctccagtggaacgtaagcatccctcctgccaggtccgcgtcccctgcttcaagcacaggcagaatcagaggctgctccccttacaggttataacatcagattcctagagaaggccatggccccttccacagtctcccagtgctggttcctgggatcagccaacagagctctattcctctggggaatagagtcacactttgaggaattccaggtcagtgtaaacaaatcagctctaaaaagctgttagatggagaaaataggagctgctaagcctagttggggttgaaggagtaatcaactaaaagggccggcgctgatgtggatagatgaggctggatgcatccaggagcagggaatattcagggaaatcagaagcttctgggagaatgaacagaatgagttctgagcagtgaatttgcatcataagatggccctgaccctgctactgacatgctgaggaactcgagtgagcctaaacacctctctgcctctcagtcttgccagctaggcaatgggcacacaaaattccctgatccaagagtgcccttcctgctctgaacgctcaggatctgaagctatcaaaacggagccccatgaccttatgtcatgagaatacatggaagggccagatcaaaggagtcactttatccatccccctgcctccaaatgaccatgccagacacccttgatctcctctaggtaaacgtaaggctctgtctctccattcccagacttgttctgagctcctgtaacaccatcatggctatggcctttttcttgttcctttctgcctccctgaaacctatatccctgccattcaagccatctgaaatatacggagccttgtctgtgagccaggcactgtgctaggtacactggggaaagcagcgatgaatacagccaagttcctaccttcaaggaacttacttggcctagcagggaaacccagatatacctgtgagatggtgtccaacaatactaggtaaagaatgggccagccagggcaactgtgttgtaggaggtcagaggaggagaggtttctaggatttggctgtgtatgttagggcagagggcaggtcaaaggtttatctgcagaggatggaacttaaaccaggctttacaatatagggagggggtctggcagaagcctggaaagaccctctcagcaaagacaatgagagaagttagaaattaatcactgatgataacttctattgagtgcttactatgtaccaaggactgtgctaaccactttaaatgaataactattaaatcttcataacaaaccaaggaggtgggtgcattatcatccccactgtacagacagtacattgaggttctgataccttatccacctagattctcacagctagtaaatcaatggcagagctaggatttgaacccacatatatttgataccagagtatgtgttcccagctgctacgcactgatgcacttacctacaaagaaaaccaatttttttttttttgagatggagtctcgctctgtccctcaggctggagtacagtggtgcaatctcagctcactgcaagctccgcctcctgggttcacgccgttctcctgcttcagtctcccgagtagctgggactacaggtgcccaccaccacaccctgctaatttttttgtatttttagtagagacggggtttcactgcattaaccaggatggtctcgatctcctgaccttgtgatttgcccgcctcagcctccctaagtgctgggattacaggcttgagccaccgcgcccagccaagaaaaccaattttttgaaataacacttcctctctttcatttgcttcattgttaaccagtccctaagtcctattcttgcttccttggatttgttctctgagccctgcatcatcacgtttaatgggatgtgtattcatattcctaccatgcacaggcaacatgcttagcaaacacttgaggtgcattctccatttggtcccccccagcactcttaataaaaccaggcaccgtgaccatgctcacttcctagaaaaggaaaccgaggcctatcagagaggcaaagtccttgccccagggcacagagcaggaagggatatagccaggacagaagtgagagagcagccgactgcagggatcaatgaaggacaggctggtctggcaggggtctgggtgccaggcaacgagacaggctgtctccactctgtccttctcacttttctctcagatgggttggctatcagtatcctggctaccgcgggtaccagtacctcctagagcctggtgacttccggcactggaatgagtggggagccttccagccacagatgcagtccctgcgtcgcctgcgtgacaagcagtggcacctcgaggggtccttccctgtcctggccacagagccccccaagtgagtccacacctcactctgctaccttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactgaaaagtt

SEQ ID NO: 65 - DNA, 21680 bp, Homo sapiens
aagtgggggcctagaccctggaaggcaggggactgcgagctgggctggcggagcagaggtgcagaagcaactgagtccaagtgagtatggtggcagggaggccagggcaaggggagcagggcaccggggcagtggcacccagacgtgagcagggtcaggtgctctgggtgagggagcatcgctgtgcaccgctactgatttaggatgcaggagtgtgtggcttggggctgctttggggatgggctcggaccatcgctggggcagcgatggggctctgggaagaaaccacagagagaaaaaacaaagggccccccctcagcaccccttgtgggtgaagattttgcaggagaggtttccttggggttcccgagtgcggggcagatggggtggaggaggtctgcatctggccgaagaatggaaggatgtccaggtgatcagacacctgcaggctgcaatctgggaggtggatgggggcagtgggctgttagtgactgcattctagcacctgggcacatagcaggtgtgtgtgtgtgtgtgtgtgcgtgtgcgtgcacacacatggctgcccatgcaccttcctctgtaagcctcagtcgacttttcttcattaatccccactaaggacactttttatttttcgttacttttttttttttaagagacgggactctcactatattgcccaggctggtctcaaacttctgggcacaagagattctcccaacttggccttccaaagtgctgggtttacaggcgtgagccactgcgcccggccccaactacagaaactttttagatgcatttgtcctcatcccatccttcccttggcattttaatccaacagatctgctgtacatatgtttatggactgtggccacacacactgtaatagctgaggttgatttggcccccatcccgagaacttgttttccccgctgttaagagtgcatggtctacctgcttgtttcatgtctgcccgggcacgtgctcatcctcatctgcatctctctcctgtaccttcctgtcacaggtgcaagggcagcgtcggccaggtgtccatcggcgcgtgtctgagtggacgcgtctatagccatcctcagtgtgtgtgtgcagttccttgcatctttgttagcctggcatgcatgctgggctgtgtgtgtgtgtgtgtgtgtgtgctgaatgccagggctgtgtctgtccaggtgtgtgtggacagcagcagaggcattgcatgcacgccttgggaactatgtgagtgccagcccatccctgtgggcacaggggtccctgtgcctgtctgtgtgttcagggtcctgtctgggtgtctgtatgagtctccgctgcgtgtgcctgccccttctggctggggctacatctgtcacatttcatccccgcgattggatgtgtctgtgcatgtgtctctgtccgtgggaagagggcggtgaaggctgggaaaagcaattgcttggaaaccctggctgcaaccccaaggcaacccatggagcagcagggtgccaggggctcgctagcccccaccctgggccttcctggccctgctcaaaggccagccaggagtgcctgacccctttcttactccccacttaccctgaaagccccccgcaggctaaaacaccctctccccgagggaacaggactcttttgtaccggggaccagcttctggtgagggtgcggacaccaggggccgtctgtggggtgggagagggcggcaggaattcacgcggcatgtcgggaatgctgatactgtgaaacccagtcattgatggctctgggtccctgcccgccacccccaggccccggccgtgggacatctgctccctcactccactcgccacacccctcagtctcacccccgtaccccgatgcggtcgttcccccttccctccccacagttctctgacaccccagcttggagggagttgttgccagagagtggcttcgaggctgtgtgggagggtcccaggcacaatgggagggccacatgggcagcctgacaacaggtcacaacccatgcaggagatactgaagcgggggtgggttgggtgcctcaatcccgcccccttgcacctgagtgactcttgttgcatgcaggttgtctggcggcttcaggtggacccagaagacgtccccaactcagggagattcaggtgaggggcagggtaccaactctcttcccttgcttcagctttgcaatgctggccctgccttggctctctggttcttactttctggagatctccaggggcatcacggtgacaaagataatgatcagcacatcatcactgcatagagacaggacatgcagcaaagactgcagaccaactgtgtggccttgggcgagtcacttaacctctctggacctcagctataaaatgaggataatgcatcttcctcaaagagatccaatgagttaagacagcagaataagcagtgagggctggcacatggccaatgccatagaagggtttataattataagtaatagcagcaggctgggtgaggtggctcatgcctgtaatcccaacactttgggaggctgaggcaggaggatcgcttgagccaaggagttcaagaccagtctgggcaacacagaacatggcaagactcccatctctaaaaaaaataataataataaccaaataaataaactaaaataaaattagccaggcatggtggtgtgtacctgaggtcccagttactctgaaggatcgcttaagcctggcagattgaagctgcagttgagtgagccacgattgcaccactgcattccaggctgggtgacagggctgagaccccatctcaaaaagtaaaaagttaaaaaatatcagcagaccaggcatggtgatttacacctgtaatcctttgggaagccaaggcaggaatattgctggaggccaggagttgaagaccagcctgggcaacatagtaagaccccacctccacaaccatttccacaaaaaagaagaaaaattaactgggtgtggggtggcgcataccagaagctgagacaagaggataacacgagctcaggattttgaggctatagtgagctgttattgtgtcactgcattccagcccgggcaatgaaacaagaccctgtctcagaaaaataagtaaataaatgcataaataaataataatagcagcagcagctaacatatgaatgggccccttcctgaagcccagatggaacaccccctttcacttcccccagcctttaaccctctcctctccctttccagcgatcactcactcgctgtacagaatgatattcctcacggcactgcctctgttctggattatgatttcaggtaacggctgacaggtgctggggacctaaaggctttggcccctgagcaggttggaggtgggtccccgcagccccccggcatgtggttggggatgggagccggagggggtgatcgggtaggacgtgtccctgagcctcagctctcctgcttgcccgcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcagtgagtccccagcggttgtgcaggcaccgggagctggggcagcggggcgggaaggagtgtggccggaaggcctccccgcaccttccccagcaggcctggatggcagatctgggaggtgctgatttggctgggggtgcaaacctcaaggcccacgcagaccatgcagatgacagacatgaacaaagcagggccccaaaatagtcttgctgccctcagggggaaacaggtgctgctactcttttggaaacacctggagaaaggcagtggggccagggggtaggggcaaggctgctgggcccccactttagcgtggtgatcttgggcaagtgacttaacttccttgggccttggttttcttttccgtaaaatggggataagaacagcacttaaggcaatgagtgaaaagccatcagatgcccagagcagcacctggcacgtggcccccagctctggccaacagaaagcagggcggtggctgtcaggtgttctgaattttcaagataaaccagaattttggattctttggtgtaatctcctaattcttaaattttggttgctgattcagatttctttttttaaaatcctttaagccaaatagaatacagctatggccagacatggcaatcagaatagggcacactgcctgatttcagggatccccctgcctcatttctgagtggcgctgctgcttggagtcctcagcgctgagtccctatgagagagccgggttcaccctggtgcagaaagagactgcacaggtgcagtacacacacacaccactctacagaaatcacacactacacactgcacactctacctacacactacccacacaccacacactacacatacatcacacactacacaaaccacacaccacacactgctcctgctacctacacactgcccacacaccaaacatacacatcacaccaaacacaccacacacacacactacacaaaccacacaccacacactgcatacactacacacacacacactgcttggcgctgaggactccaagcagcagcgccactcagaaatgaggcagggggatccctgaaatcaggcagtgtgccctattctgattgccatgtctggccatagctgtattctatttggcttaaaggattttaaaaccacacaccacacacacaccacaccaaacacacaccacacacacacaccacattacaaaaactcaccacacactacacacacaccacacacaccacaccaagcacacaccacacacatcacacactacacaaaccacacaccacacacttcatacactacacacactacccacacaccacacacacaccacaccaaacacacacaccacacacacaccacactacaaaaaccacacaccacacactgcatacgctacacacacactacacacacaccacacaaacaccacaccaaacacacaccacacatccaccacgctacaaaaactacacaccacacactgcacatgccacacacacactacccacacaccacaccaaacacacaccacacacaccacacacaccacacactacataaaccacacatcacacactgcacatactacccacgtaccacacacacaccacacacctcataaactacacaccacacactgcacacactacccacacaccacacacactacacacactacacacaccacacacatacaccacacactgcacatgctacccacacaccaaacacacactacacactacacactgcacaaaccacacacacactacaccctatatacactgtacacatacatgcgccacccccacatcacaacacaaaccacacaccccacacacaacaaacatgcacaacacacgctacacaaaccacacaccacacacacaacacaccaaacacacaccacacacacataccacactacaaaaaccacacatcacacactgcacatgctacacacacacaccacaccaaacacacaccacacactacacaaaccacacaccacacactgcacatactacccacgcaccacacacacaccacacaccacataaactacacacacagtgcacacactacccacatgccacacactacacacaccacacactacacacaccacatacatacaccacacactgcacatgctacccacacatcaaacacacactacacactgcacaaaccacgcacacactacaccctatacacactacacatacatgcactacccacacatcacaacacaaaccacacactccacacacaacaaacatgcacaacacacactacaaaaaccacacactgcacacacaccacacagtacccaaaccacacgccacacaccacacactctacctacacactacccacacaccaaatacacaccacacaccaaacacacaccacacaaaccagacaccatgcacacaccacacacacaaaccacacactatacccaccacacactgcacacacacaccacatactacagaaaccacacaacacacactgcagacactacctctacaccaaacacacaccatgcgctacacacaaattacatgctacacaaaccacacacactacaccctacacaccctgcacacatacatgcactacccacacaccacacacataccacacactacacacagcacacacacaccacacatgatacaaaccacacaccgcatacacaccacatactacactcacaccacacaaaccacaccacacacacaccacacaccacacacaccacgtactacgcaaaccacataccacacacgacccaaactacacaacaccccacacacactgcacacatacatgtactacccacacatcacacacacaccacacatgacacagaccacacaccacatacaccacgctctacacccacaccacacaaaccacacatcacacacacaacacacactgcacacataccatacacaaaaaccacacactacacacatacatcacaaacacaccacatactacacaaaccacacacatcacactacacacatgcaccacacacccacaccacacacacacacacacacatacctacacacacacacactcacatgcccggcggagggtaaaccaagcaggcatgggagaggagagccgcttgggaagtgatgaggtgtggggagcccacgctgacgccagagccacagggtttgtagccagtgttacctggtgccagctgcagcctcagtttcttcatctgcaaaatgagcaaaattacagtcctcaccctctcgctttgcgggagggactggcaagttaaacgccgtcaagtgctctggccacgacactgtgattttcattacgatggcgctctggtggctccgtggagggctccggggtgaccaagaggaggaagggtaaagggaattctgaatctggaggcagggagcggaggcgataccgttgaggagtaccattgccagcaatggaggtggacaaggaggagggtgggtggggtgggaccgggaccgtagcccagtgctgctttctcagccctccctttccccgcctcgtatagacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtgtgagcctgggtgcgggcggggcggggtggggcggggtggggcggggtccggggagggggtggacctggggatgcggccggaggcggggccgggccgtgatgggggcggggccatgcccagggccaggcagggattggggggttgggtgggacgggggcggaaccaggcagtcctggggcggggccaaggctgagggcggggccggacagtgttgggggcggggccgggctgggagagggcactgggccggttccccagcacctgctcactaacctcgctgtgtcgcgggccttagaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtgtgagtggcccactctgtgcgtccacacgcccacctgcagccgagagataaagggaaaggggcctcatccagggcgagcatgggctgggtcccgaggggaccggccataaacagtcgaggccaaggtagacaggggggttgcaagtcaaggtgtaccttcattctttccacaagaatctggggaacacctgctctgcctcatcctccttccaggacaagacccaggcctgcctcctagggaagcctgttaactgcagcttcctgggggcagttcctggttgttctgggacttgatgtgggtctggtcccaggaatctgcgttttactttataaaatttttttggagacaaggccttgctctgttgcccagtctggaatgcagtggcaccatgatagcaccacttgccctcaaactcctgggctcaagcaagcctactaccccagcctcctgagcagctgggcctacaggtgtgcaccaccacactccaggctaattttcagattttttttgtaaaggtgggattttgctatgttgcccaggctggtatcaaactcttgggctcaagcaagcctcccacctcagcctgctgcgctgctgggcccacaggcaggtgccaccacacccagccaatttttctatttttttatagagacagagaatcgatatgttccctgggctagtcttaaacttctgggctcaagtgatcctcccgcctcagcctcccaaagtgctgggattagaggcatgagccaccgtgcctgtccaggaatctgcatttttaaatgaattccattgtagttctaatgagagggttgaggggacttcaggcctcatccagccccttgtatgcacatttatattactgggccagcaagaagggagctggtcagaagaggattcttagctgagaaccaaagagataccattcattcattcacaaatgtgtactgaggcaaagtgcccagcactggggatattaataatgacagccgcagccaacatttactccacagctcttgagtgctttttttttttttttttttttgagacagagtctggctctgtcgccaggctggaaggcaatggagcaatcttggctcactgcaacctcccacttccctgttcaagcaattctcctgcctcagcctcccgagtagctagaattataggcgcacaccaccacacctggctaatttttgtatttgtagtagagacagggtttcaccatgttggccagaatagtctcaaattcctgacctcgtgatctgcccacctcggcctcccaaagtgctgggattacaggcgtgagccaccacactcagcctaatttttgtatttttagtagagacagggtttcaccatgttggtcaggctgctctcgatctcctgacctcaggtgacctgcctacctcagcctcccaaagtgctgggattacaggtgtgagccaccacgctcggactcctgcatgcttttgacatgcaatcttccccccggcattccccacggctggctctgcccacctcctaggctcgctgaagccttcccccatcatcctatcccaaactgtaactaccctgattttccataccctcagcccctttatttttctctacacacttcttcccatcttacaaattacatattttatttaattacatcggctgtttccacatgggccttgttcaagctagagcaatgcctgtcactcagcaggttctcagtgaatgttggatgatcacccctatgaggttggaactattatgaagcccattttccagatgagaaaaatgaggcccagagaggttaagatgtgggtccacacacaactggacaggggtagagtagggatctgaagacaagcatgctggctaccaagctgctgttcttggaaatgagatagccaggactggggtcacctgagccttcctgaaccggtgtgctaggtttggggtgggatctggggtcatatctggggatggtagttggctggcagaagaagcacctcctgggttctgaccatcagtcccgtcctaccccgcagatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagtgtgagtaccttccgctcccctatgctggggatggacggttccgtgggggacaccagggttactgtgggtgcccacgcatcccaatcagtattggctttgcctgtcctccgcagagacaaggaagggagggcagggaagctgaattcacagcaggaaaataaaatcccatctgagaatattgtgttcccacatccgggagtgggcttttttttttttttttttttttgagacagagtattgagtcttgctctgtcacctaggctggagtgcagtggcaggatctcggctcactgcaattgctgcctcctgggttcaagcaattctcctgccccagcctcctgagtagctgggattacaggcgctcgccaccacacctggcaaatttttgtatttttagtagagacggggtttcgccatgttggcctggcttgtctcaaacccctgacttcagatgatctgcctgcctcagtctcccaaagtcctaggattacaggcgtgagccaccacgcgcagcctggggtgggcttttgaccagtgaaatttctggatcctgtggccactgcccctctgcactaaccgaaacaatgaccatgatctctaacctgtgtagagtgtcgctatgtaccaggcactgttggaagcgctgtacagcaacccactcatttaatcctcatgacatcttcatgagggaggttctattactgtttccctgtttacggagaaggaaactgagacccagagaggttatgccacttgcctaagttcccacagccaggaaatggcagaatttgaggtttgaatccaggcagtctggttccattcttcttccctgcccaaggctgacctcatcctatgttatgacagcagaatacattgatggggtaattgctatacacaaaaggctgtgcggctctgtgagaggtggaggatagggctgagaagacaccacgcttatgaacaggtacagaatagctggagagatgacacagatgcacataaaaagctactgtcttggaaatgaaactcaccattgcaccgctggccagcgcctctcatctcctcactatggactgtgccaccatctcccaccacccctacccccacagccatcactccaggttgtagcagccaagtcacagttttgactccccttccttaagcaattccctctggaatatcgccttcctgtttccatttcccctgcttcctcccaagttcctgttggcttctagcactcctccccaaatttcacctctctggtcttcacgatgcccacaatggcccccaccacacaagtttgccagaaggttcgatgacattcaacatgcaaagaattcaaagcagtgtctgctacacagtacatgctctgtgctgtgtacatggcgacaatcagtacatggcagatacaggttagtcctcgggggcaacctctcgtggcaaagccgtccctctcctgctgacctataatcttcaggcactttccctcctggttctgttccctagcggggctgatgtgatcctggcgcggggctgcgtggtcccctgctccctccaactgtgcgtgctatcctgggccagcttccccctctggttgtcccctgatccctgttacaccccacaccagtgattcttcagtttaagagtcagagagaggagccgatgggagtacttgaacaagcctgcagcaccaactcacatacattttccggtggggtgcagatctctcctttatagtaagagcagcaggcagcaaatgcgcgttaggggcctgccctgggccagaccttgaatcctctacagctgttttctggttcagttcttatttttattattattattattttttttttgagactgagtctcgctctgtcacccaggccagagtgcagtggcacgatcttggctcactgcaacctctgcctcccagattcaagcgattctcctgcctcagcctcccaactagctgggattacaggcatgcgtcaccatgcccagctaattttttatttttagtagagacggggtttctccatgttgcccaggctgttctccaactcctagtctcaagtgatccacccgcctcggcctcccaaagtgctgggattacaggtgtgagccaccatgcccagcctatctggctcattttcaattctagggtcaccctgtgaaacaggggtgtgttataattatcccctttaccaaggagaaaactcaagggcggaattccctgaggccaggcagctataaaagtgggtccgagcccgataattccagactcctgtctgccccagctgttaaacctctggctgcctcacctccctcacagctcttagcactctaggactcaatccggcttctcttgaaaacgaacacgcaggcagatgtggagtgtgcaggcctcacctgctagacttgaggggagcagtggccctgtcccctgccccacctgccagctccctactcttcacccaggcctgtgtcaaagtgcttgcccttggagagtgcgaccctcaggccccctccctctccacacagtcaatgttccctggcaccaggtctccaatgttcactgacagtggtggtgacccttgagcagggccttctgtcttacctgccaaccccagagccctgaacggcacggggcatgcaggaagtgtgcaaccttaccgagtgcctgagatgtctagggaactagcttgagtacgttgtacgcattgacctattttgttcttacaaccatgtgattgaggggagggtaccattcttcaacccagtttaatacaaggaaacagaagtttgactggcatccagtcccaacagggctgaacagacctgggctagaatcccagctctgtccccatcctcctgcctgagctcaggcgagtgacttcagctttgcaacccttagcaagggttcataacagtatcttaccacaaagatggctgtgagaactaagagaattaggctgggcgtggtggcccacacctgtagtcccagcactttgggaggctgagacagttggatcacttgaggccaggagttcgagaccagcctgaccaacctgacaaaaccccatctctactaaaaatacaaaaattagccaggcgtgatggcgcacacctgcagttccagctactcaggaggctgaggcaggagaatcgcttgagcccggggggtggaggttgcagtgagctgagatggagccagtgcactccagcctggatgacagagcaagactgtcccagccccccactccagcctggatgacagagcaagactgtcccacccccccactccagcctggatgacagagcaagactgtcccatccccccactccagcctggatgacagagcaagactgtcccacccccctactccagcctggatgacagagcaagactgtcccatccccccactccagcctggatgacagagcaagactgtcccacccccacactccagcctggatgacagagcaagactgtcccacccccccactcccccacaaaaaagaagaactaagagaacaatactgagtgttcatagtgctacatactctgtggatattggatgtcatcatctttctcactgatttttcctttggactccaggttaaatatttgttgtgtgttttgctgctgaggttttgctcatgtgacctctctgcgggaatggttctgtctatccacccatgagtacttgggtgggatgttacgtatttttaattttaattttttatttttttgagacagggtcttgctctgttgcccaggctggaatgcagtggtttgatcatcgctcactgcagcctcaacctcctgggctcaactgattctcacacttcagcctcctgagtagctgggactacaggcacacatcaccatgcccagttaatgttttaattttttgtagagatggggtcttgctctgttgcccaggctggtctcaaactcctgggctcaagtgatcctcctgccttggcctcccaaagtgctggaatgacaggtgtgagccactgcacccggctgggatgttaagtgtttacaacacacttgcgcgcctatcttcggagtcccgtagccccttgtgagttactgactgtaaccccctggtttgcacagatgagaactccatcctagaggcccaggagcctgagtggcctcacccagccagtagatggcagagctgggattcaagccaaatccatcccaccacaaactcctcattctttgtacctttgtcttacaggtttgtctagagtcccataacagtttccgcagcttcacaggttgtctgaaaagatactaagcacgtgcaccggcagggtgtcggcgttccgccgacatccaggtcgaacactttgtcaccagagcaccagtggggctgtcttgagtggaagtgctttgaaaaagttttatgtctgtcggttcaggttcgctgttattaatgtactccgtggcgtgttagctggttaacgctatagcaagcatattgcagctctgcccgaacaggactttttattcagtagacttagagatgtttgcacagaggttcccattcctgccgtgaatccgtgtgcccgtgtgactcccaggtccaccaccgttaccggcacattctttttgctagcaattgaaaataggtggggtaggtgagccaagggtctcttgcctgtgtgtaagtgggttttggtgagaactcactgagaaccagtgctcagtctagagcaagccaaggagggtgctggactctcaggccaagaaagagaacacagtttaaaaagcagcattctgtgctgtaatacaattgcgtattttggtacaaaaattagccaggcatggtggcacgcacgtgtagtcccagctactcaagaggctgaggcaggacaatcacttgaacctgggaggcagaggttgcagtgagcagagatcgtgccactgcactccagcctgggcgacagagagactccgtctcaaaaatcatagtaataacaataataataataataatttcctgttttggaaaatgaaagaaaaaacctaccagtactatttttgtaatccagtggcagcaaagcaaagctcaaccaagtgactttgggtggagggtggtgtttggtgctagtggcaggagggaatctcatgggtgaggaagggccggggttcaaggcggctttaggggaggaagtggggggcatctgcagcgcagactgaaaggaaggagcacagcctggaagccagaaaggaggggatagtctaagcctgtgtgagccccaagggtctggggaggccgggggctgggagagttccatggttcctcccttctacgtgtggggcccagagtggagaaggagcaagcccctgtcttgatggaaacaggaggccccttatgtaagtgtgtgatgcagggagggtgagtgctggggaggagaactgagtgaggcagggagtgaatgatacgtggagcgaggtgcagcttccctgggtggtcagagaaggagacgccgcatgggtagaggccagtttggagcgagggagggcgttccacaggcaactgatggaagtgttccaagttgagggagaaacgtacagaccctggagtgggagaaagctccacgattttcagacacagcaaggaaccggtgtggctggaaaggactaagccagggggagagaaggagagagtgtgtggtcaggcagggcctgaggggccttgtagatgaaagactttgtattttgggctgggcacagtggcttgcgccttataatcccagcactttgggaggccaaggcaggaggattgcttgagctcaggagttcaagaccagcatggggaacatagcaagaccctgtctctacaaaaacaaacaaaaaccctccagtaactatcatgagtatgacagatttaccgtcctctgcaattctgaacataaagctttaaaatcaaaaggctttttgcaaatttggcaccaccctgatttgacagcaaaatctcgcctaaagaacacaaggctgtttgtaatctatactgatttcatttagggtgaatattcgtactttttgctgtatacattacattgaactatgtgaaattttttctgcatgtcaaaaatggtcaaatgtggctgggcgcagtggcttatgcctgtaatcccagcactttgggaggctgaggcgggaggatcactagaggccaagagtgcaaatgagctatagtactgccactgcacttcagcctgggcgacagggccagaccctgtctctaaacgataaaaaataaaggatttgtattttaggtgaaccacggagcaacagaaggagggttttgagcagagagtgccatgatctgatttatgtattacaaggtgaatgaggttagagagagtgtaagagccagggcccaggagaaacggcccgtccctgtgacatagtgctctgtccaggctgaagctgaggctagagtcgcctcaaaagtggcaccagaagaattgccccaagagagcaccccaaaccaccccgaaatgaggccacttgggattccaaagagagaggcactaaaccaccaggtgatcatcagtccaaagcatttgggaggggaacttgcacagtgctacggcgagagaaagggagggtctacccagacacgtccgtgagggtcagggtatgggtttacatgagggtttaaggaatttggcccagggctggggctggtttctttcattctttcatttttgttgttgttgttgtttggggtttttttgagacagcgtctcattctgtaacctctcgtactcctgacctcaagtgatccactcactcttcggcctcgcaaagtgctaggattacagcagtgagccaccatgcccggcctctttcagtgttttgagcaacaacctaaacacctttatcagtgcctgggaatgttcaaggccccaggcgtgggttagtgaagcttgcagtgaaaacaggcagccggcggggtcgtagtgaggtcaaggcgctctcagtcaggacagagaaaaaaggaggggaaattggagggccctacaggaagctaccgcccccatccttggccacactggccttgccttgagccaaggagtctccggggccgggcctcgcgttggctccgggccaccctcagacctgattttgcccctgcagtcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccgtgagtggcgtggacttggggtgggagccacaggagggagcgggcacgtcttagatccaagctcccaaggctgaccaacagccacagagcatgggctatgcagattgacagaaaggtcaaattctccctttccggttggagaggagaagccgccctgagtttgccccgagtttgctaggacctttgaggcatgagcccctccccagggccctctagcatgaaagggattgccctggcacgaggaggctccgtgccaatcagtcagtgcaaggatgccccggctgtgtgactacattgactgtcatcccagcatgtctccaaagttctcaggtgtcgtcaccaccacccatagccctaagggcgcctgggtcttttctgtcctcagatcgactgatgtgggccaagatcgggcctgtgggcgccgtggtcgcctttgccatcctgattgccatcgtctgctacattacccagacacgcaggaagtgagtgccagctggggctgatctggggatgggagtctccaaaaaggggacctggtgggagatggaggcccagagtgggtgggggaaggcagcaccataagtgtagagaaggcagattctgttctgggaatgttcagctggacagaggagagagggttcctgttaattccagcccctgctggtcaggggcacaccagggcctgggctgagccctttacacacatcatttgagacctgtttgcccacattctattttgacagcctccctatctctaggaactctcccctacacactccagtgtggtggggaaagcccaggtaccccactgcagccacagcagcaggtccacttgacgccagaagccccaaagattacacacatctggggcaaaaaaaaaataggccttggccgggcgcgttgactcacgcctgttatcccgcactttaggaggccaaggaggaaggattgcttgaggccaggaatctgacaccagcctgggcaacatagcaagaccacatctctaaaaaaaatttttttttaattagccaggcatggtggcacacactgtagtcccagctacttgggaggctgaggtggaacgattcttgagctcaggaattagaggccagcctgggcaacatagggagaccccatctacaaaaaaacaaaaaaattagctactagtggcacgtgcctgttgtcccagctactcgggaggctgaggagggaagatcgcttgagcctgggaggttgaggctgtagtgagctatgatttcaccactgtactccagcctaggtgacaaagagagaccctgtctctaaaaacaaacaaacagacagacagacagacagaaagcctctccagccccaaaccatacccacctggcccaactcagctgcagccgtgtttctttcttgtggcacacacacatcagctgtcctgagaaataaattaacccctctgctccacatcctggtggcaagaggggcagaaagacccagagcctatgaggggaacctggagaatccaggtgggggtcctgaaaaacggcagagctcaggggccaggtggctcgtccccagccgggcaggggccacagaggtgggaaggatgggctgtgtgggtaggagaggctggtggttctgaaagggctgcttgccacatcttagagatgggtgggagaactctgaggtcccctgagccaaactcctaaaacacgtgggggtgcagaaagggagggcagagagaggtctgacgagtcctgccctgcagaaagaacgtgacagagagccccagcttctcggcaggggacaaccctcccgtcctgttcagcagcgacttccgcatctctggggcaccagagaagtacgaggtaaggaccaggctccaggctggcctgggaacctggatgccagggacactgaaggcctgggaaaggcctgtgaggccaaggggcaggggagtgggagcggcctctcacaggaggagaggaaggacattccagggctgggttggacctggaggctggggaggaggtgcccaggccgaagctgtgtagggggcgatgggacgtggggcctaagggccccctcccctccctgcctgtgtctgtgactgcatttccttctccaatagtccaaagaggtttctaccctggaatctcactgagtgccccaggaggtaggttccgggggcctcagtgtgccctcctctgggccctccttgggccctggggttggcgtgcatgtccgtgtgtccctgtcaggcgtcaaggtggtctctggtgatgtccgggcctgcccggcagtgctggccttgtctagtctgtcctgttgcagctcccttctgtctgtggccaccgtcctgtgtgtccaaattcctgtggctagggggtggagggaggggtgggaagcgtggggggaacccacatgtcacctgcaggacctcccagattgagggcggacccatgcaggacccatgggggggcacgtaccaaaccaggtatttccaggaatttggaaagatggggtcctgactaggtggttttcacccaaaaaggtattaggggttacattgtgtgccctcaaaactcctatgttgaaagcttcctggacgggggcagtggctcacacctgtaatcccacaactttgggaatctgaggcggatggatcacttgaggtcaggagtttgagaccagcctggccaacatggtgaaaccctgtctctactaaaaatacaaaaaattagccaggcgtgttggcaggtgcctgtaatcccagctacttgggaggctgaggcaggagaattgctggaacccaggaagtggaggctgcagtgagcaaagatcgagccattgcaatccagcctgggtctcaaagaaaaagaagaagaagaagcagcttcctggagaaactgaatttgtaggcaaatttcaagttcagcaatgattaacactggcagaagctccagagtgggacctggtgaccgcagggctcgctgggcctgcggtccttgagaaaggaggttctcgcagggatttatttgggactgaactcaggagctctgagggtgcaaacgctctgtcctctgcattgggaaaaggcagggagcaggaccctgctaatgggcggtttcccctcttagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 66 - DNA, 529487 bp, Homo sapiens
ttcaattcccctgcatccacactgcaaccgggtgcaagtctttcctaggttatagacagcccgcctccccacgagaccttctgcggactggctgcccctggcctcggcctgggtgggtgggtggtgctcgcgccgcccctactttcccctggggccctggagagccgcgcgctgggtgtgtgtgtgtgtgcgcgcgcgggtttggtggggaaatctccttcagtggaagctgctgagtgtcgttggcggaaagtatcctggagcccagcaaaagcctccaaagcactagagcttccctaaagaaaagcagaataaaagaaagacaagaagggaagcccgttcctctaaagcccgggtttccaatagtcccggatcctcctggagttgggcgaaggcgcagttggcagcagccgctgctggcacccggacttggaaaggcggtgttcccccttttcgggaggagggaggcagggacttgcaggcaagagttgcacctggtctaggaacctgcagagaaaagaactctggggtaagtagtgttctggcactggcacggaaaggggtaaagggtggggggcatgagagggacgaaatggagagggcagggaatgaattatgcaaaaaaatctccaatatttcgcagcggagggagagcacagcacagcactcccaggatgagtcctgcctgggtctcccgcgccgaacccgcagcacgaagttctttttaagaagagaaactcgaaaatcctggagggtaacagaggcagccagggcggggcggagtgcggaggcggctgccagggactggggccgaggcggcggccaaggtggcctgaagctgtgacacccagcctcctcctcctcctcctcatggccgcgctcagcctcacctccccgcccgggcctcctgcctccgcccccgggtgccgggctgcggagctgacgctgggacgcccggcggcggcgaggacgctcacctggccaagcctccttctcctcctccccctcccgcccccacctgtcctcctcctctctgagttgggaagcgtagggatccgtaggcgaggaaataacgacccctgcagttgtattgcggaaaatctcgacagcggcgctagttgcgggcgatggaagccaggcaactgggggttctggggagttcaggaaaatagcagaggagcaggaagggcgcgcgcgacctggagagtctgtgtgcccccaccgcgccccagtccccggggcccagcccttcccctcggcgccctggacgcactgccggaacccggctgagaggctgcaggctgcgcgcggacctggggagcagggagggtcggcggaggctgccggcggctggcggtttcgggcaataatccctgcctctctttctctgtgtgtctgctgtgtctgctccttccccgccccccggaagcaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcaggtacgggacgcgccgaagtcactggctgatttggattatgttgtgatgtctggggtgtatggggttttattgtatatagccgcggggcagagagaggggtggcgagaccctttgagttctgcgggtttgccgccttcagaatcaaaaatcttctcagcccaagggtgtgtgaatgtgtgtgttttgcgggggggggtggttaggatctgtgtgcagtcctagaagggtgaaggaaaaagtggtgggggatgagaaagaagaggcagatgggtgttgattttcaactgctttcctggctgagaactctggcgccgaaatccgagccttggcaacaaccacccccatcccctggctttcaaagttcccagactcggtggttcctggctggcaaaatggacgcggggccctgcccgggtatctaaccactttcaagagactgcgggaggatgcgggactggagagtaccagcagggatcagagatatgtcctccatgccttacccaaacacatcaggactgattgtgatgctttgaaacctgctgacacaccctcctctacccccccaattttcttgttaaagcactacagtgtcacaaataccactttctttacatcacggtgttttttaattcccagtagcaaggatgtgctggctcagacctctcagtctacttgggcctgtctgtgcttttaagagcaaacgggatttcagggtgttgaggtgaaagaggttgggcttgtggacacctgtgcctgagtgtgttaggacgagttctggtttttgagcactgtctttgttgatgcagggaattggggttgggaggaagctgggagggaaaggggaaagcccctggaccagcagtattccccagttcagtggctcctcccattgaaggcacccaccccatttcccttcacacctgccacttaagcacccaaggaaaagcccatttgtagtgctcccttctgcctgcattcttctgcagaagtggggactcggccaacttcccatgaagtcatcagaagaggagagcaggatattgcccctttgagcagccacatttaagcagcactggggtggagagacatgtttcctgcctcttccttcagccctgtcaatcccctccctttaagccagacctgattctggataggagaaaacaaccctagttctgccctcaccctggactctgttccaaatcccagtctggcttccaattttctcctcatagggaaggaatgggactcttatccgaaatcattctgtgtggggcttggctaccctattaagaaatttgtctctgtgatacatcagtgagatgtgttgtgtacctggcagacaagaaaatgtgccctggggtcaccccaactcctctagtgggacttctattattccattctgcatctaggagtgaaaattctcaagtgacttgtaaaggtttatatcagtcatatgtccagatatgaagtgggtggcatctcacaaggccatattttacatctttctcttctacatgtctatttcaaactctctctcttgttccagaatatttgactagttataaaatagcctttccttacttctccccagtgtcattaataattttcaaatcagacaagccatctgagtacctttaagatttataaagggttaacattgattaaggctctggatttcctccagcatcctctctgtccccagcccttaccctgaatttcgccaggcaatcaccgaggggaacaggctgagaaagggtctgatcttagcctccaaaaaaagcattagtgggatacctgtcacagctatatttgatttggtgtatcagcaactaaattattcaaatggaagcattaggagggggatttccaactcaggaggagtgctatggagtacatggcctttcatatgtatttactaaataatcattattgctatgtaatgagaggataaaagtgtaagcaaaattgctagctattagctaaacacagaaaactaggttagcgttccaaatgcctagttaggatctgcattaatttgcactttatgaagacatttaggcagggatgcaacatcatatactctttattttacacatccataaactttaaaaggccatttcttctccatggtcagggtggcctcatcctcctgtaagcagagccactcattcagtaatgcccatgtatgtgagaattattattagtaatatgattatgactcacaattgctacagtttgggagactcagactccattctttttccatctggcagccttaggatgtataggaaatgcaatgcactaaggttgaatatttgtggctttgagagagtttagtggatctttcatttctgtctccatgatttgcagttttaatttactcatgactgagctctattgaaaggaacataaccctgtgatcatagaatctactaaatcttaaattaaaaatattaaaaacaaagcacctctttagcatcttggaatgaattttcctgaccactaagtgggtgctaatccttacagagttaccagacattgatacttgaagcattgatagagttggcttcattattgagaaacaccaggctggaaaaggctagtaaaagtctgtagtctaaacactttacagaaggaaaatgttggtagtagctttgtcatgtggaagatatattgactgaatttcatttggtggcatttgctttcaggaaaacattggcgctttgtagcttagtgttttgttaaccaaaggttccaacacttcctctaacccacccccaaatttctccttgggcctatttggatatattgcttaaagtacagacacctgggcttggcatatttggtggttctgcactaataatttggttttgatgaaactgttggaaaatgagactgtttggccaggcttagctagatgctgggtcagtagcatgtatgtcttttatttgtgagatcacatcagctttggctacttaatgcaacatagctaggctaaagggcatgatttgggagttcctctggctttccgttaaactcagatctcacttttctgaaaatgtaaggcatccagggtctgtgaagagatcagagacagaaagagagagggagagagagagaaccagaatgatttttccgtgtactgcaagagcaccattcccttcctaccaaagcagctcagatcagcaagaatgtatgcttagcagcacgaggagagaaatttcttggtcaaacgagagctgcctgatttaatttttacaatgcatcctacttcctccttatgtaactttacttctttgtcagtttattcataataataacatcaataaccatttgaattatgtggtattttcacacattgtacatatattgcacatatttaattcatctattcttagaatttgtgggataatcttatagatatagcaaccaaagcccacagagcttcagactagaggtttcacatccaggtctacctgagtcaaaattcagtatatcatttatgttttggttcaagattcctttcaaatatttttatttaatattttttattttgatgtctctgaaagaataaattaggttaaatgaattgaagtcttagagaatttggaagtaaaagttttagatgattacaatttagagctagaattaaggtagcatttgagttgtacattaccctgtcaatcaaacagatgaggctattacccaaatgcctctagcatcttaggatcagcaatctctacaagcaaggaatatttcctacactgttttcctaatcttaacattaaaatggcataacttcagtttccttatgtgtagaaaagagataacagtacacgtgtcacatgtttgttctatcaactaaatgagatattatgtccaatgattttcacacagcacagtttctaccacatagtaagcatgcaataatgtcattatttcctacaaatctgacattgtataggcttggttcatggtggagtagagcttttacctttttccatatcaacttgtttaaaagcaaaaagaaaaccatcatcagcaagcacatctataacattgagcacaaaccctattttccaggaagccttggctaaataattttgaaaagtctcttaattttccttctcatacaaatgagactggtagcattaagctttggtgcatagtcataactgtaacccactttatccctatgagtccaatatggagttgaggcttggaaagtttactaaactacctggaaaccatgtagtacttattacccaggggatcagcgaatttttctttcagttgtatattacaatgcagtatagacccaactttaaagtgcctcaacactggcaaacgacatatgctttcaatatggcttgaaatagaatgtcccatcaaataaaaagccccacccttacaatgactatttatctgatgatctcattagcaatgtggtttctttaaatccagtttcccatgtgatgtcatatagcccagttactgacagataaccatcatcatagataaaactctccagatagtgagtcaagaaagtcttttggagttgtatgaaatcccaagggaaaaaataaatgttgatgtgaatacccagtcccttggctggggagaggggtttgattactagcctaagtcagtaactaatgtctcagtttatcaccttaattaagcattacatacttgggactaaggtcaaaaagagatctaggtatcataaatgtgtatgatagcaagccattatagaaagagtatggaaatcagaagacctatccttcaacgtgactctaccttcattacctttataaatttgggcagttttctttacctctcagaatctcaatcctcatctgtaaaataaaaattatatttgctttgcctatttcaaagcattgctgagggaaacttcagagagtgattcttgaataaatattttttgcattatgcaagtgtaaagcatctgtgtcattactatatatgatccatacttaagatatagttatagaagcaaagttgagatacatacacatagtttagaatgatataaagtaatatgagtaatgtttatttgttaagatattattataaatgcaaagttgtaatgctaaaatgcattgtgatataaaggaataggaataatgtctaattgtttaataattggcataaattgtatagaagggagaagtttagacatgaaagaaaaggagtatattagattgattttggaggtttggatgaaagagacagaggggacctcatcatcaaaaaggaggaatagaaacaagaggatgtacgctaaagaatgtcccaactgaaacaaaaaattcactttgggagatactggaaagttgggatgagcccacttagggagctattgaattgagagaatatgaagtgtcctaatatggttattcactttgtgactttcgtttttgtattaaggatctttgcaacggttcaatggattctttgttaaaatttgtttgaaattctaacatttctttggattttaaatttctgttgcatgtctacaactagcactgtactttatatagtttgtagcctgtttgagattgtagacagttgagttggaattttttcgtagggggtgaactggagggggctggaggtagggtctcagcttgctcatctgtaaaacagagatgataattacctctcaaggttgttgtttctacaaggtaattataaggataaaaaaacaccatttgtaaaatggctaatgtggtatctggaatacagtagccattggccaatgcatacacatcatatgagagtaagcctgggttttggagcccagataggcagacgtgtgaattctaactttgggattcactctctgtttggtcttggataagtaatttaagttctgtgtgccttaactcctcatctgtaaaatgtgaggtatagaaaatgtacataagaatctgccatactgcctgacatgtattaatcattcagtaaattgaagttgctcccataaaattatcatcatcatcatcactgacatcaataacaatacttgttgacactttggatcagtttttgtaaatgccaattaattatttaatcatttattctatgttcaacaaagacgtatcgacagcaaactctatgccaggcactggaatcacagaaatgaacaatatttggtccttagtatttaacaagagagtacatgttgtaaaatagaaatgtgtataaagtatactggaagtataaaggaagagcaattaactctgtcgtttgtagatacaagtggagaagggaaaatgtttatagaaaacatttgacctagacctagaagaacacatgagatttcaaaagaacagggagaaagaagacatatcatgtggcaagaatagtatgttcatagacaagaagatatttaaaaaacaaaatatcaaagtatggtggattgggcatatggagtggataggttagactaaacgactggatataggggttacaaaaataaccttaggccagtgtgaaggggattgtaaaccacaataagattagaccttaccttttatttatgaggagctagctaatggggagctaaggaaaatgacgtaatcaggtttgtgtgcaacttaatatttttactttgattgtaataagaaattacttagaaacccaactccttgtcttctttttctgtcaacatttattcttgatcacaaaacacattaaaaaaaatcctgacctaatagatcaatttgcccattatgggacattctaagtgatacacttttttaaaaattcattttttataaatctctcgtgaccctcatttatcctgatctttgagatttggtattttcaggttaagcaaatacaaatatcttcaattttgtacttgaataataataacaatgtctttagcattagatgaaggctaagagaaatgaatcatctgtacatgcattggtgtcatgaagattaattatgggttaagcaatagatacactatttgacataaaacagatgctcaaagtactacaaagcattgtgtagcagttttatcttactacattctgttcaactcttatttccaatagagtacacattcacttaacagaatatacccatggttaactaaatgatatatccattttacccactctatggttcagttactataaaatgagtgtagagacctaaatgaaatggttttcattgtccacttaatcattcaacatttattgaggatacattatacatcaggtactcagaatccaaccagaataagtaagacagtgaccttttcctccaaaaattcttcatctagtaaaagactgatttttaaaatattggtagtcacagcagaatgtgataggcattgtaataaaaaggtatagaaagtgtttgaggagaagagagaagggacatctgactcatcctgaaagtaggaggggtagagaaggagagtaagtagcgttaatagaggatgcttagggtgagtctccaaggatgttaaagagttgtcgtggaagattttggctacttaaccaagagggttgtgatgagagatggatgatcatatgaaacagcatttgcaaaggaagggagattagatgagacataggacatgattaattcaggagacggtcaaaaagtgaacatagtcacaactaaagagtgtagtgtgatggatgaggttgagatggaagagtatttaaggtatataatttcaataacagtaatcccttgcatataataatgtcagtaaaaatcacccattttccctctgtgcatgaaaggcatcttttaaaggcccaaggaagtatgcagtttgcatccttcattaggaagagaccagtcagtattaaagctttggctcttgttcagctatgctctacttggcccagaccactgatcattttccactgttgtccctggttccagatggcttcccagaagctttggaataacccagatatagattacagagtttatatcatcttgttacttagtttattgtcacatatttacaccctaggaaaaaaaagccaggaccctgttgaccatggattttacggtatatctattatcatcttactcattgattagtgaaggttttctgtaacttttttgcagtttttatttcatgtaaccttaaacagacctttaaaggatttccagcagtcaggggttggggtgggaaggtttgggtggtgacaaatgatctaggatcacttttataacaaagccacaattgctgtttattagcaagattgggctggtaacgggatagccagtgtggggtttgattacatttgcattactgggccatcaggatggcagtggagagattatcaaaggttatgaaggacacagcatacaaatgcctttgcctactgatctgggagaagtggtaattttgtcacagtaaatgaagaattaatctttaactttgtccaatacttcatgcctggtggctgaaggggctggcagtaggaaatgaggcctgtgactttcaggtgagttttccagagccaagtcttgctggctttgcaacacatttggcagcaatgccagagttggaataaacagatttactgaaggatgtgagtcaacatattctctttccgctcccctctctctcactacacacacagctaccttttagcctcaaggaaaacaattctgatagctgcaattattgagggagcataggcctgtcctccaacacaaggttagaataataataaatacctcagaggattcttgaaataaacaataaagtaatatatatggaagatttttttcccagtgttaaatgtatttgttaatttattgcacaaatgctaacaaatgcctcctatgaggtgggcactgggccaggcataagataaaatgtagtaaaaaaaacagcaatggtctttgccctataaaatgtgtgtagtgacacacaaatgtgtgagtgttttttttcccattacccaacccagtgcctggcatttagaaaatgctcaataatgaatgactgaattaatacataaatgaataataaggagcgatggagagtggcttttctgcattcagggcagactgagggacaagatctgaggccatgagggaggggagatgaagaagacacctctaccagctgttgtcttgcttctactgcatgtaggtttttgagtgtgcagagtcacagagaatgggaaccttcccaatgagcaatatgtttgatagttttctagtcctgctctgactcatatttccatttgacaaatcatccttatttggggcacttatagttgtttaaaatgtatttcggcccttttgtatttatgacaccataccaaaggcttgaactaggacaattaaagatcagtggatacattgtcattcttttctccatgtcatctctgttcctacttgaggagattgtttggaacatgtacgctatttcttaccaagttcctacttgggagaaaacaacactttagaaagctcactgttcccttgttagtgtgttgaactagagtgctttagggagaatagcctaccccactttttagtcttgatgcagagcaatacaggaaattactgtggtctctatggtgttttcagtcttgtgtcagaaaacattacttcccctctggccttttgtaacagaattgtggtgtagctgactagttcttaccagagaagagctggcagcctaggaattgaaagaacagagtggatttgctgtccttggctgtgaattcaccctgtaatcacctggttaatctttacaactgtgaggagatggtcaattggataatttgttgttgtttgcttgtaatcttaattacagaaaaaaataaaaaggggttatagaaaaaaaaggggccctattgttaatttctcagtggatgtttggggattttaaagtgagacatcggtgagtatcaagtttctattgtatgacctgggtgtgatagaaatatgtcacttgatgtctaagtcttgtaatgcaccataatgatactggctcttaagttacagtgactcaaacccctgtagagtggaatataaagtagtgaagtcattatgttttatttctgtaacaagtttcattcctgtttttctactgtggtgaagttccttgtggccttttagtttgttttagcactgagttttattggttgaatgagagccacatgcaattttaagtgtataagttagtgcaggctttttttttttttttaaatctgcttttagaactgcttaaattagagcttgactaagccaggtaaaggcatataatgtgccacatccaaagacaagttgaacaacttcatgaatgagagttgtgtttatgccttggttgtttaggccaattacgtatccaactcagatgttctttcttgatcagtgctccttgcaagacagggactgtatatgcaaagtgttttagtgtcacagacatgagtgaagcctggaatcagagtgtattttatgccaaatatgataaaatattatgaaaaaaattaggaaaaaaattattccccatagaccaaatttttgtttactaaattttgaaactgtaacttttccaatttgtactgtaaaaagaaactttatatcttaaatatttctccatgttgcttcctagttgtgtcagttcagcatatcctggaccctgacacatacaccccacaatctcagtgacataacacaatggaggcttacttctttgcattaattgtccaatagatgtcaatgtatgtgtgtgggcatgtaggtgcttggtgagaggaaagagataaaagaaaaaaaattctgtatttagtggtgacttgggagtcacaaggttgatgggggctgtgctacctcctatggtttccaaagttttcctgggcatcaacatcaccagatggggaaaaaaagtgtagaggaagaccatgggaggggtttttgtgggccaagaagaaaagctgtgggcatcctttctggtcagtcacattgccacatcttatttttatttttatttttttatatttatttatttatttatttatttattttgagacggagtctcgctctgtcggtgggatctcggctcactgcaagctccgcctcctgggttcacgccattctcctgcctcagcctcccgagtagctgggactacaggcgcccgccaccacggccggctgattttttgtatttttagtagaggcggggtttcactgtgttagccaggatggtctctatctcctgacctcatgatccgcccgcctcagcctcccaaagtgctgggattacaggcgtgagccaccgcgcccggcctatttttatttttttaccatggtgtttcaccacattggtcaggctggtctaaaactcccaacctcaagtgatcctcctgccttggcctcccaaagtggtgggattacaggcgtgaaccaaagtgcccagccagccacatcttattttttttttattatcatactttaagttctagggtacatgtgcacaacatgcaggtttgttacatatgtatacatgtgccatgttggtgtgttgcacctgttaacatcttattttaaagcagttagagagttgtaggctagccttgtagccaggagcaaagggaaaatggtttgcgaacaattagctagtatctgctacttcaatatgcattatttttttcttatatttccatagtagtttattcatgtaaaatagcattatttatatttaactttcccttgtttttaagcatatatgttgtttctagtttatgacattttttggcatttgtttttatccaagtagatatttatcgaattttttttaaaaataatctcaatattgtgattattgggtcaaacagtatgaagttccttaccattttactgtattatatctgaaagtaatgtataacctgtttatgaggctctagtaatgtgcttgaattccttgagagagtaagcaagtatgtagaatagtgactaatctttcaaacatcctttcagcaatggtttacctcaaaatctattaaacaaacctaaatagctatgggattcaagatgttattttgcataacaagttagatcagagacaggaaactgtggttaagataaacaaataccttttctaggtctagaattttaagccttcttaagtattgttcttggagcacatttttatacattatagggaagatagaattaggtgatttgctcaagagattactaggatggaagttaggacatgttgtgtttagtgttagttttgccactactacttctgtggcatggaggaattaattttactattctggggccagttttctccttttaaacagtttaagcatattggactaagtagtttctagatccctttccaacttaggaactttagtatattaagagacttttacagaaagttgtccaaatttgctgttcatgctaaacttccccagtttttgaaatgttgaggcaacaagatgaaaatataggaagatctttcacgactgtgagtgaacaaaaagtggaaaatgactttctatatgggcaatcatatgataaggcattatgagaaaaataacccaaataacatttgtggaatgattaccttgtcaccctctagtgcaacgctgggaaagagtctaggggtcgtcattgactgctacagatgtattgaagagcattcatcgaaaacattatacgttataccttatcttactatttaacctcaactctgatgtttcttattgtgtgactttaggaagttatttaatatctctaactaagtgtcagtatcctcatttgtaaattggaggcaataacacctatttttggagttaagcgggcttgaaataaaaaaaatggagcctggtgtttggcatatagaatgcacttgataaatggtggcttttgctttcgatatggctgaagctaaaagaataaaagacacgttgagcaaaattaggaaggaatttggcaatatcatgtaaaacatggggattaaatgagccaatgcatgtgaaagtgttcagcacaatgtctgcacatagcacataatcagttaaggttggttgaatctgattcactaggggaaactagaatgtttggggaatattttaaaggtaataagaagggagataatcatgtcttttcatagcatcatcttcagagacagtttactgggtcttgcccatatgttcctttaataattttttaaaaattaagaaattaatgccccatatttttagtttacaactgcactttaaatttatcaaaacctctaatgtaggcatatggtctcatataatccaataaatattcggccttgacagtagtggcataaatagaaccctggctcaggaatttgcttattattttttcccacttaatacattagtaaattctagatcatttgccagagcaataaagaagtgaggtattattatggcctaatccatttatgataaaagatacactatttaccctgcaatttttgaaactgtcactcatttttactgaaatttggctactctattcccttttcattgttcagacttacctgcttccccaagcactaatttgtgtttgtggtaaccttacccatgtttttttcaacctattctcaacatgaaaacatagctttgatttgtttcatattcacttgagagaaggatttctttaaatgataattaaatgctgagctattcctgagattgcagtatggttccttttcaaatatatctgatctgagcatttcagcaaaaggcataaaagggaaaccaacaagaaataggacagatgataaatactgtattgatgttaagtaaagacaagcaaactgtgacctgagtatgtctgtctctagggagcctgctttagagcttttcccagtgtttggtttttttgtgggatttttttcctccaagctcgttggtagaggctggattacaactgagaatgcagagattaatggcctgctgtgactaatccactaaacccctactcctgtttctcttaaattgattgtacttagagaagctgagtgtagacccaccccagccagcctgattttaggtcccagtgatttaatgagatccagtagctttaagtacatggaaccttcatggaacatcatcactttttgcatttgggcattatttcattagttgctgattagttcccactggattattttataacctctctttttttaaaaagaacatttttcacatgattatattttaaaaatttaacactaacataatccaatttaaaataattgggaaaaaagagaaaaaacagatcacttataatcacataaccataatacaactattattaatattctggtttgtttctttctaagcttttacttatataagcattttttacttatttaaaattatatcacattattgtgtgtggccaaaaattcatgtcagataaatatatggtttgtgttcattaaagcaacatcctcctaaaatatagcccaaataatgtgaaaataattatatacatagatggatagatatgtcattgatggaaatcaagatttaatactaaagcagtgcactgggattgtattaaatttgaacaaaatttaaatttacaaatattttattattaatctggtgatcttaaaaaataattcataggaagataaaaggatgacaaatgtaattatagtattggagatctttgaggagagggaacactggagaaacaatttagaaatgatgttaaaagtattttatttaactattaaaatgcagaaatatgtttaaatccactgagatgccatatagcttgagttgagaatgattaagagctgcatttaaacccacactctgcctcttacaagctggttggctttgggtaagttaacttcttatggatctcagttttctaatctgtaaaatggagataaaaataaccccatcagctcctgaggcctgaggaggttgtgaggaatatgagcggtgctgtctctctcaatgtgccctttagatgattccccctcctagggctgcctgcaggggttgtaggcttgggaaagattgtgtaggtgacagtgaatcagaatgaaatggtagattttgtgtagatgcatttgtctgctgtaattttatatatatattaaacttaccataactgtacagttcatttctgttgtaaaacatcattaaaccattttccaagtattttcaaaaaaaataaccccatcagtgattttttataagcattattaaatgacatatgaaagtaaagcatttagtacagtattatcaggcacataataatggcttaataaatgtgatctggtattagcatcaaattcataacatgtgagatgcagccaaccatagtctctttgtaaaggaggaagactatttgagttagctgctttgtaggggatatggtactacaagctcagaaaccttcagtacctgtcactgactcttaaaaatgaagagttcacactgttgaaagtgatgttttaaagtcttccatgatgtgccatagactgacctttccaactttgctccaatttccaactcaggattctgtgaaggcaccttgcagacacttacctgtgcttttgctcatgctgtggtttttaccttattttgacccacctgaatcctacatggcttactcataggttctcacatgttcaaccagaggcttctttgtgaacactgttatgagcagtccagccagcagcagtatctccccataatgccccatcggctcttcttgtccccggtgctgcccatccactggctgcctttctactttcatcaggaaaattcaccatggccaggattcatctagggtatccccatcctactcctaatgcaacatgctcattggttgggttttactctccaatccgtaatgataggtttttccacattctcaccagtagtctctgctgatttaggtttttttctcttccctaaaccaccaagtcccttctagatataacacaactcagaccagagctcagcaaacaacagcctgtggactaaatccagcccacaacctgtttgtttacaacttagaaaacaaagttgtactgggacacagtcatgctcattcattgatgtattgtctagggcttcttttacatcacagcagcagcattgagtagttgcaacagagaccatactgcctgcaaagcctaaaacatgtattctctgcctctttacaaaaaaacatttctgagaaacagttgaatcaaatgcttccaacaggtaggaggataaactgggtacctgaataatgattttttcttcagtaagggattgattgaattttacatgtaatagtcaatttttaaaagctcggaagcttcaagaacctcagaactgtcttgacttttgtggataccttggccattttactaccccaaagtaatgcttcaagcaccttctactgtcagaaaccaaaaacaagaaacctcagtttgtgctggtttgcatttataaagctccctttgctctcagaggagcttagagtagctctggtcccatccaggtaaacattatgggggaaagtcaccctcccctaaggcatggtttgtgctgggatggcagttcggcagggaaggagcaagctttctgagtactcttcttctgccagctctttgaaaacataacccttctctttggggaatgaaggtcagaccatattcagaaataagaacatcacctggagaacaagcaattttaggaatgacaacctgagaaatcaaactttccccctgatgattgagacaggccagactcataacccaggccatgatcagcttctgcacttggtagagcattttctctcaaataacaagctgaatgagctttaccaggctctgagagatgattgttgtcctctctgcacagatggcaaaattgaagtcaagaagcagcggcttaggctggccacagagagagtgggttctggcaaagaccctacagggctcacaggagctggactcccagtcctcttagacatggtatttgcactaagtccctaaagcagatttcataacgctgcgtaacaaagcctctttggaactctagagcaggggctgacaaacagtggcccactgaccaaatccagcctactgccttgtctttgtaaggcccaggggctaagaatggttgttacattttcagatagttggggaaaaaaatcaaaagaggaaataatatatttcatgacacatgaaaattatatgaaaacaaattttggttcatgaattgtgtttgattgaaaacaaccacactcattcatttatgtactgtctagtatctattttcgatggctacatttacaccgtaggggcaaagttgagtagctgcaacagagcctaaggccggcaaagctcaaattactttctatctgtcccttcccagaaaaatgtttgctaacccttgctctagaagcataatacattaattaatataaacttttattgaagtacattaaacataaaatgcactcattttaattatatggtttgatgagtttggggtaaaaaagacagtcctataaccaccaccgcaactaagatgtggaacatttttatcactccccaaatttctgtatgtttctttgtagtcagtccctctccaatccttgtgcaggcaaccacagatctgatctctgttagtggtaacaacttttaaacaattatttagaaaggatttcagatcactagagaccgtgttgagagaaggtggtggtgggggtgtttgaaaacatgaagttgattttattctttcgtttgataattccttaattcactccaaacacccactccaaacagccacttaactgttcataatattagaacctaacaggcactgtgcaaagtgctgtccatttattatctcattttatctctaaccctatgagggacttcttatccatctctgattctattgagaggagacaggcacccaggtaacactgaggagcacacagctgttaagatgtaagctaagatttgaatgtggacctgtctgaatccagagtctgagctcagccaccatatcacatacttattcaatcttcactacaagtctgtttgggagtatattatcaacattttgtagaaaaaggaagctcagagaggttaagtaactagttcaagtcacccagctactaactgctagagttaggatttgaaccaagctctccaaactgcaagcaaaagacaccgaacagagagggatggaaatgcattatttcgaaaaaaaaaaaaaaatcaccttgtcttacagatggataaagtaagagccatatgtgagcaagttctagataatgcagaggcgaatgaggcagtaggcaaaaagcagttttaagccagatataattttgctttctaaactaatggatatccaagactatttaatttaatgtaaacaactaaaggccataaagtgctttgaaaatcactgaggggtgcatccatgctgaccagaatcagtaatcaaaatctctcttgctgttccttcacaaacagaattctatctgaattggtctgtcatattgagaagagatgaagatcaaagtctcagaacagacctccataggatattctctttctctcctccccctacaccgggtattataaagaacagcgcaatttaccaactcctagtttgaatgattgcattccatttcttcagggccttttttactaagtacttggcacctaaatggtgccccaaatgattgtctgctgttccaattttctaggagcactccgtcagcctccctgcaagcgcttcttacaacctagcacaggaggctgtgtccactgggttccttagttataaataatgaaaccttcaggactactataagcagaaaaaattttttattaaagcacttgaggtgctcacagagtctgagggtaggccaaaaaatagtaattggaaattgtacttacaagggtatattatggcattgctctaaaaaaagactcctgccactgctgtgtagaaacagccagatctcatcactggtgtggactgagctctatacaccattggtatccagaaagctggacactgctgctaccaacctcaccagaagatggatttgatatcaaacctgcttgctcatgctgttcactttagaaccataatctcaggcatctgaatgactaagttcagtcacatgcctgcatcctgtccaaagtaaagtacaggtttctacctgggtgggactggatacaaaaggcaggaaatactccaaatatagtgagttggctgaagaatagcctcccaaagatgtttgtgtcctaattctaatgccaggaacctatgaatatgtttattttacatggtaaaagggatttagcattcatgattaaagatcttgagattgggagattatcctagattatctgggtgggccaaatgtaatcacaaaagtcattataaaagaggggcagaatgatcagagtcagaaaaagaagatgtgagaacagaagctgaggttggattgatgtgctttgaagaggaaggaagggagttaccagaaatgcaaaagatccccagtagctggaaaagacaaggaaattaattcttccctggagcctcaagaaagaacacatgcctgctgacaccttgattttagccccttaagattcatttcagatttctgagctccagaactgtaagataatacatttgtgttgttttaagctactaaatgtgtagtaatttgttacagcagcaatgggaaactgatgcacataggataggtattcagaatgtgatgacagtccagggagcatgacaaatgtccaccacagctgtggtgaaggaaagctagaaaaattattaatatttcccgcatccagtgctctctactttttgatagcattctaatagattcctaaagctaggttgggtaaacaagctaagtaaaattgcttgtgattgttcagattgttcacccactttattcaccccgtgatttattcaacaaatgttccatttattaaataaatatttactggagctgagtgccaagcactgtgaaagatattatagcttctggagctgagtgccaagcactgtgaaagatattatagcttcaaaggagaataagagagtaagactcaaagctgacagtcaagaagttcatagataccaggcttatatttaactgattttcagttgtctcttcatatcaaatcctacccaaatttatattgtttgttttgaacaatgggagttaggatgtcaagatgatttcacaacaatttatgcataaaagcattatgctgaaatgaatattttcacttgaatatctaacagtagtcaatatttattgagtgattcctgtgtgttacagataatagtaatattttatattatttatttcatttaattgtcacatcaaccctggagaaatggatagttgttctccccattctgcagatgaggaagctgaggcttaggaaatatgaccaaattcatactgctaggtaagagagctgggatttgaatttcctgttatttgacttttgggtccatacacttttgccaccctacctccctgtgtgccaagctctggcctagggactcacaagtgtgtgtgaaaaaaaaaaaatccccacatccgtaaacttcaaaatttaataagtattataaaatgagctatagaaatacagaagaagaatttatatagatttccaagttgactaatttttacagggaaaaaattcctcattttgatattaattaccagttcatttagtaaaagatcacattattttacaactgaggtattttccaaagcaactccatgttgctttcactaatctaggtgcaaaatttattctcttagattatttccatttcaaaatcgtgtctcacaaggaatatacatgaaatatactctcttctgtcacctccttccttccatccataacagtgtgaatactttggccagtgatattgtttatgttaatacgtgttgtagcctcttgccagaaattattaggctcagaaaggggggcagagggaactctccaggaccctatttctagctggatgtctcccttctgcaaagctcatcaagcacccacacaaaaaagctgaagctggctggactgtgagcaagacacacagataccacccctcactcccagcttgagtagttagggtgcgtaggattccttgaccgtgaagctaggggccatgtcttacacaaatagcacacaagtgttttgctccttaaattctgggagctgctgttggctgaattacctctcagccgtcctgttgacagatggtgtaacttgctcattaaatcaggatcctccccattccgagggccccaggcatgttaggagacagacttggtggtgttttctaatgctaatggtctgcagctccagagcgaagataaatattctactttattgtgcaaccactaacttcagccttactgggtctgctcccttcattttgacagggcacatttagaaaagtgaaatgaagtgcttttaggcatccagttcctccatccgtcactttctcttatattctgccagcctcgtctttttctctgagacttgtctccacacagtgctttatatcagtgacatacagtatcctgaactaaaaagagaccttcctagttcagagttcaggacttaactttggttttaagcagtattatgcaaggcttatttatttggagagcttattggaggaaacaatagcagcctatgcaaagaggggacctgatataaagtcagtgtggctccagcacagataataagcatgattattaaacagccatgtttaacaacttggatgtgtatgctaagagcaatggggaagccaggagagggccttagggtgggggtttcacatgatcgtagttatgctttaagaagacccctccagctacagagtggagaattgagcagtaatgagaagcagagagggagacaagtatcaactgaagaatgacaagattcataaatttgggaaaacagctttatttctcataaagtgttgcagcctgcagggtgcccattcccacaggctaggaagcatagcctcttgccagaagctagaaacagacacttcaagggagaggtaaagggaataggaacgtgcgctgagcaaggtggccaaatatacatatttaataagctataggaggagtcatgaatattcatgaaaggagaaacgtggtcctgtgcaattgaacttcatgcccatttgtgggtcccatgtacaaaaaaaatggtagcattagcatgatccaagggtggagttttgagctctctgatgtcaaaaggtgaagcagaggacacaaaagcctttactgcacattctccatagactggccagaaccactgcatggtcagtggtcttttctcaggcaaaaaaaggaggggcagcatcaggtggtttgttggtatcaaaagtggagtctttccaaagagctagtttctgtttatcccttagggaggaaagcctaacatggttagcgagggagggatatactgaggcatgtctgacctctcatcctgtcatggctgagaactcaatttttaaggttaatctggggtccccttggccaatagagggtccattcagttggggggcttaggattccatttttatttctcacaggcgacctcaggagggcagtcaggaggctctggtggcagtctgggttggagatgcaggtaacctgttgaaggtgatggcacacatggagagcaatggccagcatcaggagccgttcaggatgtggattcacagagcctgatgaactgtgtatggtgggggtgagggagaatggtgagtcagaaggagcccagggttctggctcatgcatggggtggaggatggcagtgacatccatggtgccagggcacagtggaagaggcagctgtcatgcataacctgagctctgctttgagtcacacagagaattgcaaaatactgtgaagggaagaggcagatgtgcagttgtaggaggggagagaaaaagaaataataacctaagaaagagaagatgattctttctcccagagagtatgccagggcataagaacaaacttactattattattatttttaactaatattggcagaaccactattactagctgctggtattgattgtttagttcatgtttaaactttacaatagccttcaattcttaccgaaatcatgtgggtaggcattatttatcatgcctatagaggtgaacagactgagactcagtgatattaaataatttagttaaagacagaaagcttgtgggtggatgagctaggctttgaacccaagtttggcactagaaagtacactcataactcttaaagaaaaccatcatctcccaagggacaaataaataggtacaaggttacaataagttaagaataaaatactgagtaacaaagaagctgatgggaggttattttaggattatttcttgaagaagttgaggtttaggattattttctggagaacttgaaacattttgttttgaatgggtctatatatgccaaatctttgaatgtgagcacattagttcgaagtagggaagaaatgagattaataacgtatagagtgaagatggcactgggggaacagctctttgaaacattctgctttacagccttttattatgctaccttgccagtggatgaaagctgcaatgcttagcttggctcacatcaccagcatgatatgctaagacacctttatagatctcacttcctgcctcccctcgcatgcaccctgtacagtcataaagcatcttccctccttggttccttcttcattcattaatcttctattcattaagtgaccattaattgaccattagctaatatgtgccaggaactttactaagtcctggggatataaggataaatatcctcaagaaaatgatgagtggctataatatccagagtcacaattcattacacaatattttgaaatatgctattacaaacattgtatctattaaaacagaggccagaagagggtatggctttgtctaaaggaggtgaactttgagctagaattaagaacaagtaaaaatttgtcaaatgcatagagcagtcggaaaaatggaaaacagtgttctgtaaatgttgacatgagaattgagcagtttctgatatgcaactgttttttttttcttgttaacactttttgctttgctctccccaaatcctgaagcctcttcttccagtctcctgttttctgtttccttccacctcttcactgactttccagattaaactctgcattgcggatctctgacagtttctctcctgctttgctaaccactttaaaaaatagacatttaaaggccttctgtgtgtctcctgctatgttatggctctcctgctgtgtgaattgaagctccctgcccagaggacggatgccccaccgctggggcgctggaggctccaaggcttaccttagaggtttgcaccatgggctgtgatgaatggcagcttggctttcgttccccaaggtcagtcacctgttccatgcctgatttcaccaaagggcatggtaccagattgcttgctcaccaagaaggtgaggcccagacagggcagtgaagcagctccatgcaacatggattaggtccagcccaactcccagcttttccttacctttggagtcatataatccttatctgcatactcagcctgcccatggtcctctgcgctactcctgagaagaggtagcactgatttaagccctgtaattccaccccatatattaggctctgctccaaggtacccttgctgttgtctcactgtggtcctgtgcctcggttgagccacgagatgtcacctgtgtctggaccaagtccccagtttgtaccccagtcctgatgagggccctctcttctgtacctggtacatgcatttctattgtgttaacctatacaaggaccttggaatctctaggcttagggccccaaatcctccctaaatttgtttctagaactgcctataagctaacttcactaaaaccaagtgtgctcagatggccagagcctgaggaaagatgctgaattctgcatgttcactgtgccttcattccctgttgctgtgccccacatataagtcagaaacccagaagtcagatattggtcttcattctaattattcagaataatatagcagttaacaggtacagcacacctttctcctttactgtgcttagtactttagaagaattgactcacatagctcacaacagttccatgagtagcactctgtggcactgggattccagtttaggcagtcctctttcaaagtccattttcttagccccccatgtgctttactgtctgccacatctggaccatatcctgttgttgtcatgctcagtgcctctccagtcaaaccatctctcttgcagcgtcttcctctgagtctgcctctccattgcttccacagctcttggggacaagctgttttaatttttttaatttaaaaataaaaatagtatttctttttttattattattatactttaagttttagggtacatgtacataatgtgccctatgtatacatgtatacatgtgctatgtatacatgtgctatgctggtgtgctgtacccattaactcatcatttagcattaggtatatctcctaatgctatccctccccctttcccccaccccacaacagtccccagaatgtgatgttccccttcctgtgtccatgtgttctcatttttcaattcccatctatgagtgagaacatgcagtgtttggttttttgtcctagctatagtttactgagaatgatgatttccaatttcatccatatccctacaaaggacatgaactcatcattttttatggctgcatagtatttcatggtgtatatgtgccacattttcttgagagctgatctatttctagttcaccaatacacatacaatatagtctattttgataaactaaatccagaaactgatttaagttaaaagaatgaaagttacccagtttctgactccattaaagtcagaaaattctgactacctattttagtactgaaagctctctacaaaattaaatgctctctatcttctgtttttgtgttaaactccacctggacttctttattaattataaaacaaataaaccacttgcaatgagctataatgttagtcacatggaaaacatgttaggcaaaaatactttctgcatatagttgtaattcagtaattgtttcactatcactcagaagagaattattttatatgctggttgcatttagtccaaaatttaaatcattttccctcattagagaatagtaaaatgtaagagaaatataaatttcatgtttttaatttgttcaaaattttaaaacattaaattttgtaacactgttgccatgctctgttgacagatatattagaagagggtggaacaaactcataaagtatgaggcctccttggttcaaagaaagtagagacagaacactcaaatatatattatttccatttatttgtttttttaaaggggaactttggggtaatgccaaacaataatatttatgtttatagtctaaaaaaaaataaaataaaaataaatatagtatatatttatcatatgtaatattgtgttttgatttatgtatacattgtgggatagataaatcaagctaattatacatatgtattacctcacattcttatttttaaaaaacacttagaatctactcctttagcaattttcgagtatacaatacatagttattcactatagtcaccatggtgtacaatagatctcttgaactgattcctgctgtctaactgaaatttatatcctttggtggtgtgtgcctgttgtcacagctactcaggaggctgaggtggaaggatcacttgagcccaagagtctgaggctttagtgaactatgatagtgccactgaactccagcctgggcaacagggcaagaccccatctcaaaaaaaaagaaagaaagaagaaaaaaagacatgtatatcctttgaccgccatctccccaaccctgcaccatctagtcgctagtaaccaccattctattctctgcttctatgagttcaactttattacgttccacatataagtgagataatgcgatatttgtctttttctgacttatttcaattaatgtagtgttctctaggtttatacatggtgttgcaaatgacagagtttccttctattttaaggctggatagtattctatttgtgtgtataccacatttctttattcattcatcaattgatggacatttagatggattccatgttttagctactgtgaacagtgctgcagtaaacatgagaatgtagatatctcttcaacctctgatcccatatactctggatatacacctagaagtgggattgctgggtcatatgttagtactattttaaattttttgaggaaccaccatactttttttcttaatggctgtattaatttgcattctcaccaacagtgcacaagggatcccttttctccatatcctcaccaacacttgttatctttcatctttttattaagagacattctaacatgaataaggtgatatctcattgtggtttaaatttttatttcatttcactaatgattagtgatgttgagcattttttcttatacctgttagctctttatatgctttcttttgaaaaacgtctattcaggtcctttggctatttttaaagtgagttgttttattactattgagtttcttgtatattttggatattaaccccttatcaaatatctggtttgcatatattttcttccattctactggtgttgtctttattctgttgactgtttccttttctgtgcagaattgtcaacaaatcttgttccagtctgaccccttccctgtgtccaggcctatgttaagtagttgaactatatgcagttgagtcttgagatgatgatagagaggactcaaggacactgaaaagcccatgggcatcaaactgtaaattaggcatctaatgagtacttactttgtacttatttattactatttagtactatgtacgttctcagctgtttttggtactataaaaggatcacatgaaagaaagtctcactggttaagctcttagattctagaaccaggctgccaagattcaaatacctgattcaccacatagtatatccatgtgatcttaagcaagttacttatcctctctgtgctcagttttctcatatccataacgaggatagcaatggcatctacctcatagtgttcttgtgaagattaaatgaattaattcatgtaaagcattctgcactcaataagttaaagaaaatatttgcaatggtgaagaggacaatgatgataaaggagagtatggcaatatgtttgttccctgctacaagaagctttttgcttaataagggagatgatagatcacataaaacaatataagaccatatataattaaatgctagtttggttgatgaatatcagaagttaataagtatcctaataactgttggggacagttgaggaaggcaacatggactatggctttcaggatgagtaggctacagagaggtagaggagaaagtggtggcttagtcttctttacacgagggccacttctttcaatagaacactgatagtccttgttacagtgtttgttatatgttatttcagttaccattcgaataaacaggaactcaagatgctgggtctaactgaaatagtgaggatttgccttagtcatgggtagggtgtgattcacccatgggaattagagcatgaattggaaggtgattcaaaagatagtatccagatgtttagctgccatggaagccaggcagtcaaatcaggatttccctcagcagctgagctggaaagcagaataaaggcatgcccaaaagactaaaatctggggttaaatgctagaagaagaggtctgggagggaaagttagaaaacagggtttagaagtgaagggctgcaagatatgaatgtctccaattgatcaattaaggcaaattaattctaattaacgtatcagataaattaactcacatgaagacatcagatcctgcatcagtggtgtcgtgtgagaatgggccataaagaaaatggttctcagtggtagagataggattagaagccattcgtatctagaagttctgatatgagaattacctcctgaaaagatgccacagtggacgacccatgaaggccattgtcagattcagcagggggacagtcagtgatcttggattgtaagggagaagttttgtgaagctgagtggtaagtacatctttctttcaagatatatttatcaagttcctactgtgtttgaggtactgtattttttgaaatggtcttggagacagaggtgactcatccatgcatttttcagttgagaagctaacaggctaaaagataagataaatcctattgacaaataactaataaaaggtagaaagcaatgcctgatgcaagggaggcagagataaacaggcttaggagagcagagaagggaatgattgcttgcagtagagcccagtggctcatagccccagaactggggttggaaaccacccagcccagattcagatttctgctctatgtcttaatagcccttatgtccctgggtagatttacatacctctttgtgtactcatttgaaaaatgtagatcaaagcaatacctatcttacagagttattctgaggatgtattttgaggatgtattgagatagtacatccaaagtgtgtgtcagttaatcaacggtagttgttattaattccaaagaacgattttaatggtcaggtgaaacacaggttcacaggatatctgttatcaaagatctagccttttaagtactgtctgaattattgtgagcatgtcacatcttatttcagctaaaaaccgaaataagaaaggacaaagaagcattaaaaaggagttcactctagtgaaatgaaaaggggagaaccattgccagctgagatcctttcacctcttgggatttacctactgaatgtatgttcataaccctcagagagctagaggacaccagcctcttctgcccaactgactacctccctagaataccacagagatgcttaactggagtggattctgttggtggaagtgtacattgttacttcattattggagggcaagtctgcagtgtctatttaaatttaaatggaggaaaggaagtgaatacttctgaagccacaattatacctctcagtgtataccctggagaaatatgcatgcatgtgtgctgggaaccatatacagcatagtacatcagaaacagcccaaaagcccacccaccagaaatggggtaggtaaactgtagtggatccatgtaatacaatactatgccacagtgaaaaagaatatgctagaactcgatgtccccacatggtaaagtctccaagacatatgtcaaaaacaaacttgctggacaatatgtatagcgtgctatttatgtaaaatccatatatatgtttgtgattacatactaaaaattctagaaggatacataccaaattgataacagtaatcacttcatggttggggtaaggttatgatgagggaacagaataggtaaaaggaacttgagccttttaattactgtctgaattattgtgagcatgtgttcacatcttattgtataattgcaaataaatatacaaatatataagtaaagaggccagtgctctcctctatttgctacattctctcctcacttctagtcagctttcaaaaaagttgacatcaaaacattctttagcaaaatgtaatatagaaaaggcattgcttagtttatttttatgtattaatcctttataaagctacataaagtatgctgcaattttttgaaattttgcaaacagttgcaaaattaaatttgattcctaagtttcatgggtaatgatttaatattctcctacacattgttggaattcacatatgccccaaataaaaacgagctacatagaaatataaataacatttatgtgagatggacagtcctgcttagcttgtttttcaaagtgggcatgaaaatgcccatttaaaatttatatttagacaggaaaattaccattatctcaatagtgtaagaaaaaaataataatcctagagattgatgctttcaagggcacagcagtaaacgcatgacttttccaaccatgcagataggttaaccaaacattcagatgaagaccgaggctgtcagccagacatttgctcattttcaaacatctaaatgactgatggatatttttttaaaattcatgtgttggctcttggaaagggcaaatagacactgcattacatcaaaattaaaataataacaataaaggcatatacttcatctgttttcaaaaatgcatttctattctttcatatgtgagcctcatagccacccttgctagttatttagagcagatattattagcaccattttagaatgttattttataacatttagtttcagagagctttaacaggtttgtccaggataggatgagcaatatcatagcaatgttttttcacataacacttaccactagtatatattacattgtatatgtgattatctttttttaatctggtctaactcccttactggaaaaccttttgagggcaggggctttgcttattcccttcatcacctagaatagtacctagcacttaggtagaaagtattctgtaaatagctgttgaaagaatgaatgaatgagtgaatggataggacttgagcctgagctagcaccccatccagcattctttccaccacatcagtcaccctcaaacaatagcatcagtcaccctcaatcagtcacccccaaacatcagtcacccccaaacaatggaagcactctgtgaagaatggaacctgaaaagatggaaatgaatctacaataaggaaaataaaggagaaactgatcacagactcttctgggaaaggcaggaaatatattaaagaagaaaaaaaactataaggataactgttatgggaaaaacaccttcatccccaaactaggaaggtatcaagagaccgaagaatgatttggacaagtgcagcttggcaagcagatgagttaagatttacatatagggtactcctggatggcaggcaggaaggcacctctagagatccgccccacttcccacctctaagctgcttttaagctaattctctggctcttaggcctactgtgcatgcatgatgggactgttttccttgataggttcttagatactctgggatgtttgggttctcagggacacctgctctttggctggtcaccgtgacctcagctcaccaaccagccggctgtcaagatgcaggcagtggatatacacccttaagtaacctgatgggggatccttcacactacagtagcactggaaaagtcagtcactaagtacttatcaatgagacactagcaaggaggtaccacgatggcggaagcactcaggcagcaaggaagactgacaccaacgctgactcagcgggcttccagaagaatgtgacacgtcagctaagacctcacaaacaccaagttgaaattttcctagcaaaagtgatgagggaggcagagggagctgtgtgtgcaaaagctgtgaggagagacagacagtgatgtgtatgtgaaaaccataagtatttcattatggagagataatagcatcagagggcatggtaggtataggagaagaaaacactgaagatgtaagcaagatctagatcatgaagggccttgactgccatgtagaaagatatggaccttatcctgagagctgtggaagctgctgaagtaacagtgttgtgggcacagaggagagcaagcctcattcagtgagaaagattcctaagtcatacttaacaggttctagaaggatgagttggaacttgctaggtgaacaaggtgggagaggcattgaggatgaaacagcataggcaaaggcttagaggcatgaaggtggaggacaagggatcctgccaggttagcatggtttgggtactgtgggaataatgagcagtcatggagaaaaaagcaggaaagtcagacaagccaaattatgaatatcttatatatcatgctaaagaattatatttttattccataggcacaggaagatagagctctctagtatcatctgaaccttcttacatgacttatatcattcattttgtcaggctttgagcaactgcatgctgtataccatgttgaggtccttggtaatgtaacagaatcctggggaaaggagacctggttctgaatcccagatctatcacttactgaaatctgaggtcatcactcttaaatctctaaccttcaatttctccatccatagaatgggaccaataataagttttgcattgccttcttcatagaattgttatgaggaatcactcaaaaagtgtgcaagaaattacccatgctggaccaaattctgtaggtgggaaatgggatgaaggagagaggataaatgcaggactagagagggtaaactagtgtgttggagaggcaggaaatacaggatggagcaccatagtgaaaatgaagaataaatgagtgtggttaaggttgtatactatcttgaacaagatattggagagttcaagtgggacaaatccaagaggaagcatctgtggaacatgtcattgatttgttagccaacaggtgtgaatgaatgaggtgctttataatgtctcttaatgattgttcttgacaagatgctttttttaaacagggtcccaagggtctgctcctattggatgcccatatctatcttaatatggttttctaatcctgatgccttttaaagtttattcggatgttaaaacaatggtgataaaagaaggaactcctcattcatttatttattcaataaatatgcattgagtctgtccagggagaacgctgcaggatattaggccacacaggtggttcctgcaactcagagagcttacattctagtagataatcttgaaaaacttctggaaatgttattttcttaatgaattatgtcaggcttcgatcaatggctttgggtcccttggtctgctttccttccatacatttataagccttgtattcattcatacttgctcagaaactcattgctctaccagatctctttcagttgtttgccatagctgatttgtttcaacaaaacaatggttcctacataggaggtccttaggtccccaaagaactagaaagctggtaatggagatctggattatttttcaacttttaaatgaaaacgtcacacacacacacacacacacacaccccatatatatacacacatacacacacacacacacacacacacatatatatgtaatcctgttactactataccaaacttttttacattacagttttataaagctaggtgaaaacatggtatacctaccatttctttcatgtcactcttttaagttaatatttcattataattatttttgagaactcagtatttcaaaatatctaatgaaattgtggcatccttgatgaagcttggcaggctgagttgcaggtcaagtatctccgcctttgatcacaattgtgctggttccctctggcaatcataggtgatctcccactgatcagaatatatgattggcaaattcagatatcttggcctattaaatggtggacagaatttatgcataaattcattcataaatgtttggcaaaaaaaaagtatttcaaaacacaagccctggttacaggtggggagaaaaagagtctttgatggtataaagcctgggaattactgatctaaaaggaccttgtttgtgaaactaaacccaacatacagcagaaatggaaaagttaatgttaaatttgtgactttccaattacagtttctcttgaataaaagccatagcagttgaacccaagaggcgtatttaagctgtttaagaatgcttaagtaggatctgccctccattccacttgtactaattccggggcctctgattttttaagataagatgggtagcaatattatggaaggctatatcagaagacaatacttgttctttctagtgatacaagaattatcagtaatttggagcagggcagggataagcatgggataagcaaggagcttgccttgggtgcaaatttaagagggtgccaccaggaaactcctaaatcaagatatgtaatattttaataaaacatttttaaaaaatcaaacttcatgcaaaaaaaatccatgatgaatgaaatatccaaatatttaatgaaaacacgatcagcatcactgattttctcttttgtcttaggctttaaaatggctcattatggtactgctgaattttattatttaaaattttgatatttggttcacaatgaatttatctgtattaacttctattttaaaaaatgtattgcattagaatataatttatctatctcagtcactgagctttttaatgcaccttaaattttgccttacctgcctaacttccatcaactagcccccagcatctgtgggttcttaatacaaatttgactttgcagttgatttgtctggttttagaactttttcttactcttctccctctccaagctgtgttaatggctgtttgggtaattctgattgaggtgtgcataaaaggatatttgctacacgatgaaaggcagtaagaagtatatttgtgggtgagatgttagtttgctgctgttggtgctaggataataattgctacattctgagagatgcaccagaggttggggacgagtgagtaggtcaaggctcctaatgatcagcttcttgcctacaggtttctggaggccattggatgagaaggcagcacaggtgtgcagcaggggcaggattgtctgggagacgggcttgcttttgtaacacaattttcactgtgttctgagctgtgattgacctagtgccttctagcagtgattggaagttaatattttgccctggtgtgtgtgtgtgtgtgtgtgtgtatctgtgtgtgtgtgtgtttagagatagatagagattccctcatttttttccattttatgtgatttccagaggatctctactgaggggctgcaattctttttttttgaaatgaaggtctctttctaatgaaaattatggaatgggtttacagcttcacatacctaagcattgtagaatgatttatggcagaactattcagcaactctgttctgcagcacatactaagtattaggctttagtttgcatgctaagcagaagtctttttttttcttttttaagcaatatcccttccaacctaggtcttctccctattttaatgctaatgagacagttttgccaataatagcagaatcaaggagttctgaatgtcaccctcgtcttctcattttgtcaaaccaactaaccagagatgaggcagagaaggtgaatcctttgagagtgcttggaaggatttcttagcgtatttgccataacgtctgcaagagaggaggtgattcagccttttgaggctatctgctatatggaaaactctgacagcatttaagtagattagacaccaaaccacatatggcaaagacatggaaaccagtcagattcttggaggcagggaagtgatgggtgaagatttcaacagaacagtggaaggtatccaggttaatatgtagtcatcatttgagcagtcctaccataaacaagttctcagaaggtaatgatacaggattctttcctccttagttcagctaaaatccaggtccttgtctcacaacaaggaaaacttagatatgcagacacattgaagggtgagaaaggtagatttatcaggtgaaaagaatgctctcagcaaagaaagagtgggtcctgccaacaggatcccacctcacagatcgaataccaggctaccacacatgagctgaagaggctagccttctccccctgcatgaggcgtgaattcctggtggctccaccccattgacccagtgcacatgggccaccagtcccttgtgggcatgcccaggcaagaccctgtgcaggttcccccagctgcacaaagacatctggcataaacacttgtggggcaggtcagagattctccagggacacttccttatctgcctcctgcatctatcattccccctactaaagaagtacatctaaatgcccttaggttagaagtacatctaaatgcccttaggttaaagataaggataaggataaggataaggataaggataaggataaggataaggataaggataaggataaggttaaggatgaagaccaatattaactgcttcctgctgacaggggtgctgttttggggaatcagcaatcagatctccctcataggcctatataagggtccctggtaaaaggggtgatcatcaaaggctccggtggcaggactatttggagtatttggagtttgatggcctgaaggccagaagagacaaactgggttattggaaaacatgtatcaaaatgaaacaaaaagggatgggtaagggcagctcaaaaatcccaaggctgctggcacacacagataactggtggctatagttatgcttgctaagatttgggtgcatggggcttgactttggttagctcccttggtcttattttctcaaaaaggatacctctgggtgatgggcaccctatttactcctatcacctgccaggatttgcaaggtaattgcccagaactagactatttgatccagatttttacattactcatctcttttgtttcttctgagctgcagttggagatcactggttggttcacaggaataatcagagttaacttataatgtgggggaaaaaaaattaaaacagctaatgagtctagaatttaatgacaaatgtctaagttttggaacataatttatctctctccagtcctcattcttgtcaaaaagaaatcatgatgggactgagttgtttgaaaaatagactttagtcttatacttggcctgattatttgcataaagtacagcacaaataattatttttacataggcctttcagattggctttgatggaactctgttccacaaggaatctgagataagactttttcttcttttttttaaagctgagcccagccatgagtttgtaccctcaaatacctgagttgcataaactcctctcttcttgaggtccaagaacatgtgattcctggacttgttagaaagcaacattctttacttaccatgggtcaggaaccctgtacagggactgtgaatacaaggtgtgaggccagttttcccaagggacttttatcagctctgcaagtcaagcttgattccttaacgggatgcatacccttccagtcaaagctttggtaaaacaaccagtttctccacttgcattctgttgcaaaagaaaatggattcttattgcactgacacaaataactactttgccataagtcatgaatactgccataagtcatgaatactcatgactagtttccaaattctggagaaaccaggcaaagagaaacaaatatgctccaaattttgtcacagaattgtactttattcaattattaaaggccataaatagctgaacataaggttccttgactctgaaaaacaaaacaaggatcagcagtgttctaagcaaacatttaaaaaggctacttcagttttctattagttcagtccattccattaactcttgttctatttgatattcatgaacatttcagctcttcatgaattcattattccaatgtcacaatctccaaaattacaagaaatctgcatttgagagtacctgtcaaagttctatagctgattataaaccatcttttgaacaggatcaaaacaagacaacaattgcctgtgaataaaaaaaattctagggtagttacagtcaaaaacacgattgacaaagaaatttggttatctctgtggtttacaataacttaacataatatcaaccttaatcatgattgatagcatatacccaaacattagaattttagaaatcccatacaattttggaatatatattaatattattccctaaattataacctgaagaagattaaacatcattttggcaatcccatgtacctcaacatgtcaaataatcctgtttacctctcttttgggtgctccaggggccatctgtagcatccaaaagctgaggtcagaaaagacaacctgaagctgaaatttgattcagggaagcctgttaaatatgttaaaaatttaaaacacttgatgctataaaatagaatttcagattaccataagttatttattttgccaaaacgatgacttaggaattttaaaacaaggcagaaaatctttactcattaacagggaagactttgttttccaaaaaatttttctcttgtctgctctttcttttccttggcagtctatccacaaggcaaatgaaaatcgctcattatcctttactagtacgtgaaaatcttgtacaagggagagaaagccaaattttacccttacattaatagtaattttacccttactattaacgtctatcccaattttctaatgaaactttacagacaattctatcttatcttaaccagtttaaccaccaggtgagatccttataatccttttataaccctctacaaattttgctaaagagcagattagtgccttaagaaaaccttgttgtgcttttacttcaatgttccatttgcagaaaaaccatataatacccttttgaattaaaaccatataatacccctttgaattttgtcaatgtgcaaacacagaatttcttttacaagattaattcttagaaaccttccacaatgtgtttaaacctttagctttatcttatctaattttaaaaaattctttagccctaggcaaaaatttacatttccatgccctcttataatcttttactaaaaacacattttactgttcttacacaccttgtatgtaaatccattttcagtggtctcaattacatgttatagtggtaactcttaggaatttttaactgtaatgtaaaatctggtaagttgttttaattatgtgctaggcatcaataaagtttgactaagtttgatctaagtgcttatttttctttaagccaattaattagagctcttttttatagacatcacacacaacacatatataactacacagacagaagaagatccagtagctataaaatttttcatttgtcaatctcaattctcagggtggagaaaaaagaaaaaaaatcccaatctcaacaatcccaattggattatttgcctcaggatggagccctttaagagcatgctgtttccagggcccaataaacaggtatagctggaagacaaaaacagattttgagagggatttatccgcttctaattcctgggcttccatgaggaaaacagaggtttctcccaaaatggaatccgtggtgtcttttctgtctttcccaaggagtcccaggccatcagaaattatcttaggggctctaatgcatgcattaagagtggcaaggcaaaatggagaaaaataattcagtcaactgaggaaaacccttttttcagcaaaataagattcaagaagagaaaaacataaaggccttttaaatatacctataacttggatatacacttctaattaagctgagctctctttaagaaaatccttttaaatcccttattagttcactttagccatgccaagcagctgatgtatctagcttttgaactttatcaaaagtaacctcaccagtgggaccaacaaacctcaattaagacacgcaaagcataccagattggctacagcttaagaccaacctcatatatcctttttcattaatcagaacttcacagataatataaacagtgattcttatcattcctcttactggtgtgcacagggagagggaagccaaaagcccaactggtaaaaacttttacccttttgccagcatgtcaggcttctgggttcctttcccctgagctcaactccaagccaactagactaaagatgaatggctactcatctagaaggggtaacaggcacccctggtccctttctctttttagtgaatacccaggctatatgagtgagagaaggaaaaagcatcctttttccttcttccatctttttattcccgaatcccagtggccatgacagggtgctgcccatgagtgtcaatgtggctttcacccatgttaataggggggcctgagggagggattatctgctcttacccatgaactccatgtcccgcctgctgtcagtagccttcaagttccaaagcttggaatggagtttggggcaaaaatgtgtctcatggggtttcatggactccttataagctgaatgttaaggcaaagctgtggaaccaagttcccctccaacaagggagagaaaagagcatcttgtgaattggggtcctggcctagtaaaaacaccttctaaaaggaaaaatctctcacacaaaagttaactcctgatagggtgaaaaaagaagaaaataataatagtttaagtgcaggactggaaagatgcctgggggaataacctcttattcttatgtaaatgggtttctccaacagggagagaaactttttttttttttttgagacagagtctcgctgagttgccaggctggagtgcagtggcccaatctcagctcactgcaatctccgcctcccaggttcaagtgattctcctgactcagcctcccaagcagctgagactacaggcatgcaccaccacacccagataatttttgtatttttagtagagacagagtttcatcatgttggccaggatggtctcgatctcttgaccttgtgatctgcctgcctcggcctcccaaagtgctggaattacaggcgtgagccactgtgcccagctgagagaaacttttaattgctgttggactgaggtggaccccttggccaggagaggggaagactcccggtgcatggcagggaatgctggccagccagccacgcagggcccttgggccatgtgccccagccccaaccgagaggggaggggggcggggagctgctgctcacccatctgtcctgtgcatgcacctgtggccattggggtgggggtggaacaccccccaatatgtaaaagaaaagatagctgccattacagtcctaataaaaagaaggaaattgccatagaaaaaactgggctggactgaggccaacattcctgacccccaagagtgacaaggcaagtctcagttttttctacctttagaagaaatctgagaacaagaaggctccaaaacaaaagggaaagaaacattcaggtccgtattttactcacccttcctcaggtccccatatgggccaccaaaatgatgcaggattttttgctccttagcttggctaaaatctaggtcttgtctcaagaccaggaaaaattaggcacacagacacattgaagggtgaggaaagtggttgtattaggcgaaaataaatctctcagcaaagaaagaaggggccctgccaataggctcccacctcgcagattgaataccaggccaccacacaggagctgaagaggccaggctcctcccctgcataaggtgtgaattcctggtggctccactccattccttcagtgcatgtgggcatgcccaggaaagaccctgtgcaggttcccttatctgcacaaaaacatctggtgtaaacacttgtggggcaggtcagaaattctctggggacccttccttatctgcctcctgcatatatcagtggcagagcatagcattagggggccccagtggatggagaatggctgggatgcaatgacttagtttttagaatcactgacattggtcaacactaatagctctttccagagaaacacaggtagtctggagccaggacctgataggaagaaggacaatttttgaattaattataatattataattaggtcgtattagtggaaggagtggggtaagatacacacaaggccagaaagaagactaccaaattgataaactccaacttgttatagctccatttgtaggaccagtgttggtcccagagaaggaggcaggttgcctctatagctggcatgttaagtaattaaaagaattactaattctgccctcttacttagcagtgacagggtatgccagcttatatttataaggaatttactatgtatagttcaaaaagcttcacatgtattagcacatttggccctaatgacaactgtatgagtttaatactagtatccttcccatttacaactgggcaaactgaggctcagtggatggataagcaatttgctccagatcacagcagtgggattgggattggaacctaggtagtttagtttgggagtcacattctttactgctatgcttacggagtttatacaagcagatcatcaagctccaaaataagaactctagtggtccaaaaggagcagaaatctgagggtgtagttaaatttgaatttggtggcatatctggatataagcctcttccccaaacatctaggaaataagggtggatgcagtgaattggtgaatatgataaagaagcttcattcaggagactcacttgtagatgttttagcttaatctttctagaatgttttagaattcagccatgcctgttcattcgtactgactctggggaggctactctgatattcagctatgttctgtcaacttgtgggccttttgatgctgttcaggaccccatcccatcctcctgtttttgctacaggagcatgccttcttctaagacttcaccattcctggtgttctgatttccatctgaatcttttggtctaacctacacattacagctgaagttgttagaaaacaaggttcagcgactgattaacacacattgttagcctgggaagctagttaattaatgtttattttaaatgaaaacacctcaaattactcacttgaaatgtaaatacatatttaactttagtgtttttatcttccttcagtaagaggaagtaggatggccattttcttgtgttttggttaacaaatttacatcatgtggattttattttcccctgaaatttctataatattaactatctgaatttagcaactaattacttattgcatagcagtatcttttccactgttgtcttgtactgtcattgaactcattaattgctatttaacttttcatgggcttgtcttgctttctcaagcagattattaactccctaggatgggaattttaccacattgaatttctccatggtgcccagggcaatgccttatgcatatgggtatcagtatacatttttttttagaactcagaacactgacctttttattattaacctggccgtaaggaaaaggtggaaaggaagtgaaagagagagagaaagaagtgtaatctatttattcatctgtatttctcaaaaaggtgggtttttcaaaattctactaattttatccccactttacattcctaccttacagaggctgggccctctgttcatcttgagcatctaatctggacaaacttgtaagctctcttaggaattcaaggtttatattctaagccaatctttgatcctacaatatctttagaacctctaattgattctaaagatgaaaaaacactgtgagttgtgaaaacaaaccagttgttttgccagggttgttaggctggccattaaatattttagacagaagaaggaggtttgaaatctctgcttgagctttttaactgaagccatcttccaagaataaagagaggaaaagaaaagaaatggcttcccttctgcgcagctgctatagaataactagaatacctagaaagtatctatgtgcattcagaacattggagagacattccaaacttatccatgagaaagggcagaagggcctctgggtggttcttttggcatgagagccaacaatgcgtatggggagaaggatatttgttcttgctgtttataataataatggctaatagttattgaatcctgaatatatgctagatgctggtctaggcactttggatatttaaacttactcaatcttcctatcaaccctaagtggtagatagtgttcatttcttcacgatgattacattgagaaactttctgaaagtaccacagctaataagtgatagaaccagtatttaatatcaaggagtttggctgtagagcaagagtcagcaaacattttctataaagggccaaatataactattttttggcattgtggccagcgtggtctttttcccacctattcagctccactgttgttatcctaaaagaagcataggcaatatgtaaatgaatgggcatggctgtgttgtaatgaaactttactaacagagacaggcagaagagagatttggtccatagtttatgggcttctaatctagagctcagctatattcctttccaaaattaaagtctgtttttgccattaaagtggatgtattaatacatgtgagagagaactttttgtattgcccataccaaattgtgagttttttttttttctttttcttcttttctcaaatacctcatgatcctaatagaactaaaatgaaatctggtgaattggggcagtaggtccacttgttttacacacatgaatcttctgaaattcaacaactagtctttaggcattcatttccttgacttcatgagggtgatgatgatgtataaaatccccatttccttttatatgttatctattggccactcacaattaaggctctagaaccacctgctagatttgttttctgaattcaatttagtctctaccagtagagagagtattagataaaagtacaagaaaagagcaggttcctcaacctgtttaggctcctttttatttgtccctagtcacctgaacagatgtgaaatctctggaaggggctgattaattcagaaggagatgtaggtagagccaggagcactgaacataaagttgatagtagaataattaatactaataattgacctttataaatcaccttgtgatttacaaaaagctttcctccattcctactgatgaccaacccagctctctctttctatccctgagtgcctggggatttgtcctaatggtatttcagagtgtaaggctgctgatacaatctaatctgagcaggtactgggacctgtatacattacttattcgttcatttgctgatggagatggaaacccaagcatgacatcagtagatccacaagacaatccttcacatcttctatctctttaaatctgggttcttgcttgtcaaggagaagaaaaagtacattatttaaaagtgcacctgtcacttacatgcttggaaacatgtcacagtgaatggtgaaacattattaattccttttgccttcaaagaataattcatgcacttacaagtataatctgcatcacaatgaaatatttggatgtaagcgtaggtgtaattagcaccagaaaatctctgaaacaagagaagcaagaaaatttacagttaagtgagcgtcatacataatcagtgtgcctgggaatttaggggtgtgctacaaccttgtgtagtcttggcaattctgagggccagtgaaggggaggaatgtgacagctgtctccaaagattttgaatatgcggatgagacaaaagctattcatgctggctttgcacagtctatgcaatttagattcttcaatttagttcaactatttattgagtccctgtcatgtcaaaagctcatatttggacatagaatgatacaaatataataatagtgtagtgggtgtttctggtgcctttcccagatctcccttacatggttgctgtgagtataggttactgtcagctcacaactgccctattcttcgtggaactgtccttggccatgggagctgcttggccatggaggatacgtccttctgtgcccacaaaggaaggcagcctatagccagtaaccaatggatatggagggtttgaatggggggaggatagaaatggctggacccatcccaagagggaaccaaccttttggtgcaatttatgcttcagacctccctgtgggatcaggctgaagctagagttcagcttagctcctcccccgactctgtcttacttccctaactcctttctttctgagacctctccttcaggtaaatcgcagacacccaaatctccatctcaaatattaactctagagagcccaacctaggatacagtggtattatttatcacatcaattgctaggggcaagcattggctaagccatttgcataaatgtcattggatacttacaataactgttttcctattggaattgaggctcagagaggttaagggcccaaagccctacagttagtaaagttggccttccaggataggtctgtgagactccagaggactcattttatcctgctgtctgagttaagtaaggcacgtgatcatacctgctccctacccacaggaacttacagtttaacaggcagagaaagcaaatgaaaagctattatcagagaatggaagaaaggttatggggatccaggggagggagagctagcattcagttggaaaacatgactgtagagattttatcacatgcttatacagagaccatgctgatctgtcaattttttcagctggactcatgccggtgtctagtctggggtattttatgctttgtgtttgcagaatagtcatgcggatgagattaggagggtatgagcatgcacagttatataagctcctcatacacctgttgcagataaaacttctgtgatcatgatgccagaggatgcatgggatgtgatgcctctagattccagagataataggaacagggtctcaaattctttaagtcagaaaggaacatgattcttctttgctattgccttctctgaaattgactgcctgaaagtcatgaaacacactgtcaatgctcctgttcctatcttttggaccactgatctaagatagtaatagtggagatggagagaataatggaatgtgagacctatttttgaactagacctgatagattttaaagacttgctcatgggattgaatgtgacttgcattaaactccctctctattaatttccagtccctagaaactaatagccactattttgtctacagtcctcagagagaacacaatgtaatctgcattaatctgcaatagtttattccccaaccaggaaatgatctggggaaagattacagccttctacgatgtttcccacacagtgccttgttctggaaggtactcacactgaatagaactcttgctttggaaaagttagtgcagaatcaaactcaaacatttcttctctctactctattgctttggttttcccctggaaatatgtggtttattttgttttttgtcccttcggaaaagaagatacacatgtatgcatccatacagccctagcatccttagaaggacttgaatgttttctccgaaaatctcttagagcaaaattttaaatatcagaaaatagtactattatctgtgggatttggtctttgtagggaagatacataatcttcttaattatcatctacaacatgagtgtaatgcccctatgactcccttcctagtattggttttgttgctgttgtaataaacttacagattaatttggggagaattgatggctttattatgttgagtcctccaatccatgaacctagtagggatgtctccatttattgaggtctctttgatttctttcatcagcaatttgtaatttaatatacagatcctgtgtttttcacttttttttaaaaaaagtttgtacttcagtattttattttatttctccataacttgttggggtacagttggtgtttgattacatgggtaagttctttagtggtgatttgtgagattttggtgaacccatcactgagcagtatacactgcaccatatttgttatcttttatcccttgcgccctcccactcttcccccgaagtcctcaaatctcattgcatcattctttttttttttttttttttttttttttttgagacggagtctccccctgtcacccaggctggagtgcaatggctcaatctttgctcactgcaacctccacctcccaggttcaagcgattctcctgcctcagcatcctaagtaactgggattacaggcacacaccaccacgcccagctaattttttttgtatttttagtagagacggggtttcagcatgttggtcaggctggtctcgaactcctgacctcgtgattcgcctgccttggccttccgaagtgctgggattacaggcgtgagccactgcgcctggcccatggcatcattcttatgtctttgcatcctcacagcttatttcccacatatcagtgaggacatacaatgtttggtttttgattcctgagttacttcacttagagtaatagtctccagtctcatccaggttattgcaagtgctgttaattcattccttttatggctgggtagtattccatcatatacatattatatatatatatatatatatatatatatataaaaaatatatatataaaaatatattaaaaatatatatatacacctaatattgatttttaaaaagcaaatacaattattcatttcaaagtgcctgatagaatagtgcctggcttattcttataatagaataagtgcgtggctaattaaatgcaaggacgttttatttttaaaaacaaattcctttcttgaaacttggtaaattttccctaggccagattattgctaagtcaatcaattttacattgttgtatgtggcattttctgctttttctcatagtagaaaagaagttcttccagcattgccttgctctgactttcttaaatgctcttaatgtttgttgcaaggatggaggattacactgtgctcaccctacctgagcaaatgtcttctttgaactgtgtctagggactgggtaatccaccaaaatgatggaagcaaaaggttgccgatcacattgcagatctgctttgtggagggaagtagagcagcttttaaaaaatgtttctgcttagggactcagagccagcttttctcccttggacttgaagggcctcatcattttattttcccccccaaattataagaatctgcaataaatctccatctagaatctggtgttggatttttttctctcctatgttctagataataaaaatgttacagtttattcaaactgttcatgtggagacaatagtttcagctacaagtatggggagctttgtgaggaataaatcctatgttttctagaaaattgtcataggaaaaaagaaaaaataaccttttaaaggggttttaagaggaattatctttccgaaaattcctccctgtcacttatatgtgctcgaggttagtatgaattgagtcctaacatattggaattcaaaggaaccctggagatttcataccctccttattcactttatagcaagagtaaaagggaatcagaactaaatctcaaattaggactcgatcgcagggcacctggcttctaacatggggtgcagtccctaccgccccagcttgagagattaaaaaggggccttgtgcctgtcctacctcaaccttctcctttcatagatgagagggtaggcccatgtgaactcagatcttctggctcctggtcatggttcttcttaaattatcaaatatatggaatcgaaagatctttcaggaagcagaatattcaaaaacagagtagacaatttggggttttatatacaggagtctccccaccgtactcataattgaccttgaaaaagtatgtttgacttgaaaaggccaatactttctaaaaatagctgtagtttttgtaggataggtcaaaaacaggcatgtactccagcatgtggccagtagagggcgatcaagttaatacaatctgagccgtgggctttcaattaatgcatggaagtgaataaataaaacaaagaaccaagttagtctaaatgttttaaaacaaaccctgtaatcaatatctgctaaatggaggaaaccaatttttctttatctactgtagtcatttaccaaggagtattacagagttgtagcatagcctgttacagttccttaattaagccctagaaatccaggcagcttgctattccatcattgtcagggctcttggtggccatcaggtggaagacaggcatggaacttgacatgtgtttttgtagcacttatagcattttcatattaacaacaacgaaaagctatactcttccagagtgaaagaacctcttatcaaatgtgatggggagtagctcttaactcatttctcacacctcccttttcctccctattcaattttcaaggactcagcaataaacaaatcagcggtggaggattccacctccctggctcactccacttccagcataaatcagttctgctcttgattagagccatgggcgggttgcagcatttggaaacggaatgaatggccccgtggtcaggaagactttcacgatcttgagtcacaggcaaaatcagtgtggagggtgaaggcaagtggaaattccctagtaatccattcgtttgtgcatttagaaaactttccttaaacccgtgatgcgggccagcccctatagcaaaatctaagaaataagcacaagaaagatctttggctttacttaggagccaagctgggtattttcttggacaggaaatgtattaagaatactccagaattatcaacttttattgaaaattgactattatgtgcaattataacagctggcatttactgagcatttactatgtactagggctctactaaacacttttcatgcaatatttcattgaatcctcatgacttacttcttttatgctgtttataatctcctgatgcacaaaggtgttaagtagcccaaagtcacaggcctggagatgagtcactatgtctcatatacacacacacataaaatgctaatccacaataaggaagggctcaataaatgctttagcatgttaataaggtatcacttagtgggacttgctgtatgtcatacagtatgctaacttatttccatcttacttaatccccatgaacacttctgtggaaggtactgttattattgtcattttgtaggtgaagaagcgggtaagaaccttgctcaaagtaatatggtagtgagtgcaagaataaggatttgaggccaggtgtggtggctcacgcactttgggaggccagggcgggcagatcacgaggtcaggagattgagaccatcctggctaacacggtgaaaccccctctctactaaaaaatacaaaaaattagccgggtgtggtggcaggcgcctgtagtcccagctattcgggaagctgaggcaggacaattgtgtgaacccgggaggcggagcttgcactgagccgagattgtgccactgcactccagcctgggcgacagagccaagactccatttcaaaaaaaaaaaacaaaaaaacatgaggatttgaacctgggtctgatttcagagctggagagtttaataggaagccagtgggttttgaagctttaatgcatgtaggaatcatctgggagcttgaatacagattccctgagcccgggccagtgattggaccctaatcatcttacaaatcacctgagaagctttttaaaattacccatgttgccctaccccagcctaatggaaccagaatccctggaagctgagcgtctagacttcaggtgagtctaaagtgcagctaggctgatctttcatcagtctgggtggctctcaggaaccccttatttttttgtaagtactccagcaagaaaagttgcctaagctctactgttaattaatctaagctttatctaacctactgggagaaaagaaatggttgtcatccgtgcagcaaatgatgaatcgacggaaagccctagcagggccaagactagcgagaggcacccagggcccacaattcaaggagtcagtgcttaggacttgggagagggtgaatgcctctttaagtcagtaccctcagtgcttcacttgttgtgccgtggagtccagcacctgggaaacattccaggaaggcaccaagagaggaggagaaggaggtaaggttggagatttcaaagagggttggatctaggggtgggagaatggatgctttgacaaagttctcccagtagttattgttgtttgtgccctcgtttgagaaagacagctaagaacaaggcaggagggccaggcacagtggctcaaacctataatgccagcattttgggaagctgaggcaggcgggttgcttgagctcaggaattcaagaccagcctgggcaacatgacgaaagccagtctccacaaataaatgcaagaattagctgggcatggtgacgcatacctgtagtcccagctagctactcgggaggctgaggtaggagggttggcttgaacccgggaggccaaggttgcagtgagcagagattgtgccactgcacttcagcctaggtgacagagccagaaccagacactgtctcagagaagaaaaaaaaaaaaaaggcaggaggtgtgatgagggaccccaccctcctttgtatgggagccaaaggaggaaggagcaggtgctgattgcctaacagatgtccttatattatcttaagtccattagacttgtgaggcaggtattattaattttttaattatcctcattttatggatcgcaaatggaatctcagtaaagtatggtcattggcccaaggccacagaactttaggttctgcagagctggggtttgaacctagatcagtctggctccaaagcccgagcttgcttcactatatcagtctgcccatgtggaaacatctaaggtgtgaggcagcgcccatgccagtgtgaagtcatgtcatccacctaaccacccaagtgctggggggactgcctcttgcggtaaggagaaacttgggctatgaacttgaaacaaatgagagccttggaagaagaaatgcgatgaactgcacccttcattttgtgtatatgaatcaccaacagtagttcccagctttgtgactaaagacaaacgtcaatgccaaaatcaccctagttcatcctagctgcagcatcaaacagtcatggccacctaatccagtagggaagctagcaaatgttgagtttccctaatttaagggtcagcagtctcgggcacaggcacagactactgagttgctctgattaggagggagcttacccagactcactcttcagcaagattgaccagctccctgtgggggagcaagaatgagattcaggtgacaagcaatggtataaaaatgatgtgtgaacaagtgcaaacttgcctctctggccttagaagtcactgtggattgtgctgtggacgactgggagagtgactggcagggagttgatcctggagcaagtgccagagcttgtggtcactgaaaagccttaattatctaaccacaggtggttcccaaagaaagaaaacaataacgctatcctcctgcgctaaatagtggagaagtcttacttagggctgtgtacaaaaattaccagggaagatggttttacaaaacacaggtgctgggtataaccctcagactctgattcaaaagatctagtgacgttctttgtagtttcaaaatctccaggttattctcatgattaccttaggctgagacaattctaaaagtgtaaacccaaggacaacaaaaagaagtgagaagtgcgtgcacatagcaggaaaaaaaaaatctaatacatgaaagcccttgaggatgtatatgcatgtcaacagtaagtgacttccgtagagggtgaagggtacataagaatatatgtgggatgacatgaattttggaccttttgtaaggtttaaacactaagaatgaaacatcattcttagtaatgaggttgaggaaaattttatttacattcttgagaagaatactgttaaaagataaactgaggcacaataaaattgtatagagtttattcgggcaaacagtgactcatgaatcaggcagcaagtggttcagggttccactgaagaagcccaagagggaggcttttatagtgaacacagaagcaaggcaaggaagatatctgattggtttgggttatgtagttgcctcgttttgtctgtcctactggaaagcttctagttacataactctgtgttagatggcagcttttgattggttcagttaaagttccatgtttcttaatgttggcatttataagaaatagctcaagttaagttccacttgtggttgcgattcaaacaagtttaaggtcactttcaaggcctatctctgtcttctctagaatttttcatgcctggtctccattttagtttattttaacaacattgcatttgcttgaaataatcgctcagcaaagttgtttactaaggagatgagaaaaggtagagacctcaaggacatgtttgagtaaacaaagatgttccacaaacagccttctaaggaggccggccagaattctctggaggagtctctgttttcctgagaatcttggtgtttaggttggcaagttaaaagctgagagagtgttatagggagttagaatacatgggaaagtaatttgaaattccacaagtggaggggacaggattcaggaaagcagagctgctggtgtcagggtggctaaggagggactttggagagcaacaatgtctgtggattttaaattttagtggaaacaatatgcactccaaaatatcctttacaatgactcaatcactcttcagtatggaagaccaaggaaaaagtgaacagaagagaaagagaaaaaaaatggaaggaaagaaaaaagggagggagaaatttattaatttaggtgttcattatttacctttgaatatttctatttaaaccctatgctatatatgtttaagttgattttatctataccctaggaatagctaacatttgaagtgcccttgagaagaatacacaccccagagggtagcactgaagagaaacttattagtagtcaaccgttcaatggcagccaagacaagtgatcaactctccttacctaaatctctacctagagactttgttggttaacataagaaatattataattttttattggtgaaatggatggtcttcaagacatgtggattggtcaaaagcatcacacaggaacagctgcccttgaataaataaggtatgaggatctagcaagtccaaaagctgtatgctcctttctagtggtggccctcgcttagggatccatttaataattcttatgacctgccacttaacagagaatttgtttggctgattttaactggaatactggctgaattctgctgctgacatgatgtcacatttgcctcaagtaatcttttcatacaagggtccttttgaaagtgtcttaacagagatggtgcttcgccatctcatatgagaaaaaaaattgtgtacatgctcatgaataaaaggatgtatgtgttgcagaaattagtcagatacatgttttcattgcagcatctcacctagtggctgggttgggagaaggggacttagctctcacttgcatctcattactggaggccatcaacatgtacccaaaaaaatcctgccagcagggaatggtggcatcagcttacattattctcagggttgtcgagactagaattcttgggggaatatgtgaaggtctgaattttgcaactacattgacttagaaccaaaaaagagtaagccttatctgggcaaaggattagctaatatctggactgtaagtcagagtagcgaaaaatatttagaaggcatcatagacaatgaagatatcattatttcctccaaaaagcctaccaaagctataatacagtacaagaaagaccttactaagcatgtaataaaactgtgagaaatcaaagtagggcaagatcgatggtgggtgatactgatggatatcaggaaaggcttgatgggggtgatatatttgagatgttccttggaggaggagtgagagtttcagcataccagcatgagagaccagatatggggagaaggctgtcaatggcaccattttaagtgtcagaaatggtgtgggagaactgagacaggataagacgtagttccgtaattttaagacatttttatgctgttgaggatatcacatttcctctccccatttctctgttcagaagttgcttacctctttcttgcccactttcatgtagagttttgcttttgtttttgttttcacttgtagtttgtggggtcccactaggtgttggcttgtctgttttttttgagagtcctgttgcccttgagaatgggttatgtttttttctcaaatatagaagaaaattgaggcagacagaaactcctataccttttcactgcccaaataaactatctgtatctctatcctgtctctttcagtactgtttctatgaagatgatatctctgtgcctatcagaaatcaatcctaatgctttggtctggatcccggtccttttcaccttctcaaggtctttgcttctgcaattatatcttcctttattcctgaatcatcacattatccctttcaactagtccatttccattattatacaaatacgctcttggttctcctattaaaaaattgatctcttatttccttccaactaccactctcttcactccgttcacataaaatcttgagcttattatctacaatcattatttttacgtcctttctgacattcttaacctatctgatcagactttcctccccaccactccactagggccactatcatcaaggtcaccactgatctatgtattgccaaatctagagggttttcccttgttcttgtctaccatgaccttacagtagcatcacatatagtcaggccctgcctccttgaaacacttctttgagttcacaagactccatatcttcagtcttcctctgacttaactggccacttctcaaattcctttgctggtctttcctcctctgatcaatctgttagtatgacattccctatggatatgccttaagaaccatctgctgaatatgccaggtcttttgctcttgcccgacagcacattgagtcttcaggactcttatttccaacagtcagcttgccaccaacatgtggatgactggcagccatctgaaacttaccatgatccaatgaaactcttgtgttctctcctcaaacatcacccatacaacaactttccccaaccaagtaagtgaccccaacagccaactgactgctgatgccaaaaacaaacagaaaaagtagctacccagtaattctatctggagccttacagagtctacctctaaaatccaaaaacctcaatgatcactaaggctacatatcacacttagaataaaatctatactcctgaccctgacttatgtaggtcagcaggatctaacccctttctaccttttcaatgtcagtgtgttctatcccaacccccattcattatgctccaggcagtttactgaccttcccagtctgtgagcatattaagctctttcctgcttcaaattctagtaccatctattttcctgcctgtgacccttttttttcttattatctatacatggcgtcttcctgctaataatgcaggtctgagcttaaatgacatcattctgactgcccagtccataggagccaccctgccaccctcacctcttgctattattttcagcataacaccaccatatgaaattcttcttgtttatttattcatgtatttttggagcacatctgaccccagcagaatataaattccatgagaggaagcactttgtctcagtacctaaagcaatgaccaccaggtacgaatgctcacgcactatttgttgaaggaatgaatgaaacattgtaaagatgtgtcttagagccttagctccctggaggatttctttaatatagcaatgggcccttgtacagctaaagaagctcaggtgcattgttggatgcatgctaggtataccttctctatggactggcccggtagaggaacaggtaggtatcacaggcccctcccgacgtcactagcctccaaactagtgtagctgcaaagagatacgtgtatacaaaaacatatctccataaatagaagatgaagtagtattgacttttttgctcttcctaaaaagacttagaggacttaggtcagtacaggacttaggtcagtacatgtctgtagtgtgacactgttgtcagataactgatttgacactgggctgggtcgttattgttgggtcagaattatgttggtgttggttcaactacattttaagctgcaaatacccttgctactcaaaatatggtcctcagactagcagcattggcatcaccaggcaagttgttagaaatacagaatctcaggccccagcccaggccttctgagtcatatccacaattttttcaaaaaatgtagatgtttcatgcacacactgaggtttgataaacactgtgcttagactatttttccatgaacctatgtattgttctgagcactatcatgtatgaaggataaagatagatgtgacagagagtgattgggacagtgagaatacctgtaaccaggacacaagtgaaagtagctccttccaaatatgacagtcaaatatgtaacagcagttctgggcaccaacccatcaaaacaggccagctgcagcacaggcataaggtcctggtgtatctcccacaccctgccacccccttagttgatatagaaatattggggggcctccgctggaagagtggccaggtgacgggggaaagatacacaagaggactatgacagtggatacttattgcaggcaagttttatagaaatgtctattttaataaatggtgtggtgagagggtgaatatctgttaaagtcatcctcattctgtcctacctttgtttcttgtgcataccactattactgggcttaccatgttgtatcattagttaatttgatgtctgtctcctctatcaaactgtgtctccttgatgacttgacccaggttttattcctgactttggtgagtgcttaatttgtgtttgctgaaatgaataaatgagtaagtatgtgaatgaatgaatgaataagtcaatgaacaaatggatatgtaaggcagtgatatgaaagaaaggtcagacttattccgtgtcaacccagagtgcaaaaccagtgtactggatagaaatatcaacaatacagatttgggttcaattttaaaaaacttctgaaaattagaagtgcaagagaaattggttgagcttttctgggagaagtaaaatgttctggaaccagaattattcaaacagtctaataaaccatttgatgtacaaaatatataaacaagactgtttataggtaaattccaacagccataaatgtatgaaaaatttgttcagcctcactgggattcaggggaaattaaaattgcagtagcataccattacaaacccatctattgacacacatttaaaaatgtgattataccaactgtggccaaaagatgtgttttaaattgttataaccactttagagagatctaatttgttccaagataggcatactctacaattaagcaatcctgcttctcagcatccattctagattttttaaaaatgggatatcctagttcataaacaatgagatctacacaaggatattcattgcagcataatttaaaatagctaaaaatggcagaagtggggtggatccagctatttatttgtaagcaaatggacaaatccatgatcatttatacattgcagttaaaatgaatgaattgtatcattgcagttaaaatgaatgaattgtatctgcattatgataaatgaaaaaagcaagttacaaaggatagatagggctagatgcattttctataactttaatgatacctcatagcatattatgtgaagactttggatagaaaaccaaaagcatatttgcaaatggctttgaccaacctcagaaatgagatgcctcaagggaggggagagaaagagaaagcatacagagtagaacttcaaccctatctgtaattatttttttcaagaaataaatcttagtacatttagcaaaatatcaatggctcttccagaaggatatttgagacattggtgtctattatgttattgcctgagcttcttggaatctgatatgtagtaattcttaaaaactgaaggataccaattgtcatagccgttgataggatgggggataaaagattgttcgctctgtcctcagagccaattcttatctctttcttctgtaatcggatgtaccagagtgtccaggaactttttctctaaagatggggaaaacaagatagaccagtggttcaagttccttggtcattatccagccaagccttttaagacactctcacaggcttcttgttgagactccttcttcctgacagtagaaggtgtgtgttcattagtgagaacacccactaagttccagaaaggaaatgtgggtcagagaaaaagcaacagatggagagcaatgagataatcaagctgtagtggacactcaggcctgctgctttctttatgtcagcctatgtacccctatattggcagccaggtgaaccttagtacccatgctttctagctcatggtgctttccccacatgcattatcccaagagatattcacaatacctgggaagtaaataggactagcctggtttttagaggtgagggggcaaaggttcaacaaattgaaaccaagatttcacaggtaataaaaggacatctagactcaagctaaagttttctgacaccaaatattactctccttttataccacctttcaatttctgcgctaagcaccttgttcatttagcacgtcatgttatatccttacctacatccaacatggttttgaggtactgaacggcatacgtaaaacattttcatcagaagggaagtgaggctggagtttggggagtgaggagcagaaagagagaatgaaagtaaatataccaaaacccaggctaaaatgattaatttagtattgaattcgtgtgtgcttcctgacacaggtgagacaggacaggatatatggttttattatctgataaagggaatcttaccagagtgtcaggagagacaaatgttttccttggaccttaattattaatataaaatggatagatcatataaattcttattcaggaaactggtatagttacaaatatatttccatttgccatgacagagtgctgtttggttgattacttgctttttaaattgagattaacatataaaatgcacaaatcttaattgtacagatgaattaattttacacatgtatatactacataactatcacaccaatcaaaatatggaacattttcatcactccataggttcacccccatcccttcccagtcaattaccaacacccttcgccctcacccaatagaggaaaaaaatattctgacctttataactatgaacttgttttgcctgttttaaaacttcatataaataacatcatgcagaatgtactctttgtgtctggcttctttcactctacaacctgagactcacctatgttgttcaaggtaggaattgttgattcttttaatgtgtaatttgtaggccattgtatgaatgtacaaaaatgtgtttctctgttctggtgtcagtagacatatgggttgttcagtctttggctatgataaataaagctgatgtaaacattcttgtacatgtgttttagtagacatgcgcactaatattttttgcatctatacctaggagtgaaattattgtcatagagtagatgaaatttgtagtttttatcaactgtagaagataaggccaaacacattttcaaagtggctatactaatttatattaccaccagcagtatatgagaattccagttgcaccacattcctgccaatacttgctattatccattgtattaattttagccattctggtggtggtagtggcatttcattggggtttaaatttgagtagtgttgagcaagtttatatatgcttactgcccatttggatattctcctttatcaaggatctatcaagtctcttgcccataaatgaacaaaagacttcgtcttttccctattaagttttaaagtatttctggataccgtatgagtatattttggatacagtatattctaaattcaataattttgcctggatgtatatatcttctcccaactcatgaattacattttcactcttttgtgatatctttaggtgaacagaagtttttaattttaaagaagtccaattaattgtttcccctagtgtcctgctaacgaagcctttgcttactccagtttcctgacgatacattcctatgtattcttctagaaactttattgtttagtgtgacacaattttaaggacataatcttttttttttttgctttatacatttatttaggttttttttaaattatactttaagttatgggttacatgtgcagaatgtgcagttttcttacataggtatacatgtgccatggtggttttcacccatcaactcgtcacctacattaggtatttctcctaatgttattcctcccccagcccccacaccccgcaggctccagtgtgtgatgttccgctccctgtgtccatgtgttctcattgttcagctcccacttatgagtgagaacatgcggtgtttggttttctgatcttgtgatagtttgctgagaatgatggtttccagcttcatccatgtccctgcaaaggacatgaactcatcttaaggatgtaatctttagagctgaatcttgctttcaggccccagctttccaacttaccagatgaatgaccctgatcaagtaactttgaacttcagtgtctttatgtataaataaggtaaaaactacctaataaatttctggtgagaatgaaacaagatatacttgcaaaacatctagtacagaggagactctcagaaaatttagttattgccctcttttccattctactgcataaaagctagcaatacttaggagcactggtctcttgcattcaaaatattaataaattaaacatttatttatactagcatcttctcttagaggggcacaatgaagacacaaaagtatggttctcttagttgaagagacaatgacaacaagagaggagtgaaataacaacacaaaagttaagtgatgattaaaaaccccacagggaagcaaaggataaattgctaaataggtgaacattgtcataaacatttagagaggaagagttgtttcaattcacagcaacaaaggagattttccatgggttggtgatggtttcggtcaggatgtaaatagcatttgtacaaagagggaaaaacctcagatgaggtctatgaatgtgagcaagaaaacacattgcatttatagggggcacttttctagttggctggagtgaaagatttgcttagatgaagattgggagataattctatgagttggttaattcattaattcaataaattaatatattaagcagctagtatgtgcccatctctatgttgcttggtttccccaactatgtcctctttacttccctgatatatgtatgtgtacatatgtatctacacatatatacatatatgaacagtatgtcctcactaatattaccagtagattcttggaaactgactttaagtgaaacaacatataaacaaaaccaattttttttctcgtcaacatgataaaacattacattgaaggaaatgatattattgaaggacctactatacgttgttttgcttaaagttccagtttctaagaacctatcaacaacattaagtgaggacttacatagacaaattattttaccttttattttttacagagaatagatagaaatcaaatgccatattatcttacagaagctaaggaaaaagcagtttaagaagatgagctccatggtattcaatcctcagagagcaagtacagtaaggactgagtgaaggacattgggtcctcaacatcagaaaactctgtgaaggatacatttattttgtctcaggaatgaaaatcaggttgcaggaagtgaaaaagagagctggcaggaaaggaatggaggtgggaaggatggagggctggttgctctgctgcctttatacctgtgggttaggtcagtttgcatcttaggccatggatttcccagcccatggattaggaagaatagccttgtatcacggagaaggtgcactctgcaagcatgtccacatactaagaagggtgttactccggggtccacggggactcattaccgaacagccatcttccattttctgtgaataggtggcctttggacaaaattcttctgtaagcttcagtttcctgatttataagaaaagtttttggttttttcttaaaaacgtttttcctcctcttaggattgctgaatggcttgaattaaatagtgtatataaagtaacatagtgccagaaaaagtaaatgctatattagtccccttcccttttaagaaaaaattctgtggacaagaaagaaggaatgttatacagagaatgagacagagatagacactgagaaaaatacaaacagacactcatagaaatgcacacgaagagggagaaacagacaaaggagagagtcagaaggagacagggacaaatacagagacagacaggcggagaaagagaaagagaaagacaggttgttttaactcatccctcccacagaaagatatatcggtatgtagaagtttgtgtagtgatttagaagccctatgtgaagagcataggcggcatatacttttcaaaggtaacatttatcccattttacccatggcttataaaacctcactggctatgcagaaagcaggtctttccagggcacattcgtttcattgtgcagccctcttaggaagtcctcttaggaaaccctgtatcatggagatggtctttgggttccctaaagtgtttgccatttcctgctaaattgaattctagtgtatacagcaaggtccccctccaacagcaatgttcattgtcttgtacaactgcaaatcaaaattgagtccaaagtgttaccaagttccctgagcttagagcttgaagtaactctccaggctgtcctcctcatcaatcacccttagggtggtttctctgatttaacatgtatcttttatgcatgagcaaaacgagtaactgagaatggggggaaattgtttagccagcagcacagtggccaatgtgcgggagtgagaaattaggctcagaaacggtcaatgtcctttgggctttcttgctcccatctataccactgaaaattaaatcttaatgttgggaaaactcattatttttaccactgagaagttgttagggtcctcagtgaaatctagttcactggttcggggaagctcagcacacagtgggaggttttgcctttttaaaaatttttataccatttttatcctaatcataaaaaatacacattacaaaaagttggaaaatagtggttagaaaattaacttcacttcatcatcataacacttgaaaataacctcacttaacatttggttgtatttccttccagatattttttccttctcaaaattaggatcatattttatatacttttttatatgctgatttttttcagatagtattttttggtgaggatttttctgtctttacataatcttcaaaaaacattatttaatatttcttagtgtgagtgttccataatatatttagctaatgctgtattgttcaaaatcctgttatttgtaagtttactaaaaagagtgtgtagtcagcagctatttacataaatctttgtcttccttggttcatggtaacttccctggggtatccacttatctttcctttaaagaagcccagatcatcagataatctacatagatctgtaacccagttttacaccacgttccagttcatctcatgtaggggtgtgggcagaatttattttaatttctctgaatgttctgtgagagttagactgctggtctacctagaatgcataaaaaacccttaggtttaggacaaagaggaacctacattaacttaaagatgctgtatttacagaaaaaaatagttatattctatttacctattttaaaattttcattttacatttaacttttaaatctatccaggatgtatattatgacaaatataataatttttgttacaattagccaattttcttagtaattgttaaatagtccacttctttgctgtagattttgatatttacaccgttatatcttatacaaaaatatgctagggaatatttcagcatcatcaatgctgtttaattgatctgtcaattacttatcaatacctcatcatattagttattataactttataaagttttgatatctctgcaagtaagtctttttaaaaaatcttgtttgttcttccatgtaattttggaaacagttttaagttactgaagaatcccttaatgttactgaattaggatttcattaaaactacatctatttaagaattgacgcctacttggcctatcacttttgaactatgaagattctcactgatctctatcttactgatttatctatcttactcttcccttctgaggttgcttttttctagctaatttttaaaaacacgtttacagttacttaataacttgtttgtttacaactatacctatttttccttgcctattttaaaatcatggcttcttttaagcatactggaaaaactactgagaatacgtgaaatactaataactcatcattctaaaatagcaaatattaacattttgccatatttgtttctgatattttcaaataaataaaattttagtaatctgtgtatcctttccaaattgtattccccatctctcccttcttctcaagatagagaaccaatttctccaagttaatatgtatccatggttttataactttaccacatatgcatgcatgcataaaatttatagttttgagagttttaaaatatgtatattataaatgtcatataaaatatatatacatttcatattatcactgttctattgtttactagctattgttgttaatgtcttacaatgcctaatttgtaaattaaactttatcataagtgtctacgtatagagggaaaaaaaaaacagtataaatagtcaccagctatctgagacttcaggcatccactgaggttcttggaacataatcccctgcagagaaggcaggaatactgtaacacaaaagagagttgatgtgaatttaatgagtcaatacatatataaaatgcttagaacagtgccttcctataaaagctatttaaatgttagctatttttatttcttctcttggctaacttttggctgctaagaaaaccttggaatccaactcaagtccaagacctaatgccagcccacccttggtccctgtggtgacactttcacacattgtacactcaccaagaccagcatcttttcattgaacaccatagtaagtgtacacatagtgacacaaaaactcagttaaggtcaatattggtgtatttcttgcacacttctgtaatcttcctatcctatctttttgaccttgaaaattagagtacaacatttgcatcagtagcatgtggaacgttttctgtgtctggttttgcccatcttttgaaattcgtgattacatgatcctgcctgttccaaaggaagtagaattgtagcactgtggagcattagcctaatgatggaattgcttactttctaaacaaagcataatctgtgaaacctggccaccatgatgaaagcattttattgacagatttgtatataatctatagtgtatttttcacttttgtgcttggtaattttttcttttctgaaagttaaggatgttgtagctcttacaaatggcatctgcctcacctgtgattttaaaaagtgtaagggtttttttcttttcatttcttgcttttgtaatcatatgctggcatgtaacatttataacaaaaacacagtgttcttggcattctcagaaatttgagaaaacctattgtttgagggggaaaatgcctattttgaagtgcattttcctttgttccttgaaagattaacttttagagggggatctcaaggaaagcagttcctattggttcattcttttcatttgtaataatctgtctttgatgtacaaagtgagtagatcttgaggttatgtggtagagtgctggaggtgaataatggaagaacaaaaggtgcttactgtaacttgtgacccaggagcttgccaaactgttcttccactcaattttcctatacagggtgcacatactcctctagagtcacttttctataagccaacaagacagaatctcattgttacacatttcttaggtagaatgactgcatgtgatatttaaaaactttggagtttgctgactactgaactaattatcctaaataactgaattcagatgttctgtttagctgacaactaattcttccttttatgactttttttttaaactttttttaagttcaagggtacatgtgcaggtttgttacataggtaaacttgtgtcaagagggcttgttttacagattatttcatcacccaggtggtaagcctagaacccatttgttgtttttcctgatcctctcccttttccccaccctccatcctccaataggccccagtgcatgttgttccctgctatgtgtccatgtgctctcatcatttagctcccacttgtgaaaacatgtggtatttggtgttctggtcctatgactaaggataatggccttcagctccttttaaaatccttttgtatgtagttgatagagcagcaatttggtcaccagagacctcatagtgttggcttctaccgttaactcttctgaaagtttttattcctctaggactctgtttccccatctgataaataaggggggcataaaacactgtcttaaatctccctttcacatgtataattctatgttgtattttcatttttctgaacatgctgtttcatatttaggagaaaattaaatgtaattaaataatttctgtataagataattacaacttattatattcaatatgttgtaatacaactcattccggcagctattctcactgtatagaacagaattgaagacagcatagggagtcatgttgaatatttgctgttgaagaaaagttattcagggaagaaggaaccattctccataccttctaccactgaacctttaatttctctaatcttactttcttgacatttgcctctttttgtctagcatttaaatacaaggaaaggggccaggtgcggtggctcacatctgtaaccccagcactttgggaggccaaggcaggaggatcacctcaggtgaggagtttgagaccagtctggccaacatggcaaaactctgtctctactaaaaatatgaaaaattagccgggtgtggtggcacacgcctataatcccagctactcaggaggctgaggcaagagaatcacttgaatccaggaggcggaggttgcagtgagacgacatcaggccactgccctccagcctgggcaacaaagcaagactttgtctcaaaaattaattaattaattaattacaagaaaaggtatctgggtcatcaggtttctagtaattgtgtcttctgtagccaattgagttgtttgtattgacttattggctggcaaatggtgagtaagaaagcaggggaaagagataggttgtaggaggattgagagaaggtgcacattcttgatttcatttaggcaacaaacacacaagacaaaatatgggtcaatatgtggataatctggtagaaacctaaatgccctacaacagagtcttcaaaatggctaaagctgcatgtggaaaagactgctaagtgtagagatgatcacataatttatcatctaaactgggacatctttgagaccccattttataacaatattgggacaacaaatgcaaatagaatattctagacaaattagaagttataaccactctggctgcatgttctccaaaaaatatttactcctcttcttggtccattttaagggagtggaaaactttcaaattctcttcagtgtcattgtgtgtgagggattctacaagacttccctcagttctatccaatccaacaccactgtgtagtccacagctggactacatttccctagcctccttttacatttagttgtattaaagaggccaagttctagtcaatgaaatgtgggcagaagtagtgaatattatttctaggtttaagccaggaaaacaacttttgaaaaatcctccacgcttttttccattctggcttgacctacacagcatagcggcctttgaagtcttgtattgcagatagcagagccacaggacagaagaaacctgggccctgacttggagagctatatgccaatcaggaaaaccagtttggaaatttatatgtatgagaaataaacttgtactatgccattgagattttagagtttgcctgttctcgcaggtaaactagcattgtcaacactatcattatcttaatttgtatattgcatacactttagcctagaatatattaaagacatccccttatttctcattgcactgtaaaccactccaaaataaagacctagaatgagtatgcaaacataatgagtatgttctaaatattaatattttctggatttgattgaattgaatcatatcgaattggactgaaatgaaataaattgtatacaatatggtaagaaacttcagagattataatagagctttcttttatctggagaaaccacggaaggtttttagaaggtagtgtttgagcaaacacttgaaatattggtttactttggatatacagtaaagaatatgatattccagtaaaagtaaatagtgtgaacacatggcaaacatcaccaagagcagatagttcagtctgactagggttggtcagtgagaaacaaatgtctaaatttacttcagtccaaatacatttacagggcacctattctgacaggaggacaatctcatgaagaggttatttaagaaaaatatatatgttataagtaaatgtatataataaatgccatgagagcacagagaaaagatgcccaaaggagataggatgagttttggaaaacagataagttaaccacaccatacagtttgttgaaagtttcattggaacacttgcacattatcgtgtaaccaatagggagtcattgaagggctttgcagagagacttgaaagatggtcaatgagtttggacctggctgtgtaaatagctggtaaatgagcttcataggaagactctgtgcatgtctttcactacccctcaaaagtgaaagacgacatggacacagtgctgctgtaaacaggaaacataatcatgcaggaggtgtgaagaccacagcagggagcatggatggacataggagtccagttattaggccactataattggccatttaagtaatcactgagggcctttgtctaggatctgtgtctaggcagtagaaatgtgaaggaaagaatggattagagctatagcagaagtagagtcaatgtcttcactccatgggtattgaaggcaagtgtgtatcagctaggattagtttcagctatgagtgatggataagtctaaataagatggagatttatttatatcttataaatgtaggccatgcagggatcccagctctttctatcttgatgctgaaaataaggcatttgcatgatggttcaggatggctatttgaagtctagctatgatgtccacatcccggcttgctggaagaggtgaggagaggcatagcattttcttttagcacttcctggaactcttatacattttctaacatctcattaaccagaacttattcacatgtccacacctacctacaaaggagatatggctaatatagtctgtattctgtgatgtcttactaaaaccagagttttccttgttaaggaagaaggggaaataaatattgggagatttagtagcactatttttgccacaggggcagaagacagttgtgatcatgaggtcctggaaaatagcagtattctaattagtaggctgctgaaaagcttgcatggaactggaataaaaaatccaggtggggaatataaatttgagaatcatcctcattgaagtagtagctgagatagggatggtcctcaaatctcctcagatacaactctccagacaattcaagttccaaattttagtttggtcttggttatttatataatgaaactccagtttggcttgtggaaagcccagatatggtcataattcactggctctaccacttataagtatgtgacagcacctgtcatatagtgcatgctcagcaaatgctgtgtggatcagaatcagaatgaaggacaaaactatgttgagctatgatatacataaaaaataaatctgccctggccttttcctatggtttgcatgtggctttatgtcccaccatggcaaattgacttaataggtcattttgcctacttttctaccgggcattgggctttctctgggctttgtcccagcgaagaccacatgtttcctgcatgagttccctgaatcagtttttttcctgctgcaagtcttatattctgttccccaagtttcttcagtgactgtactttgactcacaaatggcacgaatgtcctcagaggctctttaagtcttttttcagtcagggagggctatcttttttcttccacaagttggctcacaatttagaggagttttcttggtaactaaaaatagactaccattcaatctgcagtcacagtattgggtatctactctaaaaaagaaataattacatcagaaagataactgaattcatatgtttatagcagtactgttcacaatagcaaagatatggaatcaacataagtctctatcaatgggtaagtgcgtaaagaaaatggggtatatccataccgtggaatactactcagccataaaaaagaatgaaatcacatcttttgcagcaacatggatggaactgaagaccattagcttaagtgaaataactcagaaacagaaagtcaaatatcacaaatacttataagtgagagctataagctataaatgtatacacatggacatagtggaataatagacattggagacttggaagggtgggagagtgagggggatgagggatgggaaattccttaaggagtataatatacccattaaggtgagggttacactaaaagcctagacttcaccactaagcaatatatctgtatttaaaaaactgcatttgtactttttaaatttatacaaataaacattttttaaaaagagatgaaataattcgcccaaagtgacacaattagtagcaaatttgtgatttaaccccagggtgccatgtattttccatcatttcacactgcctcccaaaccaacaattctgctggatttctttcttttcgttgcatttagccttgctgaattcaagcttaagagagatacaaggagattttagtctcattcagagatttcagctgtaatagaaagttttatgtgacatgagattaaccccacaattgactgacccattgattttaggaattaccagtagtttatttccaattgtagtttaaaaatggagttattagtatgctcctagcattctgaatatagcacatacacattttccttattgctatgatttatgggaggctgcatgaacctaggcatggacttgtactcttgggatctgaagtttcatccatctgtttaaaaacataaatacactctactacaaaaaggagctacaatatttacagagaataaatctatacctgattccaaacagataaataatagtaaaaatatggaatagatttctatgaaatgtccatctcatgagctgatgacagaacagattcattcattagactaatgatgcttcttaagttgcctatttgtcagaagtcaaaattatatttaaatggttagcattattttattatgtagttatcctgaaagtaccaccagaattttcctttgagaaataataatttatacttttgtggcaatgcagattgttataacattttttacaaagtaactcaacatatatacttctgtcccttgactgtgattttggctcactgtgctaaagaaaggtctaaaagaggatgagtgagggaagctttgtacctgagaaggttaagtgcagtattcaaacaactagataaccaatagggaaggaataattggtaaattatggcatagctactaaaataactagtatctgtacattaaaaataagaatgaaaaaacaagacgtaatgtttggtgaaagaagcaaaattatagttaccctcttaaaattacagagattagaggtaatctttttgtcccttttcttttgtgttccactattattgagttacactcttctttgaattctaaggaccttttatcattaaacttattccaaggaaatcatagagggtagtcatcagagtgaatatttctataaaacttgtaaataacatttataaatggaggttcacatgtcattctccctttcctagatttattaagcaaatatttgtcaaacactgtgccagtgtacctacgatatgtgttgcattatggaagacaaagcacaacatttttacccttgagacagctttaatttagtcagggagagagaagtaatagcaaaatatatgttaaaaatatacaaagaaagtgttgcagccatgaggagactgaagatgctcccaaattactcccttagtctccctggtcatctcagtaactgtcaacatctagtcactcagactaaaaagggtgggagttttccttgagagaagtcttcaacttctctcatccagttcattaccaagtcttatccatgcttcatctaaatctttttttttttttttttttttgagacggagtctcgctctgtcgcccaggctggagtgcagtggcgggatctcggctcactgcaagctccgcctcccaggttaacgccattctcctgcctcagcctcccaagtagctgggactacaggcgcccaccactacgcccggctaattttttgtatttttagtagagacggggtttcaccgttttagccgggatggtctcgatctcctgacctcgtgatccgcccgcctcggcctcccaaagtgctgggactacaggcgtgagccaccgcgcccggccgcttcatctaaatcttatgatgttctattttcaccagcactgccctagttgaagccaccaccacctttctcttgggccgctacttacattgtccggcctcatttttagcctgcctctcccctgtatctactattatcacacctattggccacttttagttttcttaaagaagccaaacttatttctgccaactttcagtctttgaatccacctgaaatactaccactgctgatcttcatgaagccaattatttttatttaaatctctgattaagtgtcataatttcagagaccatcactgtcatacaatctcatatgttcttctagtcactttactacctcaccctctatatcacagagtacttttctccaatttttcttatatatttgaattcagttctttccttttctctgtctccctcccggagaatgtattaggtttacacaaaagtgattgtgggttttgctgttaatggttttgccattacttaacagcaaaacccacaattacttttgcgcccacctaataacttcatggaaaacaggaactttgtaccctcaatgcttagaatacttactgacaatcataggtactcactagatgtttcttgaattaacaggaatggcaaatgaggaatagacactaaagttctgaaattcagggaagttagggattacagtagagttggaatgatcagtacacctttcttgaaaggagtgtaaattggagaggctttgagaattgagtaagaccaggtcaagaaaaagtagacaaagaaggaatttcggggggaaaaagggcagagtgaaggtgtggagagagtaataaacgtggtatacctggggacagcaggaagaatgactcttgtaaattttatgagaaatgatattaaatgtgtggtaaacccaaattgcagaaattctagaatactaggctgagaattagccataatagggactttcctcctgatgattttcaagtctagttacctttgagcttctctctatttattttaatatttatttatttatttatttatttatttatttatttatttatttatttttgagatggagtctcgctctgtcacccaggctggagtgcagtggtgcaatctcggctcactgcaagctccgcctccctggttcatgccattctcctgcctcagcctcccgagtagctgggactacaggcgccggccaccaagcccagctaattttttgtatttttggtagagacggggttttgccgtgttaaccaggatggtctctatcccctgacctcgtgatgcgcccaccttggcctcccaaagtgctgggattagtggcgtgagccactgcgcctggccttgaacttcttaaaaatagtatcatgctaagcattttagatgaaagtaatacgggctacccgccatcaatatttttttcttatctcccaacacaaatataattttgtcagcttgcttaggtctggtccaacacgcaaggtgattctaggtcatacccatcttctctctttggaaatagtcactttgtcacccattaaccagttcaattctcaatgttctgagtgtcctgtctagtttgtatggcaagtggggttttcacataggatggagagatagaaatgagtttcatcctgtcttgcgaattcaggaaaagcaaagaaagacagagatgtaaatagttccaggtatgacacatcttcccctttgcttttaaatgaaacacattgtgctaaataaaagtgggtttgctaaggctttgatttccctaggcagggtgtcagctcctggtactcttccatctgtcaagcacgtgtgggcttgtcaaccaacttgaaaccacttttgtccacattcccactgaccacaaatataggcgtcacacccacaagtctttggatagagactaaaacctcccaaggattgtgtgagctggactgcaagttggtataatatacaacttcactaccacgtttatcaggcattcacccaatatttttctggcacttattatgtactaagcttttgcataaataatggaattttttttttttttttgacggagtctcgctctgtcccccaggctggggtgcagtggtgtgatctctgctcactacaacctccgtctcccgggttgaagcgattctcctgcctcagcctcccaagtagctgggattacaggaatgtactaccacaccctgctaatttttgtttgtgtttttgttttttgagacggagtttcgctctgtcgcccaggctggagtgcagtggtgcaatctcggctcactgcaagctccgcctccccggttcacgccattctcctgtcttggcctcccgagtagctgggactacaggtgcccgccacagcgcccggctaattttttatatttttagtagagacggggtttccccgtgtgagccaggatggtctcgatctcctgacctcgtgatccgcgtgccccggcctcccagagtgctgggattacaggagtaagccaccacacccggccaaataatggaattttaaaataagatatattctctgacctcaggaaggttacggttaggtggaaatgaatgatatggaaacagatagtgtggggcactatctaaatgttagaatgtaggaccacacataatacagagagtgcacagaagaaaaataccttccgggtgttgtaaaagtcaaccacctgaggaagggcattatccccgttagtctagtgagtgccatgcagctcaatggggcagtcatttatgtttcttctgacgatccatgcacttctcaatgttcctgcttcccacttagaacacaaaattggccatgcaaggaaagaagtgatgtcatggatatgcatccaatgttagaagtacttttttaccttccaacttatgttgtttcctggtcagtagacttggtaccttcctccttgaattacctcctccagtggagaaatgcaatttctgagggaaacaaccattcagggcttctaccattacattaaaatgaagtaaccatagcagtgtatgtactctgcctctcctctatatctggcttcatctttgctagttgtagaccacttggcacaggtataattgtactgacccagggcttggaagcttatttttgcaatgtatgtgcttatggtttggtatgttttgactgatggtggagttttattaagcaacatcccttccccaactggatccctttgtgagggctcttctgttccctattgcaccatttccttccctacctcaactgtgctatctcagatgttgcttttaagtcttgtttcccaccaggtcaagagaccactgtaatttccaaatggaggtatttcgcagttatgttttctctgaacctaagttagttaaattagttgacttggagcagtaagctctgttaatgatagggatctactcacaggccagatcacatcatctttgggaagttttagtctggatccaaagacttgttggtgtgatgcctgtatttgtggtcagtgggtatatgaacataattttttaagttggttggcaggcccatacttgcttgagagagtttatggacttgtgggaagaacaaaaggggatcaagatattgttcaggtctttattgactggtttgaaaaacccagcatgggttgtaggccttgtttatataaagctccaccagctttggtggtttagcccaatggaaatcgggtggagagagggaaatattcaattttatgtagatgctggtgaccaatttcagatctggaaaagatttagtatgatagataccttctgcagtacatactgatcagatatcaggcacatgtaattagaaacccatatatttcaacattctgattttttttttttttttgtaaagtagctcacttctgaacatttaagtaagaaacagaactggataacaaaaatcttttagatccaagacagaactgagcaaactatggcctacagatcaaatccagctctttgttttcataaataaaattgtactggcacacagctacacccctgcatattgtatacagctgtttttgtgctacaatggcaaagtggagcagttggcacagaaatagtatgggcttcaaagcctaaaacatgtattatgtcgccctttatggaaaaaatttgctgacctctgttttaagaccccaacctcttacaagtgaggttcccttctctgtgcaagaagggatcaccaaaagcctctgttccatccagaaagttgcaaaacactttgctctttcttcatccccaacgatgacttcttcagctatcccattcattcagaagtagaattatgtaagataattctgctcacttgtataagaagccattggagcaatgaacattgtctctcaaaattctgagattcagagtttcctttggaaaatcatcagttctcaaactgccacagtgaaaaataaaccaagaataaaactgaaatagatttttccttgctatgtatatcttttcctctggcagtgatgacaatttttattgtcaacacaatttttttaattagacacctggatttttcccaggggctggttgcacattaaaaaattctgatccatacctaggcaaagaggagcatagaatgctgtaaaagctcaggcggctctctgttcacctgtttgctctgaggaattctcaatcagctcttcactcacttcaaatcacatgtaaacaacaacaagatgactaccaaggatctggtgggaggcgttaaaataagaatcctgtatttctctaggagatccatctataataaacttcttgtagtactgtggcagaactttaagtgaggtacctttttaaatgtgccatcctgtctttctaaattaccaaacagtatgaggccagcctgagcatccaagggaatttgaaaacattacataaatcatctttattttcttctagtctgcagccattaaattttgtaattgatagacatcaaatgggctcttccagctgattgatttttggagggtgaatttggttcttcacaatgcacatcaaagacagctaacaggagctctgcagttctactattacaataggctttattcagatggtctgattgtcttattacctgctaaaatcttacatagttctgcttctgaatggatgtgatagccaaagaagcaatgattggagatgaagaaagagcaaagtgttttgcaactttctggatggaacagaagcttttggtgataatcttgtcagtgccaatactcttacttacccaggggcttctttcttcttccttctagatagatgtttcttaaattgatatttcagttcgactgataggttgtccttagaggggagtgtggaagatatgcacatgtaagaagagagataaaaagagggactaggaatgcatctaaaaatctgagaacctagtcatcttactcaggttttattagagttagctttcccttttttgccgtcttgacaacatgcatgtatgctttctcttttttccttactgctttatcccttgtagaaatgaaagtttcttaatgatatggtcaaatggcaggaaagagtagaaaaaatatttgaacatataatggggtaatggggtggcaaatgtattccatatgacactacaattcagatagatggggaaagatgtatcttttgtctacttagacaaagcgctatcctctagtgttcaacataatgtttcattttatcctcttttagcacatgtaagtactataaatagcacctttaggtcagtgactgtcaatagggatgtcaccgtttctgggggaatattttggaaatgggtgagggcacttaagattgttataatgaaagagtggcaattagcaacaactaaagggggacagagatgctatgctctgcaacatattagatagttagaaacaacgataaattatcccatgtcccaacagacattcaagtgattggaaaaactgttttatttatttgaccctccaatcaaactccattttgcatatacacacaaagcatgtcttacaaagttttattatacctggttctttagcaatgcaaagatcatgtaaatcaagagaaggtggtacttaattgtgttctaatctttcccaagagttcactattttggaaaaccacataccattgagagaaatgccacttgtggattctggaatctctaatataatatgaagttgttatttgtgtctgtgttaattaagcatccaacttcttcattttatcttcttctagtgcaccatgcccaggtatttacatattgaaatatataatattttgttttacattatgttccttgtatttcccccttgtattatagttaaagcactatattgattatattgattgtttttccttttgaaattatgtatgtaaattagcactcaacaaattttttcagtaaagagccatggaggaaacattttaggctttgtgggccaaatggtctctgtcataactattccactctgccattgtagtgagaaagcaactctagagactatgtaaataaatatgtttggctatttggcaataaaacattatggacactgaaatttgaatgtaatataattttaacatgtcaaaacatttttttcaacccttttttttcaaccatttaaaaatgtaaattcatttttagctcttgtgcagtacagaaacaggcaatgggccatatttggctagcaggcacaagttttccaatctctgttctagtgtatcatactcaagcattttcacattgaaatatatattattataaattacatttcttttatttatagttaaagcactacattaaatttttaaagtgatgtgtaaacactgtaaaaatttttttgtaaaataattaggtaaaaagcttaatgtaacaaaatttgagtgctaagtgtatatttatttggggtaatgaaacacatgcaagataatgcagcttccccaatgactgtctcgtagaataaagagagaaggctggatttatggtttaaattgtttgatgacagtcagtaatcctgactggataaaacttggtgtgagtttttataaaactctgaagtttttgcctgttgtaaggaaaaccagtcctggcttatctctgatgcaaaactgttaggtgatgtttatagttcaatgcttttaagatcttagaaacatgcatttttcccaggcttgagacattttacatgtctagcagagctaggctgaagtttagagaattatcaggtttggggtttggttttcttgttgttgttttttagtaggttgtactgtccgtgaattttatttaattatactcaaggtgagcattacaaagtagttgtttcataagagggccattagatatctgatctcacaggtttctaagcctttgggattctcctctggctcctatgatgactgtctaacgaattgggggagaaggagggtgagtcaggcaataccaagacccagaggaagaatcagaaccctttctgaactctagagaaatgttgtctacccacttggggaattttgcagccatatccaaaccttgatttggtttcttggcttggtcgggtctaaagacctcctggctgacttcaaatctccttgtctttccctggtgctgcaaattcccagagtctcagttgaatcttccgcctgactccctggttggacagaacctttctggcttctgctttgaggtgacttcctcctttgcctgctgtcccagagcagatgcattggcttccaactcagctgacctcgggatcttcctcaagggctatggaaatgtctgaactctatccacaccacaggggcaataagaataccaggaaatccaggatacttttgtgtgtccatgcctgagatttgtgctgggcaaatttaaaggtgttattttttccagagtcttaaataagctctttgtctctcttttatttgtttttaaagtcccctaagcccactgtcagttccagaaggagtgggcttcagtttcactcatcctatgtcagaaaatctccttcaaccacaaagatacaagcctcagggctcttaatatcataggaagaaaaagtatcttcactatactataagaagagacttgaagctaaacagtccaagcttatctggaaactagagaaatctagtaaatcttctctctatacaaagccttgcattcaaacccattgtcttatacccattctttctaactcagaatgatgagtcttttccctagaactttgaagaggaaggctggaaaaaaacccccaccagatttaaagaagaaaagaaaaaagttaagatttaacattaatagtagccaaattacaaatatgattgattcacttattttcttccaatgtgtctgggaattgaaatatgaatgtagtttaataaagggataagcataaatttatgtatcatgtatactttggggtttgtgtgcatgtgtaatggcattgccccaattcacttgtcaactgtcatgaattcaagggtttccctgaggtcatgtcagcatgagcttacagatctccacgatattttccaatatcttgagccctctgccctttttgcctgtgatgtcaaaaacctccaccacagttatttatattcttgttttcattttcctgggacctaaggaaagctggctgggtatacctttcagccttccagactggctccctcagcaaacttcaatctctcccaaaacaagggttccatggacatacatggatgggatctgcctactgtctcctcagtttcagcaggagcactgtgtgtgtgttgtgtgtgtgtgtgtgtgtgtgtgtgtgtgtgtgtgtgtatggggaagatgatgaggacaggtagcaggggacttaaatacataattactatctctttaacatcaattaaaatatcagagaactttcaataaaaatgtttttatatttaccgatcaatgatctatttgaaaaaaaaaagggaagggagaaggaaggttctgttgtagtatgactttggggtagaaaagggttattttatggatattcacccttcttactcggacagccgggacacagtgcttctctgctatcatcttaatctctcttctttgcttttcctttagctcaacagaattcaccaaaaatccatgaaggctggtgggcatacaaggaggtggtccagggaagctttgttccaggtaagtacacattaattctttaatttatttattaaaaacaattagaatgaaggctagcattatttccaggattttacattgcaaaaggtgaggcagtctaatttatgtgtgcaatgaatactccatcaagacaaagtttgttaagtaacaggcaattagattacttttttttccatctgagcctgcagtctcaatgtccttcaatctataggatgccctcaggggcagggggatggatgattaagggccgaagctgtgtctgctgacatttggttaagtaaggaagagccatttcttaacattaatgaaacaggaactatgaaaagactgaccatggcaatggagctgctggaacacatgctgtcactttagcagcatccatggccagcacttagcacatcgcgccaagtatcagctaaaaataccaggtaaagtggatcttgtcagcatgcgggcagaggacagagaactgaatacagattaaagcaaggattatattatgactttcgttcagaagcaaggtggagggtccctgtgtctcctcccactactcttaccctcattatggtcctcttgcttttaatggtcctcttgcttttgctgctttagtaaagcgaggcaagagaaaaagcaagcaaaaggcaaggatagaagggaaggcaggtgacatatttcaaagtatttttaactgctcagatgtgagaataagaaataaagctctcagcaggagccagtgtgcaatctctactccggcactgaaagcagagggctggagatgtcagttgaggtctctgtagttggtggcaaatagaaagagcagagtcccaggtcacctcattcattcttggcttctatgtcttcttttcctgtccttctgtagagtctattacaccagctgtgcagagctaagcaagtcacaaaacccctctgagcatcattttttctcatttgtatgatggggcaattataagtactcgtgaggctttgcagttggaggaaagcaggcatggtaagggagagtgggtgacccaggaaaaagccaactggctgccaaatagcctcagaaatgaatattattaacttcataaatttactatggcacatctattctatggcccagtgaacatagaaaccgaacttgattaattcatctagaaatgaccaggtttctaatgatataacaatttcattggcacaagctatgttcatgtgaaacaatattgacaaatggcattcaatacttacaattgaggatgtcccttttaaagaaatagaatgtttacatacttttttcctaggaaatctgttatattcaagatatctcagaagttacatttataattatattcttgtaccttttgagtatggaattagagaaataaagggtattctctccaggtaataagaagtcttgctaagttagtacaacctgtaaagagaacatcctctgtagtgattgacatgcccatgggtagaactgggtggtcactgcaaaatgttgtgtgtctgcctcacatttttcgatgtttttttctctgttgtcacattctttctttaaagtgttcaaggccctattttgagttggttgttgcttctaagacaaccacaggaaataatttttattgtccccttacatgttgatataaaataacttttcctcactctcaaatttaattgagataatatatgtaaaccttactacatgggaagcagtaacgtgtgcaagtgtgatcatggcctctgaagtcagagttgatgggacttgagtctgggttctgtggtttcttgttggtaggactgtcagcaagttacctacccagctcagctccctgggttcttcatctgtaaaatggagataaggactaaatcagccttgtgaggtttgctgaggattaaattgcataatggaggtaatgtgtgtatgttcatgtctggtgcatgttgagtcagtatatgtcaattgttgttggtatctgcttgagggagacaattacaaactggatagtgtaataatgtgtgtaagggtttctcaagatgcctgaaacatgggggatgcttgaatttataaggtcaagggtttctacacagtggacaactaaaagatgacttcctcatcctctgaatttaacaggtctaaagccttttgtctttctggtagagaagattggtatctgatgattccactttctaaacttttgggaactccaactctgttgaaaaggataagagtcatgagaatttgtggattaagcaactgaacctggggctctaacatctgactccagatgacctactttatctgagtgggtacttgtggcaaacaatggaccccttacctcttattacttgactataaagttaagagtgttcttcaatttgttactgagatttttttcaggttatggatgtgtgaaataggagagaacttgatatgactgaactagttttatcgtcccataagttcctcactgaagtgtctagaaataatagtcagttggcataacagttgtgaatctgtgacttcaacaaagctgtggtggataaaaatatatgagctctataacaatggtgagtacaaggttaattcagcacgcaaatgccccactttggtcagttcaatagcatttatggagtacctaccttgtgctgagcaccaagtttgggcggttaataaacaggtaactcacacatgattcttactcaaaggtgagcctacagtctaaagaggaagataagccataaatccatgactcagggtaacaagggctccaacagggtttatacatgtaaaggaggcaacacagtattgggattctgcctgcctaagtgtttaacagatgttgtttacctgctcaaacctatgccttcctctgaccttacccacaactagagtctgtcttgcaggcagagccctgactatgcttgcacattcgccctccataccatcatatactcagggaaggagccccttaccagccccagagggttactcttggctgagatttataccaacaatggtgattctggtctctttcttctcagtaattggtttagacattgtgatggctaatttgatgtgtccatttggctaggtacgtacccagatattagaccaaacatgcctggatgttgttgggcaggtactttttaagaccagattaacatttgcatcagtaaactttgagtaaagcagattatctgtataatatgtgtgggccttatccaatgagttgaaggccttaagagaaaaagaccaatgtccccaaagaaaaagggagttctgcctccagaagccttaggccaggagcagcaatatcaacatttccctaggcctcctgcctatcggcttacgctgtagacatcatccttgccagccatcatgtgagccaatttcttaaataaatctctcactgtcaccccattctgttgattctctttctcaggagaacccagagtaatacattaatatagtcatgcatatgtgataaacagttctattcatgccatgtaaggagaagccttctgaataaacttgggtacaaaagacacactaagatggcaaaatggagagttgagaaaaacccatatcttctatggctcacttaagggttgaattcaccatggaactgcctcaccacttattgtgttaagtgacgtaacaaacttcttactgcttgagccactttgagtcagactttctgtcacttgcagcctaaagcagtcttccagggccaggcatctcactacaaggctaaaggaagaaaggaagttagaactgggtcttgacaaggttcaggagtactcaaagtggagaagggtggtaatgtgaggaatacttgacagcacaggcaaagagggattgtattagtccattttcatactgctttaaagaactgcctgagaccgggtaacttataaaggaaagaggtttaattgactcacagttaagtatggccgggaggcctcaggaaacttacaattatggcagaaggcaaagggaaagcaagataccttctttacaaggctgcaggaaggaaaagtgctgagtgaagggggaagagccccttacaaaaccatcagaccttgtaagaacttactatcatgagaacagcatgggagaaaccaccccaagatccaattacttcacctggtctctcctttgaaatgtggatattatggggattataattcaaaatgagatttaggtggggacacaaagcctaaacctaccgtaccactttgggtccctcccaatcctcatgtctctgacatttcaaaaccaatcctgcctacccaactgtcctgcaaagtcttaactcatttcagcattaactcaaaagtccacagtccaaagtctcatctaagacaaggccagccccttctgcctatgagcctgtaaaatcaaaagcaacttagttacttcctggatacaatgcaggtacaggcattgggtaaatagagccattccaaatgggagaaactggccaaaacaaatgggctacaagccccatgcaagtccaaaatccagcaaggcagtgaaatcttaaaggtccataatgatctcctttgactctgtgtatcacatccaggtcatgctgatgcaagaggtgggtagctctgcccctgtggctttgcaaggtacagtccacctcccagctgctttcacaggctggcattgagtgtccacagctttgccaggtgcatgttgcaagctattggtggatctaccattctggggtcaggaggatcttggtccttttctcacagctccactaggcagtgccccagtggggactctgtaggagttcgcaccccgcatttcccttccacactgccctagcagagtttctccatgagggctccccactgcagcaaacttctgcctggacattcaggtgtttccctacgtcatccaaaatctgggcagaggttcctaaacttcagttcttggcttctgtgcacccacaggcccaacaccacatgtaagccaccaaggcctggggcttgcaccctttgaagcaacagcatgagctatatgttggccctttttggccacagctggaatgcagggcaccaagcccagagactgcacaaagcagctaggccttgggcccagcccaggaaactactttctcttccaggcctctgggcatgtgatgggagggctgctgtaaagacctttgacatgccctggagacattttccccattgtcttggctattaaaatttggctccttatgcaaatctctgcagccagcttgaatttctcctcagaaaatgggtttttcttttctatcacatcatcaggctgcaaactttccaaacttttatgctctgcttcccttttaaacataagttccaatatcaaaccatctctttatgaatgtataaaattgaatacttttaagagcacccaagtcacatcttgaatggttttctgcttagaaatttcttctgccagataccctacatcatttctcttaagttcaaagctccacagatctctggggtggagcaaaatgccaccagtctccttgctaaagcatagcaagagtcacctttatacccgtttccaacaagtttttttatcttcatctgtgttaatctgttctcatgctgctaataaggacatacccaagactgggtaatttataaaggaaagaggtttaattgactcacagttccacatgactgagaaggtctcataatcatggctgaaggtgaaggagaagcaaagtcatgtcttacatggcagcaggcaaaagagcttgtgcagaggaactcccgtctataaaaccatcagatctcatgagactcattcactacaagaacagtatggtggaaactgcacccatgattcaattatctccacctggccctgccgttgacatgtggagattattacaattcaaggtgagatttgggtggggacccagccaaaccgtatcaccatctgagaccaccttagcctgctgtatttcattgtccatatcactatcagtattttgatcaaagccattcaacaagtctctaggaagttcccacatctttctgtcttcttctaagccctccaaaccattccaacctctgcctgttacccagttccaaagtcactttcacattttgggtatctttagagcagcaccccattctctgtgataccaatttactctattagtccgttttcatactgctataaagaactgcctgagactggttaatttataaagatatcaagtttaattgactcatagttcagcatggctggggaggcctcatgaaacttacaatcgtgttggaagaggaagcaagtcaccttcacagggcagcaggaaggagaagagctgagtgaaggaacaactggatgcgatgaaaactcactcactgtcaagagaactgcatgggagtaactgtccacatgattcaattatgtcccaccaggtccctcctacaacatatggggattatgtgaactacaattcaagatgagatttggctgggggcacagccaaaccatatcaatgggcaaaagcctggaagcttggaagagaatgttcactagtgcaagaagagctctgggaattaaggccttggagagcagcaggggcctgattatggagggccataccaactgggagtttggattttacctgaaaggaactagaagtttggattttaccctaaagaatcaaaggagagattgaaactcttacagaattcaaagtcagagaagagggccatatgagctaagataggagcagtgaggggcctagggatggttcagcttctagagttagggaccttatctcttcccaccacctattcctcgaggatatacctcaggccttccatgcaccaggggctcaatgtttgccaaacaaacttgggtcagaatagacagcaatattccttaaagaaaaagacaaaggcttgactcgggagacagagtgaaaggctgttcctcaacccttaaattgagttataaaataataatagtaacaaacacatcagtacaatctgtagtacatgctataaatggaaagtactcaaggttttaaaaagcctagtagaaatagtctggagatcaaggagagcctccttgtgtaatctaggagaagctaagctaaggaaggacgttgctagtgcagagtcatcttagaccagctgtttaaggcagaagcatgagcctcaagcgtgggcatgacatgtatgagaaatggaacaaaggtcactgtggccagagtgcaaagtgacaagtgcaaaatggttggagattggggtggtcaggggccagctcatagagggccttgtgggccacataaagtatttggatggagatcctggaaataaaggacaatagatagttttaagcactttactcttcctctgagatctgggaagcaggaatttctgaggaattagatcaccacttattcagcagcttaaaatcataatacagaattcctctgaatgattaatagaggaactcattgctgccatttctgatcagcattggacctagcaggctactttggctcaggacagcatcatctgttgcattctttaaaattgggtacaaatggtttacccaggtcaataaccctcccagcttgctattttccatccttttctttttgggtagttttaaaatctaaagattattggacaaggaaggtaattatacccaaccacctacaagttaccactgatgtctaattgtttatcaaaatgtccactttaaaaaaaaaaaaagtctcatgattaacaggtaaggagtgtaagctcttctttcttcacagtactcccaggaaagaaatctggctggttggtgagggttacttgctgatccaggatggccagcctggggctgtgcatgctcttcattccttaattcatggagtaagtggtacctgccttgattttttggttgctacttaagaattaccatttatttagtagtttaaaatgacacacatttgttatttcacagtttccttgggtcagaagtctggacatggcttaaatggatcctctactgagtcccataaggctgaaaaaggtgtcattctggctgcattctcatctgaagtcaagctcatgtgggtccttggcagaattcaattccatgcagttgtagggctgagacccttgtctcctatggcctgccactgctgaataagcagttcacaacacagtttgcatcttcaaggttggcaggaaagtgccttacttactttaaatctccctatcctgagaaggcctagactctcttttaaaggtcaagcctattcagtataacatgcctttttattaactgaaagtcaacggattaagaacgttattcacatctgcaaaatctgttcatctttgccagaaatggcagtctactcaaggaagtgaaattccattatactcagaaatctcactcatactagagggtgtgtacactatgaggtaggaatgttgggggctgtcttattccatttgtgtttccgtaaatgaatacctgaggctggataattcataaagaattttgagataaagagattcatttggctcatgattctacaggctggtgtacaagaagcatggcaccagcatctgcatctggtgagggcctcaggctgtttctactcatagtgcaagtggaaggggaggcagcatgtacaaagatcacatggtgagagaggaagcaagagatacagagaaattgccaggttctttttaacaagctcttacaggaaccaatagagcaataacttgctcattactataaaggtggtaccaagccattcataagggatctgcctctatgacccaaacacctctcattagaccccacctgcaacattgcgaatcaaatttcaacatgaggtttgaagggtcagatattcaaactgtagcattccacgcttgactctccatgcctcacatccttctcacattgcaaaatacaatcattctatcccaatggtcccgaaagtcttaacttgttctagcatctactcaaaagtcccaaatccaaaatctcatctgagactcaaggcaagttccttccacctatgagcctgtgaaatcaaaagcaattcatctacttataatatgcaatgtttgtataggcattaggtaaacattctcgttcacaaagacaaaaattggccaaaagaaaggggtaagcagtcttcatggaagtctaaaacccagcagggcagacattaaatcttaaagctccaaaataatcttctttgacccatgtcctgcatcctgggcatactgatatgagaagtgggctcccaagtccttggaaagccctgcccccacagtttttctgggtgcagcccacattgctgcttttacagtttggaatctaatacctgcagcatttccatgctagtgtggctcattgccagtggctatataattctggtgtctgaagtgtggtgctcctgttcccacagctcccctgggcactgccctagtagaggctccctgtaggagctccttccctgcagaaggcttctgcctgggcacccaggctttccaatacatcctctgaaatctacaggcttggcagcttccactgctcttgcattctaggagcctacagacttagcaccaagtggatgctgctgagatttatggcttgcaccctctggagcaccagctgaaatagtatgtggggttatttgtgcctcacctggagctggagcagcttgaatgttgagaaagcatatcaaagtggcttcggggtaactcgggcctgttccctgaaaccattttgttttcccaggcctgtgggcctatgatgggagggggctacaaagatttctgaaaaacctttttccaatttttttgactctttgcacctgactcccttttatccattttaatctctttaacaagtggttacccctcagcaccactggatttttctcctgaaaacattctttcctttcctgtcacattgctagactgtaaatttttcatgtttttatattctgctttccttttaattacaaattccacctttaggtaattcctttgctgccatatcttactgtaagctgttaaaagtagccacaccttagccagggatggtggtgggtgcctgtaatcccagctacttgggaggctggggcataagaatcacttgaacctgggaggcgaaggttgctgtgagccaagattgtgccactgcactccagcctgagcaacaaagcatgactccatctcaaaaaaaaaaaaaaaaaaaagtggccacaccacttcttgaaagctttgctttgcggcatatagtgaatttatgaggttttctccctcagaaattcagtatgtgaccaccccttccaagagacccacattcagtctccctttgataagccagtaagtttatccttcaatacatcccaattaagtgatagttaaagtaattgtattagtttcctatagctccatgtgctagtcctttttcacactgctataaggatactacccaagactgggtaatttataaacagaggaggtttaattgactcacagttccacatgcctggggaggcctcaagaaactcacaatcatggcggaaggtgaatgggaagcaaacaccttcttcacatggaggaaggagagagaagaagccagcaagagaggaaccagtgaacacttacaaaaccatgagatttcatgagaactcactatcatgagaacaacatgtggggaaactgcccccatgatccaatcacctcccactaggtctctcaacacctggtaattacaatttaagatgagatttgggtggggatacaaaggctaaccatatcagtcttataacaaattaccctaaagttagtagctagaaacaacagatttattatcttaccattttaaaagttggacacactaaaatcaaggtgtcactagggcagcctgcattatggaggctctgaggagaaatcaatcccttgccttctccaccttctagaagccacctgcattactcagtgcagggtcccttccttgcatggctccagcctgtgcttctgttatcacatatctttctctaactctgacccttctgcctcccacttttcagaatgtttgtgattgcatttggcccatctggataatctaggatgatctccccatcgtaagatccttgacataatcatatctgcaaaatatattttgccatataaggtaacacattcacaggtttggtggattagaatatggacattttgggaagaccattattctttttttcatacttacattatctccaaagctaatggaagcacaattaacccatcacatgaacatatgattttatagttgtcagtactggtttactcatgttacttcattcatcccttacaaaatttgcactcatactcccctttttccagatgagaaaacaaagcaaattagataaagttactatctaaatttccaatgcaggtcaacgtagaagcaggtttataaataagcacatttctaatccaatgctctttccactacaaatatgtataaatttgattaacaggtgatacttcttggatagacaatagtactgttctgcttatcttctagaaaaaaatgaactacaggcaaaaataaaaggctatatgccagattaatccactgaaaactcaacacaaatctatcttctctctagacatgatctagcatttggatatcatttattacattttagaaagcctttccaggtgtcatctttcaaaataatttttttattttgggatgactttagatttacagaaaagttatacagggagtttccatatactctttatccaaggtccctaatttaatgccttacattagcaatacatttgtcaaaactaagaaaccaacctggatacattactggtaaactaaactccagatttttttttaatatccgagtttttccactaaggtcctgtttctgttgcataatccaatttaggataccatattacatttagccttcatgtctctttcgtctcctctgggctgtgaaagtttctgaatcttttgatttttcatgactgacagttttgagaaatactggtgagctactttgtataaaattcctgaatttctgtgtgtttgatgcttttcttggttaatctgggattgtgagttttggggaaaggttccctggagatagagttccatttgcattacatcctatcagagggtacgtgatatcaacatgtgtttgtctcatttgtgacaacttataaaaagacacgtatttctatcaccaatcagtaaatgtggaagattcaacaaggctagagattgatctttagttgtagaacaaatgaatgatggagttggacctagaaccagatcacttgcattaacaggtagtatttctcgaattggactgtactccaaagcccctcctgatgtcttactttatgacatcaattgttttgctacaaaattgtatgtaaacctttgtgtttgagagtagaattttgtttcaagttatcttaagaataaaacttgcattttaatgagccctgtggcatattgaataactctctccattggaggtagtcagtcattaactgtgtaaggtcatatttcagccattgagttttcttttttttttttctttagcacttttttttttattatactttaagttctagggtacatgtgcacaatgtgcagttttgatacatatgtatacatgtgccatgttggtgggctgcacctgttaacttgtcatttacatttgatagatcttctaattcagccattgaattttcttgggcagggagtgtgtgtgtgggtgagcacaccagtattttgtgcccccggactttttgttatcaattgtcttcctcctttggataatagatgcagcaacgggttctggaaaatgctcagtggcttgtgtcttccactgaccaaacatgagatcttaggcaagtcacttagcatatcaggagcttgttttcctcacctatagaatcagggtattgagctgcatggtttccaaagaaccattccagctctgatatttttttgtgagcttgctaagattggtttggaagttatagttagcagcattaaggaatagaatattgatttcatccacaggataattttattatgttctcaatatcagtgtttgtaagtggaggcagtgatgcaagtctctctctctagatttctgatttttcatctctaagaggaagcaagcagaatttaatggatatattctctcagtatgagagggtgatgttacactgactcaccctcaattagaaatactttgttatttcttttccccaaaaatggggatgcatagtgtgtaaaatttactcagagcctgatgtgccagacactctgctagacactaggtatacaaatcagaataaatgacagctcctgatcttaagagctcgcagttgagtttagagacagacatgcaaattaagagttacagtttagcctaataaggcatgtgagacatgagtggtgggatccacacatgtggattggctgcagaaaaaagaaaacaactaaccctacctttggggtcagaaaaggctttgcagatgaaggcttctcttgacatagggcttaaaagatgaataggcatctgccaggtatgcaagatggaaaagatcattgctggtggattaaacatagtgaaatctgaactgctacttaataacagattgaaaacttcatgtaaccagtaagcagtcctatttatcatttcatttatgagagtccctattattaccacacttcagagctgcacggcagaaagcccactggacttagaaggtcatgctttggatcccactccattgtgttccaaccatttgatggacaataatgtttgaaaatcacctaatgtctcagagcctcagtttactcatttgtaaaatacagacaataagacaatgagaaatgtgtctcaaacatttttgtaaaaataaaattttgtattagagttagtcctgcatcatagactatgaaagtatacaaagatattacgatttttattattataattttgctttaggctatttaaagttgtataaaagcaacctgatcaattgtaccattactgagttcctgatccttctgagttccatctgatccagggaggcacgtgtaaggcttttcagtatgtgccaactacagcgtattgtacttaaagacactacctcatgtaagtgtatataaacctgcatatatatttcagcactgagagggtttgggtcacgttgcagccatccaatatgaagtactcctgttggataggcttttgtaccaatccttctcagaggttcatggctttcctagtcacaccaggaaatttctggccaatcaacacaagtggttctagctaatcaacctcttgagaaacactttggaacttcaggatctacacagtcagaagtgcacaaaggaaggaacatagggagtgttccatgctgggtgcaggcagtaacagcgtgcattgtctggagagaatttaataataataatgaaacccaccaaatgacctgctttttattatccccaggtgctggaaattgtaaaaatgccagtgataaaatactccacttcgaaaaaccttttgtgggtctaagctctaaacaattgctgtagttactgttgagttttaacaatacaatttacccttgagcaatgtggtgattagggatgctgacccccatgccgccaaaaatccatgtataactttgactcccccaaaactcaactactaagagcctatggttgaccggaagccttactgataacaaatagttcatcaacacgtattttatatatttattaaatactgtattcttacaataaacaaagctagagaaaataaaatgttattaagaaagtcataaggaaaagaaaatagatttactgttcattatgtggaagtggatcataataaagatcttcatccttgtcttcatgttgagtaggctgaggaggagggaaaagaggaagggttggttatgctgtttcagtggtggcagaggcagaagaggtagatagatggggaagcaggatgggcaggcaccctcagtgtaacttattgaaaataatctgtgtataagtcgacctacgtagctcacaccccatgttgttcaagggtcaattgcatgtttttgttactgattctctactatgcactgtattttacatagaatttgatgggggaaactctaattattcagttagcctccaacacagaggcattcagctacatgagttttgttccaagagaacatttcaaagggttccagattggtggagctactgtaggccaagtcgtgtctctaatcgctgttgtaccacatattcctgaatttcagcagttcatataaaataaacaatagcactatgattgtaaacacaaagaacagagcttgaattacatcaactatatcattctgtgtgactatttagagcttttatttgtacttgaaatcagatatagctttactgaagagcagtttagttatctgttgatactttgtaagggtaagtagtgctcactgggtggttgtatgataatgggattgtttacagaatacacagcaggatgctttaacctcaggttattcctttttgtcaagcagaagaaaatcaaagacaggaagactataactcccaaccaggaattctacttcttataactgcaaaagcatgacagggatatgcctgtggacacttataaaatgtagtttctataacagtcttaaaaaagataaactatatagcaaaggcttttatgcagcaagtatccagcatgggatgctcttactttgaaaatttcacaacactagcaagccagctcctctttcccagcccagcctcagttgaaggacccgttttgatgatcatggctgaggttagggggcttctttctccccaccaacccgcttcatgacttcttatgaatagacgccatggtgacttatgatttttgcattccaattccaaattgccctgcaagctgccttcttccctcactgaacagaattgggtcatcacttcctgccaaatgcccttgtcgcctttccaatcaccaatcaccagtgagtctcattttggacacctcctcttcctttctggaagagtgcatatttatagatttgagggttcctttgcagcccgctgtgcctgctcttcctcatgtcacctcctaaaaggtagacttccagagcctcttcatctgccatctcctcttctcacagcttccatcagtggtcacctgctttatgtgaactactacaaaatctcccaccctagttccagtcacttcccagttacaacctcatattccaagaatttggtcagctttacctccccatgtgatcacctgaaattcacagggtgtagctaatatcaattataaatacttttatgctttatttgaggctatctgccttattcttagagatatgatgggtttcccctgaaggatctttctaacactatatcagttgcccagaattatgcctcatttaaaagagttttatattcagacactgccattcttgcatttatttttactaggaaaatattacctttttatggctaattgggagaaaataacccttcatctcatctgtctgaaacggtatcagtaatatattattataggactttttataatatatcacacaataatatatcagtttcacaatacatttacagtcttgatttttaatcaggaatttggtgttatgacaactactttttcttgaatacattcttggagcctccaacatgctgttctaatatcaactgatggctttctaaccttgttttcagatatcacactaaatttgttttactgcctagattatttctattctttctcacatattgtggtatatatttaaattcactttatagttttggaaactccatatttaagttttgctttgttttttttttttttttcaccagaaggatatatgagtgatgagttttctgagtcctcaggtgtccaataaaaggtttgtcttcaccctcacactttactgacagttcatctggtaataaaattctagtgtcaaaattaccttctttccttaagatagtcctaggtgttactctattgccagcttgcaaagagtctcagataagtctaatgcttttgtagataaatgttccctaccagaccaggccttactggcttttttaggatatcatctttattcctgaagttcaaaaatgtcactgggatatatctaagtgtatatgtttgttaattatttgtgggaggcagagatttcttttcctgttttgtttcctgatctgtaaatgctaagaacaatgcctggcaaaaagtaagagctcagtaaatcttatcgactaaatgaatattcaagtcacttcctagaaaaattttcttctattatttctttgattatcttctcccatctgttacccctactctctcattctggatagtttttgcaacacatgggtctttaatgcctttttttctttccatttataatttccatatctatcgggggaaattcacccccgatatttcacgtaagttcttttctattttccctaagtgttggccagtctgagaaataagggaaagagtacaaaagagagaaattttaaagctgggtgtctgggggagacatcacatgtcggcaggttccgtgatgccccccaagccgcaaaaccagcaagtttttgttagtgattttcaaaaggggagggagtgtacaattagggtatgggtcacagagatcacatgttttacaaggtaacaaaatatcacaaggtaaatggaggcagggtgagatcacaggaccacaggaccagggcgaaattaaaattgctaatgaagtttcgggcacgcattgtcattgataacatcttatcaggagacagagtttgaaagcagacaaccagtcttaccaaaatttattaggcgggaatttcctcatcctaataagcctgggagtgctacaggagactggggcttatttcatcccttatgtacgaccgtaaaagacagctgtccccaaagtggccatttcagaggcctccccttagggacacattctctttctcagggatgttccttgctgagaaaaagaattcagcgatatttctcctatttgcttttgaaagaagagaaatatgactctgttccgcctggctcacaggcagccagagtttaaggttatctcccttgttccctgaacattgctgttatcctgttcttttttcgaggtgcccagatttcatattgttcaaacacacatgctctacaaacaatttgtgcagttaatgcaatcatcacagggtcctgaggtgacatacatcctcctcagtttatgaagctgacgggattaagagattaaagacaggcataggaaatcacaagggtattgattggggaagtgataagtgtccatgaaatcttcacaatttatgttcagagattgcagtaaagatgggcatgagaaattataaaagtattaatttggggaactaataaatgtccatgaaatcttcacaatttatgttcttctgccatggcttcagctggtccctccattcggggtccctgacttcccgcaacatgtatcctttctgtgcactcaatttctatctctgcctttttatgttaatttttagatttcctttcttatcttccatatttcttctttggctttcagcaatgtccattcttttgtacaggacttctgttaccttcttaaattttgacaattatatcttaatttccaaaaacttttcattttttctatttatccgtttgagtattttcttattttatagacatattagtttgctaaattcttgcaagtatactgattgaactttttaaaagttttcttttgttttttatgttacctttctttgttaatcttggttcttctctctcatgctattgatttccctcagatgtctggttatgtttatctatttgttcctgttttaaacaaagagctcagttggtattggaagctggtatgatttcctctgcagttacacctgtgcctatgatagccccctacttttaatgagagggttagaaatggagacaatgctgatttcaccatcttccttcaagatataggagcagaggataaagagacaagttggtgaaatctatttctaaagtaaggaaaacattaggaagtgatatgtatggttgcattttagtcctctaaagaattgtccttattttttcatttctgtgtcagctgtgtggttctgaagttaccttggtttggtctgcttctctctggccccaggcacatagtaggaagccaccacacacacacacatcactcacactcacacacactctctctctcacacacacacatactcatacacactgtattgctttactggaaggccctttacacggtttcaatatgggagcaaatgccatatccaaacttagcattaatatgcaaaggaggagaaggaaaagcagccaaggctttcataggttgtactctagttattgccctatgtaagctgcttctgctccgagtacttttgtcagcaggtttaacctttatctaaggagccagtgagaatttaggaagaaaagctattatactacaaggagcttattctcagtcctagttatttatttattattttattaaatctgatcctattcacttgatatcttctgaaaactcctcaaaattcctggtcttacaagtaccacttgttcatatttattgaagttgttatgtattcatttcttttctaatatcttttctgtaataacatgtgggaagcatgcatggaggagacagtaaatatgtgtgccctgaatgataataagccaaaactaagtgagtcctcttttcataccaaactggtttatccttcttaactccattgtttcaatgccttgccaggtctgagaggcaaaagtcaatggctactcatcagggttggtgaatgcctgtctttttttttttttttttaaaaaaaaaagccttttaagttcaggggtacaagtgcaggtttgtttgttacctaggtaaacttatgtcatggggggttgttgttcagattatttaatcacccgggtattaagcctagtacccattacttatttttcctgatccctcctcccttcccccaccctccaccctctgaaaggccccagtatgtattgttaccctctatgtgtccctgtgttttcatcatttagctcccacttataagtgagaatatgaagtatgtgattttctgatcctgtgttagtttgctaaggataatggctactagctccatttatgtccttgcaaaggacgtgatcttgttcttttttatggccgcctagtattccatggtgtatatgtaccacattttcttcatccagtctatcattgatgggcatttaggttgattccgtgtctttgctattgtgactagttctacagtgaacatatgtatgcatgtgtctttataatagaatgatttatgtccttttgggtatatactcagtaatggggctgctgagttgaatggtatttctctctttagatctttgtggaattgccacactgtcttccacaatggtagaactaatttacactcccatcaaccatgtataggcactccacaaccttgtcagcatatgttatattttgactttttaataacagccattctgattggtgtgagatggtatcattgtggttttgatttgcatttctttagtgatcaatgatgttgagctattttttgtagacttgttggctgcatatatgtcttctgtcgaaaatgttcatgtcctttgcccgcttcttcatggagttttttttttttcttgtgaatttaagttatctataaatgctggatattagacctttgtaggatgtgtagtttgcaaaatttttctcccattctgtaggttgtctggtttctctgttgatagtttcttttgctgtgcagaagttctttagtttaattagatcccatttgtcaattttggtttttgctacaattgcttttcctgtcttcatcatgaaatctttgcccatgtctgtcctgaatggtattgcctaggttgtcttccagggtttacgtgcctttgttcctttgtttcttttcttctctctcttcatccctccctcatttcttcctttcttttcttttcttttcttcttccttccttcctcccttcccactcttcatttcctccattcttcatttttcccctccctccctccttcctttccttcccttccttccttccttcgttccttccttccttccttccttcccttttttttcttttctttcttgtcaaaacatacatttcaacccaggcactaaacagggtctgggtgtatagcagtgaacaaaacaaatatggtcttgtcctctcagcttataatttaggagatgaggcaaatatcaaccaaacaagtctacaataaatacgtattttcaaagtatgcacattctatgaaggaaataagagttggggggccttgctgggaagatgtcatttgaagggagccctgaaggttaagtagaatttgttcagtggaccagcaagtttagaaagttgcaacaaggtggagcacaaaccttggaagtccttgaagtgagaaagagcttggcatgttggaagatgatagagaaagccaaggaagggattgaaggacatgaaaagagaatgagaagctgggaagaagaggccttgtaggccatttgagaatattgaggtttaattctttattcagtagtgagtgattatagagtgttaaccagagtagtggcatgcatgatatacattgtttaccaatctgtttagccgttgtggggagaatcaactagaaaagggcaagcatggaattagagaaactgcttagatgtcgattacagaagtgcttttgagaaataacagtgactagacttggagagtcaggagtaaagagagcgataaattgactgactctggaaatgttttggagacaatgtctacagaacatactgatgtattgaatgggggaaaaaaaagcaacgaaggatgaatcttaagtttggatttacaacacctccatgaatgatggtgccattgtctgaattggtaaactataggtgattcaggtttggggtggggagattcaaatagtcatgtgtcacttatcagtggggatatgttctgagaaatgtgctagactatttcattgtcatgtgaacacaccatagagtgcacttacacaaacctatgtgacattgcctactgtacacctaggctatgtggtatagcctattgctgctaagctacaaacctacacaatatatcgctgtcctgaatactgtaggcaactgtggcataatggcgagtatttgtgtatccaaatatatctaaacatagaaaagggccagtaaaacatatggtattccagtataatcttataggattatggttgtatatacagtccaccactgactgaaacatctatatgcagcacataaatgtattctgttttagtcatgctaattttgatgcacttgtgaaactttcaaaagaaggcatcttgttggcaggagaagtctgaggggacatacacatttgtctcctgccaacatacaaatgatatttatagccactgagtgaatgaaattggctaaagagaaaatatagctttcaaacaaaagattaagaacaaagaaaagacaacgctttaggagatgggcagagatgccaaaagtttcacccacaatggcaactcacattaatataggactatgtgaacatagtgaggttttgtttgttttaacaaacacttgtaaaacacttactttgtgccaggcatgactccaagcactttgcaaatgttaacttgtttatttctcctaactttcacataaaggaattattatgattgttggccatattttatgagaggaggcatgtgctggtttagtaacttactcaaggccgcatagctagtaagtagcagaatcaggactcaaacccaggcagtccagctgcagaattcacattctgagtactctgccatggtactattctgagcatcctgtggtcacacctggattcagtgagactctcgcaatcataagtgaatatgtgagatggcaatgaaagtacttctgctcctgtttagccttctggatcttgattcttcctaacgcccaccacttaaagtcaatattgctcaaactcatagcttttaactacaaaataattcttatatatgtcattttattttatgccttctgctaccattgtggtttcaggctttcagaatattgtgataaacccctaccttgtttttattttcttcaatcattttttagtcattgcaacaagactaatcaaagcacaacagcatcctattatacccttgatcgaaaaccttcaatgacctcccatttcttgtagggtaatgtctacacatctctcctggtagccaaagccatctgcaatttggcctcaacttctaagctcatcagtcacaattccccagcatgtagctactgctgtcaacctggactaattaactcttccctgggtatgtcctcagcattctcagctcagcagctttgtcatgcctctcagcatattcagattattttcctactctaccccaccctgagggctcctatacctgcctgttgaaatctgactcattccacacaagccagctttagattaccccctttcatggctccttgatgtttcagctgaaaatgatcaaattcaattctgaattcttaaactttctttgtactctttacgatagacatcacattataggaatttgtgtgtacagactgtcaagtcctagagggcaagtaatttgtatctttccacccgctatactgcctgcacggtgcctggctaacagtaggtgcttaaagtatttatgtacttgataaacagatgcaagaaatcgctctcagctgcttctttctatctgattagtacctgcagagcactgccccctttgtcttgctttccagtggaatgattctgcttcccagatgcatttgtatcttggagtgatttattacatcttttcctgaaatatatactaaaaccaagaatgttaagtgactgactccaaagttaagacttttgcagatagggtgaactctaaacaagacattttttcccccagtttggctctcagcaaactgcctttcagatgcttcagcaaaataaaaccaaaaacaaatgttttttttttttttaatttttgtgggtgtgggagattggatggagccattggtgtatagatgagaagcaagtcttgaaaattcatttgttttcatctaaataagaccaaatgaaactttttcaggcttttattttactaatataatattgtttcaccataaaacatattttctaactggaattttttaagttggaaagagttattttgcaatacttatgaactagatattctgagttttctaatcagggaaataaattccatatattaggttttaattttgtagttttagtgataaaagcaagatattgaatcacatatacagtattattaaattttttatattctctcataactatagaagaaaaactctggaaggaaagctgcaaaaaataagtatttatctctggatgatagttattgtctttttgtacatttctacattttctatttttaaaaataatttgcatgaattacttttgtgtgaaacttttcttaaaattgaactttcattttaaaagacttaggaaaaagggagatgttgagagtttatagtctaaaatttaagacttgtgaaaaccttatagtcttttaaatatctattctgttgagatattatttacttatagtaaaattctttaatttcaaatttacaattttgtgagttttcacaagtgtatacagtgctgtaaaagcaggatatgtaatatttttatgatcccaaaatgttcccttgtgcctcattgtagtagaggaactcctctgaccccttcacccttggaaaccaatacaattttacatttcccagaggttcatattaagagaaccatatgcatataatcttttgtagcatttctttcccttagcatggtgcttttaaagttcatccatgttatattgttgactgtattagcagttcattcctttatattgctgaatagtgatttattctatacatacatcacaatcacatattgatgaacagtttgagttgcttctagattttgtttatctgaaataaaacttatgaacattcatctgcaaagtccgtgtatgaacatatgttttcatttctcttgattaaatacctaggagaggaattgctgcatctatggaaatggctgtgtggtcttttatttttagtgtgttaaaatggtgaattaatgatttgtttttgaatgttggaccaaccttttatttctgggatgaactgcacttgactatgatatattattctttaatatattgttgtattccatttgctaatactttgttaaagatttttgaacttatgttaaagaggtatattggtctaaaagttttttttctatataatgtttttgtctggttttagtgtcaaggtgattctgtgtctggtttctgaaaggagctgtaaagtgttccatcatcttctattttctagaagattaaatgtttggtagaaaggcatcaatgaaaccatctaggcctacacaatttttataaagatttataactacttcaatatcttgaattgttatatgactatccagattatttcttctacagtaagctttggtagaaagtattttcaaggaatttgtcattttcatataagttgtaaaatttattagcataacattactcattatatccttttagtatactttcggtgtctgtagaatcttagtgataaattccttccttccctttgtactgttgataatttataccttttatatattattttcctattaaattctttttttttttactagaagcttaccaattttgtcaatttctcaaaagaacagttcttggttggtgtcatggattttcttttttctttgttttccatttaattgatttctttattatgtctttttctttattttaggttcagttttctctgctctttctagttttttaagctgaaagctaaaaaccttgcatgcattattttttaatataagaatttagtgctggaaatttccctgtaggtactacattagcaacatcccacaaatcttagtatgtgtgatttaatttttattcagttcaaactattttcttatttctctgtaatttttgacccatgagttatttaaaatacactagttgagtgccaaatatcttaaaattttcctaggtatattcctattactcatatctagttcatttctgttgtgattgtcatacgtcttaactttttaagacttgttttatgtctcacagtatgatcaaattgcaaaacatgccacgtgcacttgaaatgaatgcatatagtgctgttatttggtggagttttaaaatacatgtcgtttaggttccattggttgaaagtgtttttcaagtcttccgtacattaactgattttttcatagttatgtcaattatttaatgaggtgtgttgaaatctccaattatccttgtggatttgcatatttcttctttcagttctagcaatttttctttatttattttgaagcactcttattagcatatggaaaccttacaacagtatagttccattgccctcctcttggctctgtggtattaatgtcatatattttattcctactcatgttatatactgtattacaattgttattttcactttaaatcataatttatcttttgaagaaattaaaaatgagaaaaatctttcatatttatccaaatatttaacttttatgtttattcccttgtgtagatccaaatttccatctataaagctatcattttctatacgattttagtacctccttaaatagttctttgaaatattgcagagctctcggcaatgaatgtttttatatatttttttctgaaatgggctttatttaacctttatttataaaatgtgtttttactagataataaaatctaagtaggttgatggttggttttctgtatttgatattgcatcagttagttttgttttgcgtagttttaagtaagtttactagcattcttacctttgtatctctgtatgtaatatattttttagtttgcccacttctaagattttttctttgttctggttttcatttattttgttatgatgcatcttattgtggttttatttatgttcaattttttatggttcattgagcttcttggatttataggtcttcataaaatttggaaagatttggccatgatttcttcacagttgttaccatcacccactttccaatctcaattccttctgggattctagttatacatatcttagattgcttgatagtgtttcacaagttgttgaggttctgttcaattttcttctttatttctctttgcactttaatagtttctgttgctgtttcttctagttcaagatcttttcttctgcagtatttaatctgctactaatctcatgaagtatattttttcatttcagatatttaaattttttatgtctagaagttccctttgtatattttggaaagcttccatttctctaaagaaattcccaggctgggtgctgtggctcacacctgtaattgcagcactttgggaggccgaggtgggtggagggcttgagctcaggagtccgagaccagcctgggcaacatgacaaaaccccatttctacaaaaaatgcaaaaattagtcaggtgtggtggcatgcacccatagtcccagctatttgagaagctgaggtgggaggattgcttgagcccaggaggttgaagctgcagtgagcaatgatcatgcaactgtaccccagcatgggcaacagagggagaccctgtcttaaataaaaataaaaaataaattcccagaaacatacaacctctcaagactaaccatgaagaaacagaaaatctgaacagaccaatagtgagaaaagagatgaaaccagtaatcaaaaacctcttatcaaagacaaacccaggagcagatggatcatgggtgaattctaccaaacatttaaagacgaattaataccagtccttgtcaaacactttgataaagttgaagaggacagaattctcccaaactaattttacaatggcagcatgattttcatatcaaagccaaataagaacactaagagaacagaacattacaggccaacatccctgctgaacatagatgcaaaaatcctcagcaaaatactagcaaattgaattcaacagcacattaatagaatcatacaccctgatcaagtaggatttatcactggaaagtaaggatggtttaacatacagaagtcagtaaacatgatgtaccacataacagaatggattatgaaaaatatatgattatctcaatagatggggaaaaagcatttgacaaaatcaacatcctttcataataaaaattctcaacaaattaggtatagaagaaatgtacctcaacataataaaggccatgtatgacaagcccactgctaacattatacacaacagtgaaaagctgaaagctctttctctaagatcagaaataagagaggaatgcccactgtcacaacttttattcaatatagtactggaagttctagccagagcaattaggaaaaagaaataaaagattcaaattggaaaggaagaagctaaatggtctctctctgcagatgacataatcttatttatagaaatgctaaaactccaccaagaaactgttagaactaataaatttagtaaagttgcagtatataaaatcaatgtgcaaaaaattttgtttctgtacattagcaacaaaatatgcaaaaaagagattaagaaaacaatcaaatttacactagcaccaaaaagaataaaatacttaggaataaatttaactaaggagataaaagatctatagtgcaaactgtgagatgctgatggaagaagacacaaataaatagaatgatattctgtgttaatgaattggaaggattaacgttgttaaaatgctcatgctacgaaaagttatctacagattcaacacaattccagtggattttttcacagaagcagaaagacaatcctagatttcacatacaaccacaaacagctctgaatatccaatgcaaaattgcattacaataacaaaactggaagcatcacacttcctgatttcaagctatattacaaagctctggtaatcaaaggagtatagtactagaataaaaacagacaaacagaccaatagaacagactaagagaccagaaataaacctatgcacatcactcaacgcatctttgataagggtgtcaagaatacacaacagggaaaggatagtttcttaaataaatgatgttgggaaaaataggtattcacatgcaaaataatggaattagaccgttgttttacatcatacacataaaaaaagttgaaatgaattcagatttaaatgtgacatttgaaactaatactcctagaagtaaacatagggggaaagctccttgatattggtcttgccaaagatttttttaatatgacatcaaaagcacaggcaacacaaacaaaaataaacaagttggactacataaaactaaaatcttctgaacaacaaagaaaaaaatcaagatgaaaaggcaaactatagaatgggagaaaatatttgcaaattatacatctgataaatggttaatatctaaaatatataagaaacttatacaattcaatagcaaccaacccaaacaaaaaaacccctaatttaaaattgtgcaaatgatctagataaatgttttttttaaaaaaggcatacaattgaccagcaggtacatgaaaaggcatttaacatcattaatcataagagaaatgcaaattaaaaccacaaggcatcacttcatacctgttaggatggctattatgaaaaagacaagagataacaaacgttggtgaggatgagaagaaaagtgaacccttatacaccgttgatggaaatgtaaattggtacagccagtatggaaacagtatggatattcctcaaaaaactttaaaattgaactactgtatgatcctgctgtctcacttctgggtatatacccaaaggaaatgacatcagtatctctaagatgccagcagtgtcatgttcattggagcactatccattatagccaagagatggaaacaatctaagtgtccattgatggatgaatggataaagaacatgtgattttctcacagacacacacagaggaatattatttagttgtaaaaaagaagaaaatcctgtcacttgccacgacatgaatgaacctggaggacattatataagatgaaacaagccagacatagaaagacaagtactatatgatctcacttatatgtgaaataaaaaattagaactcatagaagcagagggtaaaatggtgattgtcagagcctggagaagggaaaagagcagagcacagtgaaaatgggagatgttcgtcaaagagtacagactttcattacaagatgaataagtactgagtatctaatgtacagcatggtgactatacttaatatcatattgtatactttaattcacgaaaggagtagatcttgtgttatcaccacacattcacacaaaatgtaattatgtgagataatagatgtgtttatcaatttggtggtaatcatttcacaatgtacacctgtatcaaatcatcatgttgtgtgccttaaatatatacaatttttatttgtcaattataccttaataaagctggggagtaaaaagcttccatttatcttctaatcatgctcatgcttttgtctacttcctgaacatatggaaaatcatgataatagcaatctcaatgtttctgtcttctaattgtatcatttgtgttgtttctgcttttgttgccattgattggtttttctcctgggcacaggttatcttttcttgcttctttgtatgtcttgccattttgaattgatggtagatattgtgaattttactttttgggttgctggattttgtcatattccttttctagtgttggattttcttctagtatgcagttaagctacttggaatctcttgtaggcttggaagctttgcttcattagggtagttccagaaatcattctaaggctaatttagctcctctaccaagaccatgccctttcatgggttctacctgatgttgtgtgtattatttacctgtgtattgcccctttacctgttgggaatacaaactcttcccagccctttgtgaccttcagaaattgttgtgattacctcttttcagttttctcccctggctttgggtattcttctctccagcatgctaacattcaccctcagccaaagactcaaaagacccatctgcacatttctggcagtccatcttggaatagttccttcctcttcagtaacttgcaccatgatttctagctgccttggtctctccgaactctgaactctgtcccctccactcagtgaggctactggattcggtttgggttctccctctctgtgctttgatctggaaacatttttttcagatgatgctctgggccatttataagggtcatcttgtttgtttctcttctttcagggatcattgtcctgcatagcctgctgtccaatgtctgaaaaccactttttatgtatctatactaattatctaattgtttaaggcatgagggtaatctcatccctgtcattccatggtggtctgaaatgaaagtttctttaatgattctctatttgaagacctacattcaacatctctagaatgcagagaaggctttcaaggaaaaacagagagcaaattgctatcatagaaaaggatatgagggtcctaatacctgtaataaaaatgataccactagtggaaaacaaacatgagcactcataaatagagcagatatttatggaacctgatatcagggttccatgtttacagatgaagatgagagcccatgtctttcctccaggggagatggtggtttttctgttattgattttgaaagtgacttgagaatgactccaaaaaaaaaaaaaagaaaaaaaagaaaggaaaaaggggatcttaattttataaagaatatttgttacttcccagctatatcatctccaactgatagccatttgcccactccttcacacattgtgtgtctagtcagtgtcaccttctgagaagacctgttctaactcaggattgcttgatcctttggaatcttctctgtaccatttaatcaaatatctcttcctcctgtttatctgctatgtcctcctgaataacatagaatgtactgtattatatattaataattgacgaccattatgaggtctctcttaaatcgtcttttatctgaattacaatcctctgttgtcttatagagaacatgactttcagaccctcttaatgtactacccattattctttggacaaactctaatgtgttacttttacacttagcatatgattaaaagaaatgaatattctaacttaaatatagggtgaatgagtcaattacttcccatgacaaagaaattgatttctattaatgcagcttaaggtggtattagcttttttcaaatgtgtagagatttaatttctaggtctatctggaactaaaggtaatttaaaacccatttattttctacccaaatgatatatgggtagcagagatgatcacagggagcccattggttcagccatctgtctgggctttggatagagattcctgctggtttcagatcactttaaaaaaaatcaatgtaactttcattccctgaattaaagccagggcctgctgtttaagatgatcacttctcccctgaaattttctatcagcttctagctgacaaaaggtgctgtgtggaatggaagtatttttttaatccctgtcaacagtgagaataggaacttaatctaatatttagaggaaaaagttactcatcctggatttcagtgctacaataataatactcagagagaaatttgtctaatacgtatttgctttcttggaatcatatcaagaacaagaaaataaagatattctcagattcctaagaaccaaattgtcaagatgggggagaattaatctacacttcccttatcacaggaatttcagaagagtaaataattataaaatgcatgagttgggaaaaattttagaaatcatttaattccgttctctcactttacaggtaaagaaagtgaggccaagagaaataacaggccttctgacccctagtcaaaatttctatgacactatttgaaatacttcttgaaatataccatgttattaaaataattcgaaacaggacccagagaaacaccaagtcttaattgcaatcatgttttgatgattaaggcaaaaaggaaaggataagcaaaaaattggcaagagaaatgtttaaagagtgtagagcagggaggaagtcaggagtcctataacttattgtctcttagatacagagagttgttccagttttgcaaaatgcctgcaaaatacattgtcttacttgcttctcatcacaattgtatgaggcaagtagatgagacagatctgatttctctcctttataaatccattttttatacacgtatctgttattgcctcagcagtacagatgccatttactagatcagttaatggatgccaagtctctatttacatcttgctttagtgtttaattcagtttagtcttctgtattctaattccaaaaagcaacatggtatcagaatcctgaagtattgtaagaatcatattcaattttgtactgacataagctgctctatttgggcaaaaattggtagcctctccaagcttctgtgcactcattcttgaaatgggaacgataacagtattttaaagtttatgtgacgataaaattacttttgacaagtgtgcctagtagatacctggttactttcctcttcttcgtaagccgtcccctctcccacatcctctctgtaaacttcagttctctgtatcccactcagttgttcagtttatgtgcataacttcttaattaattttcttttgcttgtcctgaattatttagaaatgcattttaagcatgatacctgtttcctccatcctttcaatactgtttattgactgccttctgtataccaggcacttggatacaacgaaacaattggatagaatacacaccaacagagagggagtagtttttcaccttgaggaattgaggaggtaaataaaaggagtgtaggttgtgaaaaaaaaaatgctataaagagttttgggccagaggatagtagtaggtgggcaagataatgagggtctggtatggaacaagaatcaagctttaaggtatgagagaattatttccttattttaggaaaagttaagggaattcttcactgagggagcaggatgaccaaaggcacagaggctagaaaagtcacggtgtgtattgggaaaatacagactctgcatagttaagacaatcttcataaaaatgtcagaggagttgaggctggtctagtgtcatctggggatcacagagggcttggaatgtccttggggagagggtgagagtaaagctttcaaatctttattcttgaggtttttaggaggagggtattttgttcattatggggagaaaaattgctctttgacttaatttctgcttatccccttttaccttatatgcaaatatatatttctttatgaaatgtacacaatgcattccacctagtataaagcagaggtctaagttgcctctcctggttctaaatccaggtgttactcactgatctttatcttgcttgatctctggagtattctatattgttgactgcaactcctccttaaaattattctctcttagctacttggatgctgtctcatgattcttcttttctacttcttttctacttctcaatgctgactttttaagcattggtgtgaactctcttctccctacataatattgcagggtgatatttcacttccatctattcaactgccaacccagggatttcgaatttgggtagccaagatctttcttttgagttccagacatttccatttcgatatcccactgatttccaaaattgacctcatcatcttttcttcaaaatcttttcccaattcttggttaccacatcacttgtcttaatcattctctcctccttcaattataatggagaccttagaatgccactcttctgccactctctgctcactgccctccctgagtcaggcagggactagagtccttcattttctggccttgcccgcctcagtagctccacctgcacctcatactttagttcattaatgactgtgaatgtatcatgctctgatacatcactggctataataataacacaaataacaattgcccatatttattaaggactaattgtgtttcaggcactaggccaaaacactatacattcattatcttatgtaattcacacatcaaccctaggtggtcagttcttttattatccctatgtttggaagaagacactgaggttttcaggttaaataactgacccaggctagtaagtagcagagccagaattcctactgtgaagcatgatgccatgttgcttctcttatgccttacacaatctgttccctttacctggaatttcctcccctcacctgcctatttttcctgttggatgactatttattcttcaagatactccaggtggcccctccttcaagaaaccaggtaattctctggggtcccaatgtttcctatgctcccaggagtcttacatactgtatcatctattatctcatttcttctactatactgcaagcttctggaaggcaaggaccatgtcacatttatctttatatacccagagcctagcacagcacccaggatacagttgtaactttatatgttattttaaaataaacaagatttcgaatgaagcctaaattcttttacttgctgtctgatctcacttaacaaaattggatcaattctattcattgatccagtttggcctcattctattcaagtataaaatgagaaagttacattataacggtggacacccccacatgtggcccctggcccagcagcatcaacatcctctgggaactcgtgggaaatgcaaattctcaggccccacccctaccgaatcagaaaatctgggggtggggcccaccaatctgtgtttaactagctctccaggtgattctgatgcatagaatatttgagaacccctagacaaggtgttggccaactacagcctgagagtccatgagccaaatcctacccaaggcctgtttttctatggaaaagttttgtcaacttctgtactaaatgctagtgaagcaggatacttccctgaccccttcatgggactcacaacaggaatgcctcatttacatagcccaccgccctcaactcctcatgggagagagtgcatgagcgaacgaggcaggaactggagtgcatgagtgttggaactgactagacacatcggcaccagcaggagtgaactccatgtgggccccacggcagcatccaggtaggggtgcctgtgacccctgaagccccagatgatgtgttacagtgctcttttagcactgccatctgtggatggcttaaatgttaacagctcagtgagtcttttgtttttttgtgtgaggcagctgccctctgccagcaagggcaaagggccagtgtgacagctttttgtatctacactcatggctcttgggctcttgtacagcatccaggaaaagtgaggtcacacaaattgaagaatggtaaatgcaggagattttattgccaatgaaagtgggtctcactgggaaggggagctgaaaaggggacggatgagagggtaggtaatcttcccttgaagtctagccatctctggccagattattctctgaagttactccatcaagccatccctctgaagtcaagctgctgctctctgacatccagctgctcctcctctctgctggctgactctggggtctttataggcacaggatgaggcatggtggggccatgggtggtttatgaaaaggaaacattcaagtggaaaaacagcgatagaatttctcactttgggctgttgtttcaggcttttcagcttgaaggtggggcttcaccagagactcacccttttctggctagaatttctctgcctcctgtccctatcagtaggatcaccaaggagccttccagttatacagttcttttgttgtgagcccagtgtgatatctctgattgcttctaccttgtaatcaaagttaattctactcccctaaccttagtttccttgtcatgaaaaatgagattgaagtaaggttatcatcacccatcccagctctcctgtcctctacctacttgagctgtgcaatacattgtttatttttatttcaccatcacttatttattcctgtagtctctaagagctttcaaacactaactcatttagtcattgtagcactgttattagccatatcttataggaaaggagttgacacttggagaggtaaaatcattctcccaaggtgtcacgcactggtgaagtggttgagctggactggattggactcagacagcttggcttcagatccctactaatctccccataaaatagaggggactcctatgtaaccatcccccagctctatcagatctaaaaacctgccaatttgtgtcacatttccctcttctcttttaagaaataaagatacaatcacagttaaaggcaactatgtacatcttaattgattctcttctttacttttctacctagatcaaaccactgtccaagactctatatttgcattctcacacaagctttaaaaaactttgagatataattgacataggctgtacatatttaatatatacaacttcatgagtttagagataaatacacactcatgaaaccatcaccacaatctatgccataaacctatcacctccagaagtttctttctgctctctttattatttctactattttgtgtgtgataagaaaattttacataagatctaccatcttagcaaatatttaagtatacaatacaatactgttaactataggcactatcctgtactgtagatttctaggacttgtatattccaagtgcggataaagtgctttgtacccttgactaatacctcctcacttaccccttcctgaatttttgtcaaccaccatttcactctgcttctatgagtttgactagtttagatttcacatataagtgatatcacgcaatatttgtatttttgtatctggcttgtttcacttagcataatgtcttctaggatcattcatgttgtggcaaatggcaggattttcttctttttaaaagctgaataatctcttaggagtgcaaaccctattgtatataattgatcaaaagagatattttcacttgcatgttcattgcagcattatgtacagtagccatgcaagccttttaatgtatacattaaacagtttgtagtactatttccatgctgttaatctttattgttatggtatcttatagaacatatctttctgtagcttgttttctttttccacttaatatgtttgttgagacttatttattttgatagatccattgggttttagttcatttaactgctgaatagtaccctattaaatggatttactacaatttatttttccattctgcacttcatgaaaacttatttctaatttttcgctatgataaacaatatgcaatgaatgttcttttttattcttggatacacatgtgggtttatatcaggaatttgacttccggattatagggcatatgcatcttcaattttattagacacttcggtgatattctccaaattagttctacctatacatggagtattaacctatgcctttatgagtacttggcattgtcagtcttttgtattttttcaatatgaaggggaaaaatgaaatcttctaattgttttctctgggttcaaattggtatgagccacagtatccaattttactactctatatctttgtccttgctctttcattttgtatgaaacattcttctgattctccacttaacaacatctatttttccttcatgacccaacgcaaaaatttctctgaaacctctggtggcccaccttcctccaaatccatgttgtagttggagtcattgccaaccacttagtaagccaaaaatcttagttctcttgactcatgccttgacgtatacttcaattagggttctcctttgtgtttcaagacatttagatcctaattaggataatgtttatgtcagttgtccttgcagaatttttgatgctcccctttcattctcaaatgtcacactgtttggataatgaatcaatgctgacccttataggctttattggagtatattgacatcccatgttggcccatttttctccctggcaaatctgagatctcttagaccagtgatattttcaacgtgcctgacttccaatatttgctcaataaatgtttgcttctagccagccactcctttgtcatgcagaaggaaggtttccagtcatattttattctcttttcatggggcccgacttggcccaaacccaacttctccttgccagagagaagtgtaaagaatgctttctctgcagaggcatagcccattttcttatgagcaaccggccaagaggaaggtaccatgaagacagtaactaaaggaaaagaaagaggctgctttctaattttacttcaagctttatttaagagtgaagtttcatgagataattagattaagtcagagtgtttccagcatgcaaaaagaggtacaaagccttatggattacagttattcagaaagctatcaagcagaccaatgcataaaaggaattgctcttcaaggaagattccttgcagaatgaaaataataataataataataaagtgatattgatatcctttggttgccttggaaatactagttcatctgctcctgtaaggtattatggttcatcccactatattaggtttaatagaaaatcacataaccagctatatttttaaccatgtctgggatttaaagcattcactgggctgtagtgatagtgggtaagcatagaattgtgcattttagtttgtgcattgatatgacctccttgggttgagagggcagaaaagccggtgcttttaacttactcgatttttatttgtgtgtattagagatctttactgtgctcatggcagctcttgtattttttcagagtgctttcaatttcaaattttggtccctctgttaaaattctgtattgccctaaatatgtggtcacggtaactagatctcaaaactttcagggaagccagacattctcaatttctaatttttatcaactgtatctttttttcatcatttgatttatcgattgagcaacttattgcaaagggaaatttggcggaatgggagaagatattagcattaattaaacacatggcatcaccaaagaactgtgtgaagaactctttacttattattgtctttaatccttgagatgttagaaacccttgatatttttaaaaaatattttgggaaactctactagaaaatgatagagctttatatgaatcctttacatgaacagtcacagaatcccatgttattcctattatacagtggtgaattggtgaacactacctataatttaaaagtgtcaaaattcacaagattgggtgcagttaagtaaatgtgtttgtgctttacccgttggagagttggagtcacagccaggcacagtggctcacacctgtaatcccagcactttgggaggccgaggtgggtggatcacttgaggtcaggagtttaagaccagcctggctaacaatgcaaaaccccatctctactaaaaatacaaaaattcgccaggcatggtggtgcatgcctgtagtctcagctacttgggaggctgaggcatgagaattgcttgaacccaggaggcggaggtagcagtgagctgagatcatgccactgcactccagcctgcacgagagtgagactccatctcaaaaaaaaaaaaaagagttgaagtcattgccaaccacttaataagccaaatatcttatttttcttgacttatgccttgatgtatacctctattagggttctccagagaggcagaatcaataaaatatgtatggataaatgagaagagatttattaaaagcattggctcatgtaattatcaaggctgagaagtcccatgatatcctcaagctggataccctgggatgccagtagtgtggctcagtccaagactgaaggccttagatctaaggaagcttatgacaatccccattccatgaccaaagacctgagagcctcaggtggggaaaggggttgctgctataaattctggagcccaaaggctgggagcctgaagtttttgtccaagaacaagagaggaagagtgtatcccagtttcagcagatagattgacacatttgccttttctggacttggaagaatgaatggtgcctcctcatatcaaaggcagatcttccccacctattttactcagacccacatgctaatctccttggaaaaacccctcacagacacctaaaaataatgctttaccaagtttctaggtattgcttattccagtgaagttgaaacctaaaattaaccatcacagtacccaaggactgcatatttagagcagagatggaaatggaatcccatttgtgcctcctgtgcttccatttatgtgggattcttcaattcccacaggactaaagcaagtttcctttgtcagcctgaacatccctgtcccacctcctcctctccatgggtgctgcttctggttacacactctttctccctttcatccattgatgttatcccactgttttgcaactcatcgttaagagagaaaggtcaacaggccctacggcatgatctttaaaaggctgataaggtcaagataaatgcatcctcttaaatctgtttttaaaggccagaaccattcatgcatttctaggagaggataatgacatcaaaattattaccaggagccagtccctgtgatcatcaggggcagccaggatttactgctcagctggacagaagcctttgctactacacgcctatgtttcatccctggtggactcaattttagggtatgaagagcaaagtcattctctctgcactctgcagcaaagcagtatgtgctctacagaaatgaacagatgccctcacttgacgtaaaaagtcttataaaagtctttctctcttaaagtataaatacacagtgtgtgagatgtatacatatgtattataatacaataaattatagagtagatccactttttagttcagttacatagcttttttcatacttggatttgaaatgaaacatatggctaaggagttataagtttcttagaatatttgtggtcaaggttcaatggctcacatgcttcttaatttcttttcttttcttgagagagtcaagctcaaggtgactgtgaaagtcactgaatgactgaatcaggtaccactattggccaaacatcctgacaggcactttatgtctcgctgatcttccacaacagtgatggggatggcaatctttggtgttttacagatgagaaacagcaaacgccttcgccttgagaggttgagcaaccttcctaagcctgttgtggggtggtggggttgggggtgagggcgggtgtggtttaactccaagacctgcgctctattaatacacccctgcttcaatctgaacaggattattcaaggttcagaaacatggtgctctatctaaatcagtgtgtttgctctagaatcaggaagagcactcaaaagttgtgggaatatgattgggcttgttgacaaaagcgtgttttgataccatctcttgaaaacttaaatttgagatgataatttttcatctcctatgatgatctacctaaatcaggcaagagggggtccaggagatctaggtgggttccttcttgggttatagagaagatgtgagagaaggcaagatctaagaggaacttcagcaatgaataaacataaatgggctcaattaagttgtagaattaacttatcatttaaaactgaagatgttcactgtttactagtgaaaaacagaccttgacatatttgggctatgatagcaccctcaaaggaattatccagtagttttagataagattactgaacaggttgagggacaggaataatgttggaaagggaatgtaatgccagaaaaatacattctccaggccacaagttgggaagagttttagcgtaagctatgtgggaaaaggtaaaaattgaaatgtaaaagttagtgttagcttcttcatggccctaaaagtcctatcgtcacagcagaagctttgtgggcactctaagagtcaacaattttgtgggtttgcattagagaagtggacagtatgtctaaatcaagatgatggccccactgcttttgaccagcactggccctttgcaatacactggctcatagctgagtatggctcccttcttattttgtccacacccaggtattatttttagttgcttttccagagcaacggcctccaatatttgcaagtgatgcaactggctggtagaatcttcttttgggagggctccacagccaaaatctcaaatggttgtctagaaacttcagtcgtacctcacttcatgccagatcagtacctttaaaaggttttcagtaaatcattattttacaattccaatttcactgaaatgccacaaagcatgaagtgttttgaagttttttaataaggaaaactagaatagttttgtgaaagatagctatatgtatagatccttgattggtatactttttctattaattggatttgcatagaataggtttgtttaaaaatgagaacacacttgtagtcagtttcactattgggaatactgatttcatatctatgtctccttgctaaaaaattgagaggtgtaagaatttggccaaatgtaactctgcagcctctgcattttgttaataacatcacagtacctcatggggtttttaacaccatcattaagaggagctcatttggttctcacctttattatctcatttatcttactatccctgggaggcatggactcagatattgctgcttgtatttacagagaggaaactgagaggtcagccaatataaagtgatggtcagcaagatggctttagagagaactcacctcagccaaaagcagtccagcctaccagtgttgaaagtaggatcccagaagctcttgacacaagggttcaagggaagggagattctgtcaaatgactgtctctgtctcctacttgtttctctctaccacttattagatacactgtgtcactgtggacaaattactcaactgtgactcacagctttctcatctgaaaaatgcaaagcattgtatctgcctcacttctggaaagagtttctttcctaagaaaaattagctctgattctgagtaggggtgaggggaaaaaagtgaatgagggtctgcaaaagggaatgaggtctcctgaacatggcttctgtaaggagagttgcatagtcactgcttcagcctcagggcttccttctttcctacactatatagatttttaaaatgtaatttctatgtgcatgtcgtctttccccaattttagatcctagactcccagagtaaccagctggggcagacttcagataattatagttcaaactcctcttattatagatgagaaaactgagaactgatgaggggattccaagaagaaagccagtctgttgcatttcctttcctctaggagaggggtctccaacacccccaccctctacccccataccagtcagaggcctgttaggaactgggccgcacagcaggaagtgagcagcaacaggtgagtgagggaagcttcatctgcatttacagccactccccatgactcacattaccacctgagctctggctcttcttgatcagtagctgcattagattctcacaggaggtcaaaccctattgtgaactgcacatgtgagggatctaggttgcatgctccttatgataatctaatgcctgatgacctgtcactatctcccatcgcccctagatgggaccatctagttccaggaaaacaaactcaggactcccattgattctacattatggtgaggttgtataattatttaaatattacaatgtaataatagaaatcaagcacacaataaatgtgatgcacttgaatcatcctgaaacctttgccccaacccccaccccaggtccacagaaatattgtcttccacaaaactggttcctcgtgccagaaatgttgatgatatggtttggctgtgtccccgcccaaatctcctattgaattgtagttcccataatccccatatgttgtgggaaggagcccatgagaggtaattgaatcataggggtcgttacccccatgctgctgttctcataatagtgagctctcttgaaatctcagggttttataaagggcttttccccctcttgtttggcacttctccttgttgctaccacatgaagaaggatctgtttgcttccccttctgccatgattgttagttttctgaggcctccccagccatgctaaactatgactcaatgaaacctctttcctttataaattacccagtcctgggtatgtctttgttagcagcatgagaacagaccaatacagttgggaaccgctgctctaggacgttttctcccatcatctgcctctgtctttgaaaactctaggtctctgggaggattaaactagaaaaaaagggacatagtagatgctattgagtagagaaccatgggagttgtatgagagaggaaagtgagattcctcaagtctggaaagacagtggtggttcagaggagactttgaggcttacgtaattttactctagtgcacatttattgcacaactcactttgatgaagaatcctcagctgcatggggcccctaacccatgtcactctgttccacctcagtggaagaccctttggctttcttagacaatttcctctgtcttcactgggacaagtttacttatgaatgggagcccatatttgctagaatcttaacctcagccagattaggggaaaactgttattcttctctcaatttaaaagatattttccttctgtgtgtacatgtatgtgtacacacagatatatatatttatatgtaatatacacattatacatatatactatgtgtatatatatatttctatgtttgtatatttctttgtacataaaaaagcatagaaatacatcctggacaagtttatttcctcagcctttcccatatgggttccatctcttccctgtcaccatcaattctgtctttatctacagcttgaaaagtaatcatcaaatccatttgtatcaacaaagttgcctatcacttgctgaaaaggctggtattttatgcatgttttacttctctacaatcaaaaatatcttaagttaaatgaagacagaaaaggcattcatgaatagaaatggcagtgtcctgattttatcattttctatctaggtgctttacccatttggtttaagtggcacttagatttttttttaattattcccttctaaaaatgcagtgaacttgaagcaaaaaatccatctagtcctatgtgaatgaaccttgggaaaattgctttctattatcaatattttccagcaagagccacaatgaggaatgtgtctcttctgaagtatgtgctgtttctccttggagtccttgcttattaatcatcctgaaactctgagctataaaaactagtgtgaagtccttcttcaagctctatgacaataagttagctttattctctccttgacattacttgtatgagggaaagtggagtagaacccaggtggaggcatgtcctatgtcacagagaccctgtttagggcactggtgccctgatatagaactcagccagttcaatcagatagaggctcagaagcatgaccactttacagtagaaaacatatttaaaagcagtaaatatcagacttccctttttaccttgaccttaatatacagtatgtatgtatatttaagacatttttttccatggaccaggggttgggagggaaggttttgggatggttcaagcatacatacttactgtatattaaggtcaaggtaaaaggggaagtctagcattctgtcatgtcatagctgactttttgggggagtgtatatatacatatactatatatatgatatcctctttcttcatggtaatgataatcatttttactttatgaccatcatcacaatcatcaatatcttaaacacaataattattatcactatcaccattatcatagctgacttattaagcaattaccctgaataagacactattctaagcactttgcatatttattatttacagtcattaccagcctgtaatataattattcatgattatcattttaagaaatctgaagcttagacacaaaaagttatctgcttttagagggaggcctgggtatcatctgtggatgaggaagtagcctgtgagggccccaaagtgcttctggatatcttccaatacacaatatgccacgctgctacttccttcacctggctcccttcctctgcttccctttggcttgggatttctggcagtagctttaccccctcccaccccccactgactccagcttgtgatttggcagcccctcaagcatgcacgggtttatagtgaggtcacattgccctagtactctcacttagggcaactggtgactaggactgcagatcttaatgttacttaataggctcaacattattatctttttacataacttaaatttggctcacatttcacatatgtgactatgtctaagtaaaaataagtatattatgtgttcagtctatggctaggattatgacagtataagaagtatcacctcaaacggggatgttctccttctggctatggaggattagcttagatcagattgatccttttgcagagaaccagataatgtgcataaaatgatttaaaaatatcccagaagggattttagagtaactgaggttatgaagccctaagcagccaagagcccagatagaagggaagtgcagaataaggtaggagtcatgttcgctgagataatggttgagaattttctaaaactgataaacactaacccacagaaacaataaacttgacaaaccccaacaagaataaaataaaataaaactacacataggtaaaacatagtaaaactgttaaaagataaaagtaaaaattttaaatatagacagaagaaaaaagagacatttaacctttaaagaaaaagacataaaatgcagacttcattcaacacaaattatgtctgttgcccactttttaatggggtcattttttttgcttgttggattgtttaagttctgtctacattctggatagtaggcctttgttgcatgcatactttgcaagtttttttttttgccattctgtaagctgtctgtttactttgttgacagtttcttttgctgtgcagaaactcattagttgaatcacatcccatttgtaaatgttggaggtttttttgttgcaattgttcttgaggacttagtcaaaattctttgctaaggccatgtccattagggtatttcttaggttttcttctaggatttttatagttttaggtcttacatttaaatctttaatccatcttgagtttatttttgtttacagtgaaagatagaggtttagtttcattctgcatatgcacagccagttatcccagcaccatttattgaatagaaagtcctttcctcattgcttatttttgttgactttgtcaaagatcagttggttggttgattggttgtagggatatgggtttatttctgggctctctattttgttccattggtgtatgagcctgtttttatactggtaccattgctgttttggttactgtagccttgttatatagtttgaagttgggtaatgtgatgaagtctgacttttatttttgcttaggatcgtttagccatttgggctcttttcaagttccatatgaattttaggattgatatttccaattctgtgaaaaaagacattggcagtttgcaaggaataacatcaaatctgtagattgctttgggcagtatattcattttaatgatattgattcttccaatatatgagcatggaatgtttctccatttgtttgtgtcatctttgatttctttcagcagtgtttggtagttctccttgcagaaaattttcacccccttggctagatgtattcctaggtatttttttgttgttgttgctattgtaaataggattttgttcttaatttggctctcaggttgaatattatcagtgtatagaaatagtactgatttttgtacttttattttgtatcttgaaactttattgaagttgtttatcagttttaggagcctttaaatggagtctttagggttgtctagatataaaatcatgtcatcagcaaagaaagataatttgactttttttcctatttggatgcattttatttctttctcttgcctgatttgtctggctaggagttctagtactcagtagaataggagtggttagaatggcatccttgtcttgttctagttattaaggagaataggggaattgttctagctttcacccactcattatggtgttggctgtgggtttgtcacagatggtgccaataattttgagatacattccttcaatgcctactttgttgagggtttttatcatgaagggatgttggattttactgaaatctttctgtgtctatcaagatgatcatatgatttatgtttttaattctgttcatgtcgtgaatcacatttactgatttatggatgttgaaccaaccttgcatcccaggaataacacctgcttgattgtggtgaattaacactttgatgtgatgctggatttcagcttgctagtatttgttgaggattttcatatctgtgttcttcagggatagtagtttgtagttttctttttttatcatgtctttgctgggctttaatgttgagctgatgctgatttcatcaaatgaattagggaggagtctctcctccttgattttcacttgatcttagccaaagggctgagaagcagtcctcctcctttattttctagaatagtttcagtaaggattggtaccagctcttcttcatatgtctggtagaatttggctgtgaatccacctggtcctgggccttttttggttggtagtcttttaaaatgactgattcaattctggcacatgttattgttctgttcagggtttctatttcttcctgattgaatatttgaaggttgtgcattcctgggaatttatccattttctctagattttctgtttgtgtgcatagaggtgttcataataatctctgagtaacttttgtgtttctgtgggattggttgtaatgtcatctttgttgtttctgatagtgcttatttgaatcttctcccttttttcctttgttaatctagctagtagtctattgatcttttttatccttacaaaaaataaactttggttttcctgtatagatctttattttgttcagttctgaaaagaagacatacaacattactaattatcagagaaatgcaaatcaaagttacaatgagatatcatctcaagtcagaatggctattaaaaaaagaaaaataacagatattggcaaggctgcagagataagagaatgcttatacactgttggtgggaatataaattagttcaactactgtggaaagcagtttgaagatttctcaaaggactaaagatggaactactattcaaccaagcaatcccattgctgggtatatctccaaaggaaaataaatcatttttcccaaaaagaaacctatactcagatgttcattggagtggtattcaaaatggcaaagacatggaatcaacctcaatgcccatgattggtgtagaatttcaaaatttctgtgattcgctttaattcttaaaaaatgccattccatttattctgccttccataacttttattcaacttttattttagattcagggggtacatgagtaggtttgttatatggaatcaacctcgatacccatcaatggtagactggataaataaaatgtggtacatacaaaccatgtaaaactctacaccaataaaaaaagaacaaaatcctgtcttttgcagcaacaatgagtgatgctggaggccattatactaagcaaactaacacaaaagcagaaacccaaatactacatgtacacatacatggtagctaaacattaggtacacatgggcataaagatggcaacaatagaactagggacactggagggggtaaagaaggatggggcaagggttgaaaaactatttattgggtactatgtttactacctgggtgatggaatcaatcatgccccaaacatcagcatcatgcaatatatccatgtaacaaacctacttatgtaccccctgaatctaaaatagaagttgaataaaagttatggaaggcagaataaatggagtgacattttttaagaattaaagcaaattacagcaattttgaaattctataccaagtaaaattatcctttcagtgtaaagacaaaataaagacatttttagacaaaaaatgacggatttgcagaaaacaaaatacaagtgaattctttaggcaaagaaaaatgatcctagattgaagcaagaaaattcagaaagtaatgaggaaaaagtagacatataaattaatattgaccctataaagtgatattaaaatatgatgctactaatattgttttgagtttaaaatttatgcagaattaaaataccacccccccaaaacaatgatataaaatatggagagggtatcattggatttgaagcttctaagaagcttgcattgttcaggaaatgccaaaaatatctgaaaatatatcatccaaattgtttaatatgaggtaatgtagatttaaggcaaaaaatattaccagcggtaaacaggatattttataatgataaaagggtcaatccactaaaaagatataacagttctaaatttgtattcaccttaaatcatagacttaatttcagtaaagcaaaaattgacaaaactaagtgaagaatagagcaatctataattatagtaggagactgtaacaattctcaacaactgatataacaaactttttttaatccagaaaacacaaagcagattgtatatatacatatacatatatatatgtatatatatctcttcacagtgatattacactgtaagtaaataacaggaatgtaactaggaaattcccaaatgtattcccaaatgttggaaaattaggcaacgtatttctaaataacccatggatcaaagaagcaattacattggaaattacaaaatatttcttgcatatgcctactttgatctggggcttctgggatgctggtaatgttctattttttagtgtaggacctagatttttggtggcaaacacatagatgtatttactttgtagaaatgaatcagattatatacttatcatctgtgtacttttctgcatgtgttgtatacatcaatttaaacatagtaaaaaaaattataaagtgtatgcttggattgtttcatgtaagaaaatctccaaataccttctatctgctgaaaactgcttgtgggattgacaaattaaaaccaaaccaaaataacccttctctcccagtattcggagagggtgaatcagtcaaagataacatttttggtggaagagacaatacagagaaacattaacatgtttacaatgtacaaattaatgtaaatggctacactatatttcattaaaatatataatttcacaactaacgttttgttcattaaagagaataatggcaatgagactctttaccctaattttaaaccactaaaatgtctgaatcttggtgtttgtaaaaagaacctagaattatgtgtgtctgttttgtgctgctataaaggaacacctggaattttgtaatttataaagaaaagaggtttatttgtctcatagctctgctgggtgtacaggaagcatggcattagaatctccttgtggtgatggcccccagaagcttccaatcatggtggaaggaaagtgggagcaagcatgtcacatggtgagagagcaagcaagagatagaggaaggagtgtcggtctcttttaaacaaccagatatcatgtgaactcatagagtgagaactcactcattatcatggggacagcaccaagccattcatgagggatctacccccgtgacccaaacacctcccactaggtccacctgtaatactggaagtcacatttgaacatgagatttggaaatggcaaaatatccataccatattacttcttccctggtcctccaaatttcatgttcatctcacattccaaaatacaatcatcctttcccaatagtcctccaaaatcttaactcattccagcatcactcaaaagtctaaagtctcatctgacactcaaggcaagcttcttctacctacgagattgtcaaatcaaaaataagttatttatttcctagatataatggtggtacaggcattgagtaaacatttctatttcaaaagggataaattggccaaaagagaggagtaacaagccccatgcaagtctgaaacacagcagagcagacattaaatcttaaatctccaccataatctcctttggctctgcttcttgcatcctgggaacatgggtatgagggatggcctcctaagactttgggctggcctgtccctatggctttgcagggtacagcccccacggctgctctcacaggttggagtctattgcctgtggctttttcagactgagggcataagctgtcagtggctctaccattatttggtctgaagggcagcatgacccttcctacagctccactaggcagtgtgctggtggggactttgtatgggggctccaaccccacacttcccctctatactgccctagcaaaggctctttctgagggctcttcctctgaagcaggcttctgtctgagtacccaggctttcccatacatcctctgaaatctgggtggaagctgccaagcctccttcactcttgggttctgagggcctaaaggctttgcactatgtggaagctgaaaaggcttacaacttgtgctatctgaagcatctggctggagttgtacctgggatgccttgagccgcagccaggaagtggggagcaatgccccagttctggctcatgaaaccattcttcctttccaagcctctgggcctgtggtgggagacctgcctcagaaacttgtgaaatgcctttgaggtctttatcccgttgtcttggctacgagtgcatgactaccatttagtcatgtgaatgtctctagcaagtggttgctccacagcctgcttggtctattctcctgaaaatggtctttccttctctactatgtggccaggctgtaaattttccagatttttacaccctgcagtcctttttattgtaaattcaaactttaagttatgcctttgcatgtgcgtctaattaactgtaggctgttagaagcagccatgccacatcttcaatactactgcttagaaattttcttctaccagataccctaagtcatccctcttaagttcaaacttccacggatccctaggacatggacacagtgcagctaagttatttgctagcacacaacatgggtaaactttattccagatcccaataacttcctcattttcatatgagacttaattagcctggccttcactgccaatgtttctatcagcattttggtcacaaccacttaacaagtctctaggaatttccaaactttccttcatctttcttcctgccttcctctgagacattcaaactcttccaacatttgtcagttaccaagtcccaaagctgcttccacattttcaggtatctttatagcagtgctccataccacagtatgaattttctgtggtagtctgctttgcatggctataaaggaatatttgaaattgggtaatttataaagaaaagaggtttattttgctcacagttctgcggaatgtacagaaagcatctcaccagcatctgcttctagcgagagcctcaagaatcttccaatcatgttggaagacaaaggagaagctggtcaaatggtgagaaagggagcaagagagcaaggaagaaagtgccaggttattttattttaattaatttatttattttgagatggagcctcattctatcacctaggctggagggcagtggcacagtatcggctcactgcaacctccacctactggtttcaagcaagtctcccacctcagcctcctgagtagctgggattacaggcatgtgccaccacacttggataatttttgtatttttagtagagacagggtttcactatgttagccaggctagtcttgaacctctgacctaaagtgatctatccacctcagcctctcaaagttctgagattacaagtttgagccaccacatctggccccagggtcttttaaacagtcaggtctcacatgcactcagagtgagaactcactcattaccttgaggacagtaccaagacatttatgaggatccacccccatgactcaaacacctcccactagaccccaacattggaggtcacatttcaacatgagatttggaggaggagaaacatccaaagcaaatcaaattagctttttgcaatcaatgcaatgaatacatttaccgagtggtgattgaaattcccagcaatctgcaatgcactggaaatatagagttaatgaaatggtgggtgtggtccttccttaaaaagttaatctctctcatgtagttgtaaggcttttctttgtttcttctaatttcttaggacaaattgtgcaattaagaacagaaagattgcctgtattatgggaaaggatggctacaaagcactctggatgctttgcatggagatgctctgagctgctttgaatcctggtgtctgaaagccccagcctgtcaaagctcttagatcaagctatggcagcaaactccaatgcctctcccaaaggattctccttttccatccatcccacccttctccaatgtctactccaaggtgagcagaagtagactccaatgtctacctctactcacctggaactctgatgtctacttccactcacctggaaactaccatctctgaggagctcccattctaaaaatgatcctccccacatccaacgtggttgacctgaaagaatatctgatttgtttaaataaaaagcagcattcccaattagatcctatgccaacaacatgtagcctaggacttgtccacagaaattcttaacagtggatgttcttaggtaaggtttcagaccttaggcttcagaaattatatgcaaattttgcaaatatgtgctcatttcttgaagaaatggtgaaattgagactttaagcttccttcagactctcaaggaagtctctgacacaaagaactttatgtaccacaggcttagaagaaatagctggagacctgtggcttgtaaatccttacttctcatcagtcacttggcctctggcaattgccttcctccttaagccttagttttcaatttggataacttcctctcaagttcattcaagatctagctattaactttcttaggatttgttcatattttcagtgttctcctcatcatgctccttgttgacaactcacattttataaattgtatcagtcattgaaaatatactattggggacaaattccatttgcttttaaggagctaaaaggcaattgaagaggaaactaacaacatccatgcaacttacatcaagtcatcagcttcatgacccaaccccggcatgatgtcagttccaaagacaaatggcagcaacaaaaaataatcaagtattgtctcagaggttttgttcttagaaaaagtgtcattatacgtctatatacttcttcattccagtttgttgtttgttttttgtgttctgtgttttcttggtcactagaagggatcactacactgacgttagtacatcaccttttactcttggtacatacatgtgttcataattattgcacatactatatgtgtcctttgcaaactgcttttttaattatattttgaaatatattcatgttcatatatgtaggtatagtttatttatttgatcttaaggattatattgtataaatgtaccacaattattcatccattttcttctttgacatatttgcccaattaattgcaagattttgctgatgtgaatagatatctttgtttttcaaatacgcatttctctgaatcacaagtgaaaatgagcatctagttacttgcttgggtatcttctactgtgagtttttagtttatattatttgcctatttttttatcaaagtgacagagttctggatactaatattatatcacttatgtgcccagcaaatatcttctcccagtctcaggcatttaactttgcttatacagacgatttaaaatgttaatatgtcacatttatctacttaactaacttttccatgatagctgatagattttgtaccttatttccttaatcctcctctgtgctaagattataaaaatattatacttctctctaaattttataacttttcttttcacattttggtattttatctgtatgaaattcttgaattgtattaatatgaagtagggatccaattatttcccacagccagttgaattaccaaaatttgttaaatagcctattcttaagtccatattaattttaatgccacgttcttcgtattccaactttgcacataatgcatgtgattctaggctttcccttctgccactggtctagttgtctataacttatacttgtatgggtcctgatgtcagctggcatgattagtcatcattccttatatttctacacttgtcttggtgctttcctctttcataagaatttataatttttcattcataaattcatatgaatttataatttttcattataaggttatttttaaatggtacctgatattatttttaatatggaagtttaattccaattttcatcctgattactggtatatttggtcatacttccaccactttctatcatatttttgtttgtcatgatttatctttgcttcctctagtttcctagagttctatttatattcacttaataaatagttaaacttgtactatgcttacacgaattaacagaatcaaaattggatcagtgtagcacagtaagcgctccatgaatggggaaactatggctatggagggtcaactatactacgttattttatataaaggacttgagcaactacagattttggtatcagagtggggttctgaaaccagtcccctgtggataatgtgggatgactgtaatctacttctgaatatgtaagtaactcagacatcacaaaaacaaaacaggaagtcaattaaataccatcatcgaagacataagggaagactaacaagccacaagtatatactctaacaagttgtttcttggatggtaatctatttctttctatgttccatatctcttcatcttttaaatttttctatatgtttctgtgtgttgaattctatgtggcttcttcacatctgttttccaattccctaatgccctctttagctaatcatagctgttgtttaatacacccactgcattttaattttattcttataattttcatttttatcagtctattctggtttctttttaaatctgatttttctttttcccataggaggtcttgttctttcattatgattgtgatttctatctcttctgttacatttttattataaatatgttgtctttttcaagagtatatattatttttgattcttacagcatacattatcaatttaattttagcttctgactactcctacattgatttatttcctcctgttgtttctaattttggttaggaatctgttattcaatggatatctctttttctgtggaagttccttgtgaggatggttgtaaaagtatttctatagagcaattttgtttttgcttttcctggttcccagagaatggttgctttatcaatttaggattttcttatactcattgcaggatttaagttaaaatttgttacatgacattgatgtctatatgtacaccttggccagcaagtaagctacattggtattttcatttttagataggaatagttttcctaactccctatctacagcagaggaagccctctcagggtcaagcctgagcagaaaaaaaatgctaacagccacctaactttaaaataggacatttttttttttataattaacacatttccatttccttttttatgttcaaacttatcattctccagttttctacttttacaaagagaattatttgatattgaaaaattgtagacaattaattagaaaatgttaaatttggcatcacaaaattacccatgtaggtggggcagaatcttctgtgtgtatgattccattctttatattaataatcactgaacgtactgaacatagtttaactttgaaccatttacatttcttggagtatttccttatgtataaagtaagcatattgcaataaaagatatctaagggccctttcacctctaaaattctataaactttgacctttgcatataatagatattccataaccatgtgacctagactcagcttctaccatttcaaataataggagacagtgtgttacctcaagtcctcatagatgcatgtatgtgattctgtgttttctcacagatccatattcattctttgattctcctacctatcagctgtgtggccattgttaagtgactcagtgtctccaaatttcagtttcttacctgaaaataaggttaataatgctgaactaaggttgttgtaagaattagagattttgaaagaatcagcaaaagttaacatctttttcccctcagtttcttcatctgtaatatcaagataatcattacaaaatcattgtaaagattatgagacattgtagtaaattgcttagtattaatattaaacctaataaatggcaagctaccataaccagctcagttcatggcatattggggtcccaggtggaaggtctccttggctaatccctcccttattcatcccagatttgcactcaccttcactgctgtttggcttcacagactattctgccattttttctgtggattgcattaaaacacaactgtgttcaccaccatacccttgagactagttacctgggaaaaacaattctcatttctgagtttttacttatttcttctatgatgctgaagtcatttctccattagcatgtatttctggtccctgtcttctttatgactctctcttccccaccagttcatagacccttgtttgtatcatgatctcctgtagttcttcctgggtcatatcacttatcatacatgccgtccttgtcttgcatgtgtatttcacatacattttcattataaagtaggaaatagctctcccatgttacagagcattggtatatagtaaagaaaaaaatccaaatgttcttttggcaaagtagattttttttctcatttgctttaataaagcatctcatgttttatatattggttaatataattgaacaaaattatttggctataacttcttcttaagatggactattccactttattatgattatttagaaaagattaatgcccaaaccattgagaatgtaattttttaaattgccctaattatttgcaccagagcatactgtcatgatcatgaccctcaggacaaacttcatttacctgatcgcagcagaaactcaagttctaatttgcaagtctgatcatagggctatgaagcccaggattgctgactatggaaaattttcatcatcatcctcataataataaatgattatgataaaggatcataaattataacataaatgataggctccaaatatggtattaggagcatatgtacatacatttcagtattcttaacaaacattcttcaaatccacaatacaattcccagtttttaggcatagaaagtaaggctcagaagggctaagtaacttccccaggttggtaattagctgactcaggacaggatcccgtctctgtgccccctcccccgcccccgccaactgcttgtgtgtttgtagcattccactttgcacacttcttatcatcattttctacagtaaatttgctgaaacttgacttcattccctgctcattgaatttaaaccttaatgatacatctactgatagaatggatttaagtttttgattggattacatcagcttttctgagtctaactgaaacagcactaacatgcatttttctaatataaataatattaataagttcatgttgaacaaaatataaaaaatcccaggcattctttaagttatttagtggtgatttctgggattttggtgtacccatcacccaagtagtgtaaactgtacccaatgtgcagtcttttatccctcaccatcccccacattttcccccagtccccaaagtccaatgtatcttctatgcctttgtgtcctcataggttagttctcacaaatgagtgagaacatactatgtttggttttcctttcctaggttactccccttagattgataatctccacttccatccaggttgctgtgaatgccattatttaattcctttttatggctgagtagtattccatggtgtatgtgtatgtacatacacatacacacacacagcacattttctttatccactcattgattgatgggcatttgggttagttccatatttttgcaattgcaaattgtgctgctgtaaacatgtgtgcacaagtatcttttttctataataactcttttcctctaggtagataccgagaagtgggattgatggattaaacagtagatctacttttagttctttaagtaatcgccacactgttttccatagtggttgtacaagtttacattcccaccaacggtgtaaaagtgttcccttttcacagcatccatgccaacatctattattttttaatttttttattatggccattctagcaggagtggggtggtattgcattgtggttttgatttgtatttccctgatatttagtgatgtggagcatttttccatatgcttcttggccatttatatatctgattttgagaatagtctattcatgtccttagcccactttttgataggattgctttattttttcttgctgatttgagttctttttagattttggatactcgtcctttgttggatatatagattgtgaagattttctcccactctgtgggttgtctattaactctgctgatttatttcttttgctgtgcagaagctttttagtttaattaagtcccatctgtttatctttgtttttgttgaatttgctcattctgatttaaaatgtgagttttgaatcataatttttatcactctaaaattaaacatctcagaattataaatttagaagagaaattatccaacaaattataattgacctttgctttagaggtattctaaaagcctggtaattttatgtagccttgctacaaagccaacgttgaggggttgattcttgttaaaaggaagtaaggcaacatttcatgcccataggacatctgctctccaggtgacacatcagcaccatagttcagcaatcttcttactggcctggtgaaaataatgattaattaaaaggcaaacaagtgaaaaattcaaacatgatcatttcctttatgttataaagtatttattcatcaaatatttataaattgttttgctttgtatagaacaaaaattagatggatcctggtcttagagggtttacagtcctgtaaaaaagaaaatctatgtccataaatcactgtcttatggtatagaaaacaataagtggcataaaagagacacgttaaaaaaaaactttcaaaattgaattatttccagttgtcactataaagaaaagctttacaatagagggaggctgactcttgaaggagtgagatttagacttgtagtgtctttaagggctatgttcatatctatagagatgagatagactaagataaatggcaaaaggaagcacttgtaactattagagaaataactcttcagtactctgtgccaggcaatgtactaggcaccaaagtcaaaaagataagaagcacttcctatcctctagaagctcatggtctagtatttaggtgaggaactgagggaaaggtgaaaccttaaacaaagaaaggcagaaaaatgccaagccctcaagagcagcatcagctcttctgtttggaaagagggaaaggtattcaaaagcaggatcaaaaaataagcttggataggaagcccaatacattcatgtttcagttccatttttttaattgagcaagttcaaagaactttatgtatctaagatctacatgacacttgagactgaggttatctttcaaagtttcctaagtaaaagaaagatactggaggatctataacttacaatatgtaagttgtcaagatgacattgcccttcttctgattcaaacacatagcagtaatagaaaaaaacaaaaaattgaaattagaaaagctctagcagagtactccattaaattaacatacttaaccaatatgtaaattatttagttttcctatgctgttccctccaaaagacaattatacattaaatactttacgcaccccattccctagtgattgttgtctaatacgttatcttctcaataaaaatagttcttatgtttttatctaggcatgtattctgaaccatctcacttaaaatttactttcagtttcctctatgatctttattctatttggagtatagtcaaatcttaattgttgattttatcgactttctttgtaatagttttcctcaaatggtttagaactttgtttgcaaaggaatcctctggaaagaagcaataatgaaatagaaaacaaagaagagatgatcaatacaagtaaaactggccctttgaaaaataaaactgattgtattaaagaataaattagcaagactgattaagaaaaaagagagactgaatgagtaatgaaaaaataatgcaactgtagatacagtggaaagataaaactatggtactattttgatcagtcattttattacaccaaatatttaaaatattaagagatggatagttttcttaataaattaaattattaaagttgcttgaaaacttagtttgaaaccaaaacgaaccagtagctattataaaatgtctttcttagaaaactataggtataaatggatttatgagtaagtgatggtacatatatagtccaaactgtttcagagaatagaaaaataaagaatgctacccaattcattttatgaggctaatatagtcttaacatcaagaggagataaaaacagaagaggaaaaaaaagtataagctattctcatgtgtgatcatatatacaaaattgtaaataaaacatcagcaaattaaatccaacagagtattataaatacattgaactattttttaagtctttttcttccaggaatatgaccataggccactatcataaaaattcataaaaatctctcagtataattctgtacattgattaaagaaaacaatcacacaatcacttcaatagaagtaggaaaaaatatttctaaattttagcattattcataataaaaattcttatcgacctaaggatcaaatactcttaatctattgaagagtatccaccaacattctagcaaacaccttacttatggatgaaatgtaagaaatttttccattaaagacaggtatttagtaagatataagatattcaaggctactgctagcacttaaatttgttactggaaagaaaagagaagaatataaactataggttgattggaaaagaagaaaaaaaattgtcactatttgaatatgatatgattatatagatatttgaaaatgaatttccagccaaactgttagaagggtgtttaaaaggtttattgcacatcagatcaatataaaaacttgagagtgtttttacatatcagccataacaaaatagagaatataataggaaaaaaatttccattgataataatgactacaaggaacctctaactatgtacataatatgtgtaaaatggctttaacaacaatcaaaaaattataacgtgcaattcaaggatctaaaagattggatgaaagagaaagaatcacaatgtgcacgactggctaaagttaatataatgaagacattaatctcagattaatcaacttagtaatattctaattaaaattccaagagggtccaagaatcacaatgacattttttagaagatgtatttatacaggaatatattattgaacttgaatgagctagatttttccttatcaacactgaaaaatctcaaccaatcttgtgtgaaaaagcaaattgcagcataaatactatatgattacatttatgtaaaactttttaaaactcaaatgctatgtgttatgtggagatgcagataggtgataaaaatatacaaacaacaatcagaaaggatataaaacagctttgggaccttgattacctctagggaaagagggaaaaaaatgcttaaaagtgatgaaaattgatcttccactacatttgcctttttctcacaaagagagatttgttgaaagaatggtaagtgttaacatttgctaaatctgagtagaagcacatggcattagcattttaatattccaaattttatgaaatttttattgtgatattttataattttagccccatatttagccccaattttatttaaatattttataattttctaccccattttcttttttcagtatagctagttgggaacaaagggacagaatagagtaatctgcccatcatgagttcatacttccttctgtaggaactgctagtgtaatactggagcagtcaatagaaataatatcaggtgctacttccttgtacagagacagagaccaaaatctgtggtctctgttcatcagcgattttatagtatgtgccttcagcatcatctctctttggccatctcattaccttaccaattacatgggataaaagttgcaatatggcatcacccctaagaacaaaggacgctctctgtgtgatggaaatttttatacataaaggcagtctttttttcatctttttgctttgaacctttaagtcagctcaccctcacctttcttacctcttcaagtgtcactcttctccttccatgaccagatgttgaaagcaaatctggtttatggcccaccattctccagccgctggttgtttatcatatgactaattattataagtcaatagagccaagagatcaatacattttagagaaagttctctgaaacagaatttgtgaggatgtaaaaggatctttttgaaaagtttatcattacatcaacatagcagacaaaaccccaatagctcccctggaccatgaaagtctggtaaagaattgtcaatccatgaaatggctttgacagctgttctccaaaccagttaaagggagctcttccaggcagtatgcaacactcatggtgtttcctattgacaaagtaccctaaagagtcatattgtgtgatgagtataataccactgaggcatagactggaaacacacagtgtgatctggccaatctctttggccagggagtagcccaggtggactgcccaccttcttcatctcaataagctttggaagtcatccattattcattgtttagagatcaataattaatggagattaaaagtttctttaaagattccagtaacttcacaataatgtcacaacagtaatgtggaagcataatggggtgttgtgtttatttgggaagcagaatttatttttatagatttttaaatgattttattaatgtatttgtagaatcattaaggtcctaaagggttcactgaattattattttgtattttcctacattttatgggagaaatgatgtgctatagaggtattcacaacttgagatttttggagatccaggatcttggttatatacttcagaataacttgctaatatacgattgaagttcaaaagcactttagtacttgagggtcttatttcttaagtctttgttttactttattttagacaagtttatgacttgagggggaaaaagagtcttgttcttgacctagctttggatgtctgagaacaattagcaaatttcttcagaggctaaaaataattggggattttcataattttacaataaaaatagagagttttgcattagaggatgggattggtctgttatcttattttcattttgcgttttcactatctcattcatatttttgaggcattatctgaacttctccatgcctcactttctctaaaagattgaaaaagtacatattaattattaaaatacttagagcattttgtagaaatgatgtgaaaataaggtaagataatgtcatgtgtactaataatgcaaaagtcatacatttattccagatctccagtgttacatcattttattaattgtcttgttagtgtctaaggcgtagaatggctgtactaaaaatctctactgtgaacttctaagaaaatacatacatgtgtcttttccacagtgttggttataaattacagttttggtggaatgagcaagatgttatacttattttagaaatatgcagctgactttcttattaactgggtaattttgttgttctgattcctaaataggtaggtacttctctctgtgtcttttggtttgggttccagttaagaaattatgaagtgagaaacttgtttcattaacttttcatatgcatgtgtgtatataaaatgcattgattgggactgactgctaaagggtaacatagggaaattattacttatggggatttattctggtgctgaaaacaagatattaaattatagtataagaagaagcataattcaatgaatttttatgatctgtaaagatgggcaaattgcagtgcaaatgataaatgggttttcagcatcaacatctacaaatcaatcatcataagtagatattttgatgtattaatgtaacgaggaagcagccctttgggatgtgcatgttatttttggtggttgtcctcataagagacagatacttattatgtgttgtgttaagggtttttttttttttgttttagtttttactataagtatctattctgaatatttttaggaaatgttttaatcccttagaaataagcttttttgcacatagaagtggaaatagatactaatttgattagctcagtatcaaaacaaagtaaaagctgataaaagtcaacaggacaggtgggaggtctctttctctgccttttccttaaagtcattgcaactaagtgtatccatttcccttttgtgtgaacttttgtttcctacctgagttgcaagttccatatcaaatccctctgtctgaagcttctcctactccagtatcattggataaataataaaataatgaacattcctgtttgtatttctttgatctactattcaaaattgtagcctaaaaattattaaaaaggtaaacaaagctttcatctactcattcttttaacagatactaacttaccaccagtagtcagggaccatgctggagcccggggaaacagtgagcacagcccctgccttcaaagaatatatggtaaaataaaagaaatacatatgcaatctggctcttacaatgtactgtggtatttgcttgtagggagatgataaggtattatgggaacccacaggacaggcatctttataaactggagggcatccgtggggagccatgatggttgtcacagtgaaaaaggggtgagggaagacttccaggaggagctgatgctcaagtttgacttgaaaaatgtaaataacaggtcaggttatctgtggcaaggggagcaacatgtacagtggtccacaggttaatgggactatattcagggatcaataaggagatcaatctgttgacaggcccatcgtataacctgaggaaaaaagtggaagcagcttgatctctagaaagaacaagagacttggagacagcaaacctcattcctgtgcaaacctttgtctccttatttctgaaggtaggataatcctacatagagaaggaaggattgtataatggaaagaggtcaaggttatagccagacatagggctcaaattccaactttagagcttgctaattgtgtgggatctcgactaaacttctcagtcacaactttttcatatgttaaaagacaacaataacacctaaatacatggtaataagcaaactggcttcttgcgatgcttatatgagggaatgtggaaatgtctacggagtccctgaatgtccatcagaggagcttaatggatatacttcctttccctttttgaaacttttctaatttctgaaatggagaacttgattccttctccctacatgaattttaagaataaaataaaattattcattgaaaataatccataaataagtgtagatatagtgcatgctcattatttatttttgtgcaggcatccatttaaagaaccccctgaagtctcaccattggtttagacattggactttttttctttgactccataattatccatcttgcctcctctacattctctgttcgatgaccccaggctggtcacttctttgcagtagcacctcctgtatgtagtcccagagtcacctgcactttttatggccctgtatgaatttgtaggcttggctcacatgccctctggcctcccctctctccctgatacagatcactgcttgtctttctcacacaccttacctctgcagtgggccaaccaagaaacatttccaggagattcatgttttttattttttttttcatttataacttttcttttttttaaattatactttaagttatagggtacatgtgcacaatgtacaggtttgttacatatgtatacatgtgccattaattaaagtttcatgggagtcttggaagcacttgtttgctttaatatgtgtgggctctttactctcttcctaacatatttttgttaaaaccaggataaatctcagagtggctatcaggttatctgtcttaagtgcttcttgcccctccttatttttgacctagaaaggaggctagtagccttgaacctcagggtaactgttgccttcagggtcagccaaatggaaggctgccctgagctctccagcacaatgacttcgctgtaacattattatgtgtatttttcatgaagataaatgctgtctcccaaacacccatttttatcatagaaagatgtgaatggtagaaacttaaaatctgcttcaggcaggatagttttgagaagatacatatctaaccctaataaagttgggctgcctcatggcctatttctatacagtgcagcaccctaaagaaaacacaaatccactttcaaaaatttataataatctttactagaatgtctcctaaaaatggtaagagattacgtggcatgacagggagcaatatcccctattaaaaaaaaaacttccctatagttacttatactttaattgcttacagaaaggtgcaacagcaacggcagagaatatctactatctcatgtagtcttattcacttcactgaaaaacaccaaacacagttttcttctacttctttcattcactcctctatcttccaagatctctaagttgagctctgcatttttagactaaatcaatataggctttctgtctcttttagttctgcatcacaaggttgaaaaaacagcatggatagtctatggtttggcaaactttttctataaaagaccagatagtgaagattttagggtttgcaagccacacaggcctctgttgcatattctgctttgttttttacaatcctttgaaaatttaaaaacattcttacctcataggccacacagaaacaggcctcaggctggatttgacccatggaccatagtgaactaatccctggttaagcaataaaggcaccaggtcttcgtagactaagccctagtgagacaattaacaacaaaaagagtgctcagtacatgtcaggcatggtatcagcagcttacttatcttagcttggttagtcctcagaataacagtttgagataagtactgtactgtttcattgttaataagctgaggcttagaacactatacccacccccaccccccagccacttgatcatctgtagtcgagattttaatcctcattaccgtttaacttgatacaacatagagataacttaacctctcttaatatttgaacctcagttccctaatctataaaaaagggatactattattaccctcataggtttatttgtgaggattaaatgaactgatatgcataggcaatatctgacacatgcttatatgttccatacttatcagctctatcattatttcagtgaatttgattattggtccttgttgtaccacttgccagccatatgaccttcaagcaagccatttttatactctgtgcttatttcctcttaagtgggtgttaacagcatttcaagattactctgaagatccactgaagagagctagcgaaagtcaaagagacatacaaaagtaaagcatagtaattaccattaattcatgactgtgtgcctagcttcatcttgaggtctccagatccattatcaatgtgtttctcacagcaagtttataaggcaagcattttgacaagtgtggccactatctgtgaaagcacttgaaagaaacaaggtgttaaactcatgtgtggatttattgctttcactacacctgcatgaaaccaggatattcagaaaccataggtcttgctctcaaccttcatcttcatcacaggcttcgtcacatcagtggcccagggcttgaggacttccttaaaatgttgctcacatcatgaagtccaagatataattcccaatagtgattcttaccttcacaacagcatcacctgttaatttagcttatgattattaaaatgcaaattgcctattttgtgaattatctgaacagaaagaaaaaacccttagcacaattctgtgtcatgcttcattttcaccatagagccagagggactaattattgattaagaaacagttacgtgaggagaggaatgatttcctaggattgctcattgtcagagtttgatccgagaagcagacctgataggagctgtaaagagtaaagaattattccaaggattggatgttacgcaattgtgggtgctggataaacagtctatatgaagctactgcttctgtgtcttggtgctagagcctgaagcccacatgtaaagcagtagagaagaaaagacagatgtgaagtcagggaaacaaggacagaatggacaggctggaacctataaggacagctgaaacatacatcagtctctcaccatacccagctttcaactttgatgatggaatgatctgcaggaagagctggcatccttcttcacagatatgaacacacagaggatgtccagcaggaactgaaggtgctgcaggcccagtcactgccccacactcacaactcaggctggcagaaaagtgacaaggcttgtgcactacaccagtgcctcatactcaacaccaatcttgcccacataaaaagaacatggctgacaccttacttctgccttccagtcccacacaaaatgtctcttgtggcccacactaactcggaactgcagcaaaagaacattttaaaaacaaaattccaacttagctacattgccgcaacacatatccttcattttcaatacctgtgtgatgatctagaactgttttccctaactcttagcccagaggttttcccacaatcctctgctgctctgaacttcctactccataaactagaagaataccttcctcatggagtgattgcacaagacagtgtttacaaagtaccccaaacaacgcttgcttggcattctaaaaagtactatcttctttttcttgatgtctacttagagatcaagaaaacatcattaataagaaatgtacatcttttggagggaaaaagcatatattgtgttactcaagacaagtatcattaattcagaaccacccatgattttagattattcactccattaattcccattacaagttggtaatagagagtcagttacaatttcacgagactaatttggaacctggctttagctccagtttatgtgaagtggaagaaatgcactattctatatggaagagagagagaagaggtggagagactcatttgattactctcagctgatggcctgcctgacacccctggattattactgagaattattctgtgatcaaaataagttgattaaaaccagagtcctagcattaaagtggaattaaactacacagtgtgattttaatactagactctttccctgtggtgtgttgcataatagaaaccaattgaaaacataggtattaggacaaataaatataaataagttgatatactgcagaaagtgggccaggggagcccacagtgaaaaggggtactgccagagtttagagcattatcttttaattaataaaaggaaaatgagaagagaaatccactcgaggaaaaagggatggtgctctaattttataaggttggtgttttatgggataagaaattcccagggacaggcattaaaagaaagtaaagttaaatttattcttggctgactacactccatgaagaactgcaggagggcaaatacttgtatcccattcttttctggatggccattctcttgtcactagctatctacagcacctgcagtctgaatgtgtaattaagcacaaaattattatactactttcattgttccttcatttactcccatgagaagtcatttttatccttgatccccagtatgtagcagtctagggtgggtgaacaaaggacatggttctgtaaagaacataggctttgacctgggtccccacctaatggaacaacttagcatcccaatccttcctctgtctgtctgcactgggctgggtccagggcgacctatcttttaccttggcagatactacagttaatatgctgctttccagtttgccacttgatagccatgatccccatatgtttctgtctcttggttcccactaggaaagtgaccttagggttatcacaggaggctgacattgttacaacagcttatgttgactttcttccattactctgagtgcttctttcactgggactctggtgcgatgtttactcagtggtgtcagttttctttgatgatccctgaaactattgccctgttcttttaattttttagaccatgctattttaaatatgatttctcccagtttgagtcagataacatttgtctcaacattgtgttacatctaaaattcttttcacctcacatacacacacacaaaaatcaacatgtttcatgaaagaatcttggacagcttaactctcttctacctccagatgagttttccatcccctggagagtgtgagaagaactttgctgagcatgattgcaaatttcaaagtacttttttccttctttgtctcaaggtatccataggttcctcatacagacaaaactcttggaaaccatttagctaccctgatagaagtagattttcatcaataattgattatccatggaccaaactaagaacataccatctactacttttttacacttttatgtcacctggcatgatgcaaaatggaattatatttattctacacatacttattgagacttactctgtgccaggatagtgctaggtatgcatggatgaacaaaacagcgctaggtatggatggatgaatgactcattacaaagcttatgaacaagtgcagaaaaatatagccaacaaataatagatctacaatggtaaattagcgtaagtactatgaaggaaaagaaccagattctatgagaaagatgatagcggggatcaatctggattgaacatctagaaagatctcttgaggacattgaacataagccaaaacttaaaggctgagcaggtaccaaccagacagagggattgaaagtcatgaagcttaaggtacaatctaatatctgtcacctagaagctctgaacccctagcctacatctgttggctgtgagaaagttagatattttcagaaatttattaacatctttagatctgggggaaattgttgtgcatattacagaagttctcttggtgacgtttttatcacctgtgattgttttgtgtttggctggagtggggtcctcagctgttatttacaaggtaagtttttgctctcatttggggtaccctgctgtggttgggtgtagccatctgttagccctttacaaggtgggtgtcaaaaaggccaagtgggcatgatttctgatcaactgaataagcatttttatgaagaagatggagtcaggaagaaattcttaccaagtagagaaaagtacatgctgtgagctacagataatttaaagaagagggcatgtttagggaattaaggaaagttttgtgtatcctgaaatatgagataggaaattaggctggagaaatataagagggccacactgggaagatttaaaccatgggccatgtcgaggagattgaacttgtttttgtgaataagtcagaccaaatggaaatttttgaaccagcaccgcttaaaaataataataatttaaggaaggaagatactagtggcaaagaggtgattgtaattgtctaggctagagatgtggaggacctagttcattacagaagagatatgagctatttctgaaggagaaaacaccatttaatataaaaaggtgaaagaggagaggggtatgattgtgaagtgtggaggacaggatggatgatgacaccatgaatagggaatgtgggagggtcaccatttgaatgagctgcttcctcattggtgctcttcctctgacatgaataactacttacatatttgcctctcttggtttactgggagctcctcaaggacaaaaatgctttatttattactgaacccacagtacaggtgacaaggcatatctgaggagttcagttaagtagtaactactattatcattaagctttcaatagttgtgtttgagtgaatgcatggatggcaggcttttgacagtataatagtgagttctgaagactccagagagaatgatgggaagttgattgagagaaattctctttagatgaatttatttcaagaaggagaaaaatgacagctccttggggaagaagaaatgtaatatgtgaggagacacaaaagctggcccagttaggttccactgctaaaagtcagccactggaaaagtttgaaagcaagaataacacaggaattcagttctgaaaatccaaccatctcagttgagtcatccttaggcctggatagtcagagaacctttgcacaaagaacacataactttctcagatattacagaaattttggaattaaccttggctatacttttctctgtttacatcctctttttgttagacccaattccccttatttagggaatgtcaccaaatgtaaggatttaatataactttcaggaaaatgttaaagtggcctgatgaggtttttaaaattttctcaatggttgaatgatgtcttctcctaatgaccaaatttcaattatttagttaaatcattgtttgcatatttttttaaaaaatgctaccccatataaataaaattcagcatttgtgtttcaagcatcttattccctatttttttaacttatttgtagtacgtgaagcacaacataaaagcaattaacaattttaattaaagaatgacatttttctaataatccaaatgctgggtgttgggttttattttatttctcttggttgttttgtttgtaccaaatattttataacttgagatgtgagcaataaatcatattacatggttttactcctctgtgataactttgtgtatcaaccataatcttgatattttatcagttttattctctttcttcttatatggctacgcctatttgttgatctctgggttgccatcacattcagttccattcacgcatcttttgtagtaaactataggaaagaaaaaaagacctatagaaaaggaaaattggtgagtagtaaaagtctagaagaaaataaagtctgagaggtgattctttaacactgtttttagaaaagggtttctggcccatcttattaaagccattctccttgacagacaaaactctaccatggatatggatataatgaggtaggtgtttttagggtctaatatcataaaatatttaaatcattcaattctttttgctggaagtccatacttgagtaacttttgattaaaatgtagatttccctataatttttaataaattttagggcaagctgacaagagtatttactataaatcaataaattggtctatatgtatatagtttattctaaatttagtctgtgtagatcagatactcaagtccagatctctgtagcattgatgagaagtttctggacttccaaaattagaaaccagatactgaactatagtaaattcaccaaggtagccttccagcctacctctcctaaagacagaccaatctcatttcatactgtctctcaggacttctgcaaaccttcagtcggatgtgtcctgcccaaaactccttatattagagttgaaaaaattaaagcctagaaaagaaacgtgacttgactaaggtcacgtgcaaatttggtctcttgccagatctatgttcctttcattataccatgtagggtcttaatacatcattatccttggaagtctaaggaaacaattcaacaaataatccaagtcatagggggaaaaaaactcttggattatgtatcaatctaatccctactcttgtacctcaatggaccatggggctacatgcaattgaatacactctgtgccctttttctttctgatggagtcggaacctggacaatatctattcactctttaagattcaccatttgttgcctccagtttcaaagtttttcccatttctccaagtagagttagtcattctcccttctgcccatgtgtatctctgttacgtgccatatattatatgccacatgatattaaatatgtacctattttattgcctttaagatgtgaactactctaaaagagtaactactggttccttatctctgcatgccagcacccatcacagcatctggcacttagtaatttatcaataaaagaagagagtaatttatcaataaaagtaatttatcaataaaagaacaaaggaaggagggaggtagaagagagagaaaaagaaacttgagtgcatcttccactgggagagacttctgtttcctcaactccagattacatgagaagaggaggtgtataaatttaggcaaaatcacatatgcagctcaaaataatacttatttttaaggctgatttggaagaccttgagttattttctcttcctatcaccttaagcagaatacaatgataaataattagaatttttcttcacattccaccgtgaatttaaataataatgcccttagaacacctgaggcactggggaggatttctgttcatggttacacggatgctaataaataactatatcagttctccaaagtgacctcatgtcagagctgaaggatagttggttccagtggcaactgagatgctgcatcagttgaacagatgggaaagaatcaaagtgtatgcttcagaagaggtccgtataacattcagtgtcagagacaacagtagatgttaatccagcagagcgaattctgtagtggggagtgaaatattatttaatcagcagtgcttcatacataattcaattaactgccttcactcatcagtattaacgacaacaggagcttggattaatgtgcacgagcctcataaaaaagctcccagactacctaagtgctgccaaaacttaataaagtcctgccaatcaaatcctggtatctggacccaatgcatcagtgcactgatattacaaattatcccaagcacttcttattgtttcctaattctttaattatgctgatatctgcataaaatgtttaattagtgtatgggggaaaccgagtaagattgcctgccacttccttgcctatcagtatttagcatcaagtaaacaaaatcgaattttatcgcgaataatttttaaagacaagttcacctttttttattctgtaaatcttgataattgaaaaggaaacagcaagttgggttataacaatctaaaaggctgagagggtattgaggatgccagaagactgagtgctcatctatccattatcttttagttcagcctctggactttgggaaccttagttttgtcctggttgtttttgtttttctggtgtcaggtattggagatgaatatgtgatactaacaatcaggtgatcagggccccttgaaagaataaagagattgtcattactctggatttttgagggtgaatggatattagcctgcatattctggtcaagttactattttagagaactggtgaagaactatgcctaatgtgctttaagattatgcctgaaatcagagaatggaaggtaatcagtccagcctttacagcatgtatttactttacaagttttgtgtacttcctatatatcaggaactgggctaagctataggcatatagagaaaataaatagttccagatctcagaaaagcaaagacctactggaggagacatatgaatatgcagagaaaaataataaggtcaagagtgaggataacaatgatggtgatgatgaggatgacagagactactattgttttaactctttgtcagtcacagtataaattttgcttaagcctcataaccctttaagaggggtattgtaactccttttttttatagtaaagcaaaaatgaaacttatggacacaacaggacagtggttgcctccaaggagggaggaagagaataggattggaaggttcacagctatatcagaaacatttatagatctttaaaaaccagaaccaaaataatataacgaatgtcaacattcatgaaaaattgagtggtagagtaaatcacggatgttttacttcttggtatgttagaaatgttttgtaataaaaacaaaggaacagtgcccaatttgcagttaagtgaataaggtctgtgatggagggccgcagagataggtgagagggcagagctggagtgggcagaggaggggtggttatggaaagttttccaaagactttaggaatgcctagcatcaacaaaaggcatttatttatttattttgaaatggagtttcgctcttgttgcccagtctggagtgcagtggcgtgatctcggctcactccaacctcctcctcccaggttcaagtgattctcctgcctcagcctcccaagtaactgggattacaggcatgtgccaccacgcccagctaattttgtgtttttagtagagacagggtttcttcatgttgggcaggcttgtctcaaactcccgacctctggtgatccgcccacctctgcctcccaaagtgctgggattacaggtgtgagccaccacgtttggcttaacaaaaggcatttattaagcacctgtttattcctggcattgtagtaaatgcccaagaagggaaatgaaactaacctagaccctgtcctaggatgttgatgatgtagttgtaagtaaatacaggggtcattgcatacaaagattattcagcaagaaatacatctgaaatagatctaaaggacaaataacattttggagggagttgacatggatgtgtttgcagctggccattagaaagtttaaaatagggataatatcaagttgaggcctcaaaattcctgtagttcagtaggaaatatattgaaggaaaatgctaatggattattatttgtcaggtgctggactctgcactacattttccatcatttttctcattgctgtcagaaaccctaggtgataagtcaaaatgccaaattacagatggaacctgagattcatagtgtttatctagttcacgttgacacagttaaaaacataacgttcagagagcctgagtaacttgcccgagggcacacagcccttaagtggtgagggtatatgcacaccatggtcgtctttgtacctctcagaaaagggcagattcttctccctgtttctggtatctgttttatttgaggcaaagactggggccatctatgatacaagtggtttttctgacctggcagcacctcctacgaaaagcaactaggtgttgacagccaaagcgtgcatccacctaagggtacaaagaacttccctacccataactctcaagaacatcccagccactttattgcagtcaaatgagaaatagagagttgaaatttccaaaggaagaagaattggaccctttccaaaaagcagtcatgttaactgagcaaatgtaaatggaattagattgattagaatgaaaagagaatctgaaaagaggatcactaattgatgtacaataaaatttaccacctagatatcaagaaagtggttgtttggacttagaattatctcagttttgtactgtctcctctcctacttcctttatgggcatttcactgattagcaaaacttctacttgtaaaactcagacctgttaggttatcatttatactaatttttttttaattaggaaaacattttagcaaaaattctgtttggatattatagaatttcataaatgttttcttaatattaatgtgaaatgatagacacagtgatagcacctggcaggtgttctgaccatggcttccacacaataatatgtctactagcacctataaaacagggatcttgagtactggaaattctggggcaattggacctggaagggcagtcctagcaggaaaacacaaatgaagccatccctccctcccttctttacaaaaacatttactgtattaaatagttgtagaaaaaagatgtataagctatatatctttgaagagctagatgtatcttaagtagaagagacagatatataaacaaataatggttggttaagacactggattctggaagcaggctagttggtttcaaatcccaactccactaattactagctgggtgatattgagcaagttacataatctattagtgcttctgttttctcttctgtaaaatgtggatgatagaacttgtaaagcattagcacgcagtaaccagcacataataattgctttttggaggaatgatggacatgaagagaggattacagcagaaaacaggttaaggaactgctgaagagcttctagaaaatgattgggctggatataattagtcttgctactcaaagtgtggtctgtgaagcgagctgcaacagtatcatttgagtgcttgttagaaacagattctgttcctgtgttagtttgctaaggataatggcctccaactccatccatgtccctgtaaaggacatgatctcattcttttttacagctgcatagtattctatggttataggtaccacattttctttatccagtctctcactgatggacatttaggttgatttcatgtcttggctatcatgaatagtgctgcaatgaacatactcatgcatgtgcctttatagtagaataatttatattcctttgaggccattatctttggcaaactaacacaagaacagaaaaccaaataccacatgttctcacttataagtggaagctaaaaggtgagaacacatggacacttacaggggaacaacacacactggggcctttcagagggtggagcatgggagaagggaaaggaatcaggaaaaataactaatggatactaggcttaatacctgggtgatgaaataatctgtagaacaaaccgccatgacacaaatttacctaggtaacaaaccacctgtacttgtaccgctgaacttaaaagttaaaaaaaaaaaaaaaagaaacagagattctgatatagtagctccaggataaggattaagattctgcatttatttttttctgggtgaagccaatgcagctgatctgtgaaccatattttgaagaacaaggatctagaacacactgtccaatatggtagatactagccacatgtaactgtcaagcacttaaatatgaattgagatgtgctataagtgtgaagtacacacaggatttcaaagacatccaaaaaaaggtgaaatagctcattaatatttttatattggttatatttttgaaactataatacattggatatactaagttaataaaatattaatttcacatttttttcaatgtgcatactagaaaatttaaaattatatatgcatctcctattgtatctctattgaacagtgtgccctaggacatttttaccaacagatttccctataatatgtgtatctctaagtattgtacttagaacctgacactagtagaaaggtaaaaataaagaatgtttattcttaggtaggagtaaaggacccaatactttaaaaatgatttttattttatttcttattacaacagtgttgcatatttactgcatgacagttttaaaaggtagaaacagaatggaaaaaaaattaaatcacccacaaaaaccaccacaccaaaacaaccactgtttaaattctgttttataggtactcaacatctaataatatacttttaaatgtactttttaacctccttttatgaggatctttcttcatgggcattctggaaaccatcctctcttggtttttctcctatcttactgactgcttcatttcattttcttaccttatttctcttcatcttccccaccaactatacttgcatatttaataagtttctcaaagtttgtgtctaaaacccaactcgatttctgtctcttaaccagacttcttctttttcttttttaacttagtggttgccctggggtttgcaaaatacatttacaactaatccaagttcaatttcaaatacaactatacaacttcacaggtagtgcaagtttcttaaaatattcccaattcttccctcatttcccttatgacattactattattcatttcacccacccataaattatagtcacaagatacattattattttgaacaaacttatctattagagtattgaagaataagaagcagagaagattttattttaccatttattctttctataacattcttcctttcttatatagacctgagtttctgacctatattatttaccttcttctgatgaacttattttcacattttttgcatggcaagtctgctgatgacaaattccctcaaattttgtttttcccttgaattttaattttcatgtatttttactgtacccctctcttaatcgccttggtgaatagtttatctattttgagttgttatttattgctgttacttttttccatagaacaaaatatcagatttggtagtcagatctgcagtttttctgtcttttttttattttctgcttttatctggcacatagaatattctgaataaatatttgttgaatggattattaagtaaatatttcctcatccttttttaaaatcttttctacatttttttaaatttttttatttccacaagttattggggaacaggtggtgtttgcttacatgagtaagttctttagtggtgatttgtgagattttggtgcacccattacccgagcagtgtacactgcaccctatttgtagtcttttatccctcgcccccttcccaccctttccccaagtcctcaaagtccactgagtcattcttatgcctttgcatcctcatagcttagctcccactgatgagtgagaatatatgatgtttggttttccattcctgagttacttcacttagaataatagtctccaatctcatccaggttgctatgaataccattaattcattcctttttatggctaagtagtattccatcataagtagtattccatcatatacatatttgtatcacagtttctttatccactcattgattgatgggcatttgggttggttccacatttctccagttgctaattgtgctgctataaacatgcatgtgcaagtatctttttcatataatgactttttttcctctgggtagatatccagtagtgaaattgctagagcaaatggtagttctatttttagttctttaaggaatctccacagttttccatagtggttgtagtagtttacattcccaccagcagtgtagaagtgttccctgttcagcacatccatgccgatatctacttttttttcattttttgattatggccattcttgcaggagtaaggtggtattgcattgtggttttgatttgcatttccctgatcattagtcatgttaagtattttttcatgtttgtcggccatttgtgtatcttcttttgagaattgtctactcatgtccatagccgactttgtgatgggattatttgtttttttcttgctaatttgttgaagttcgtggtagattctggatattgttcttttgtcaaatgtatagactgtgaaaattttctcccactctgtaggttgtctgctctgctaactcttccctttgccattcaaaagctttttagtttaattaagtctcagctatttatcattgtttttttcttttcttgcctttgcttttgggttcttggtcaagaaatccctgcctaagccaacatctacaaggatttctctgatgttatcttctggaatttttacagtttcaggtcttagatttaagtccttaatccatcttgagttgatttttgtataaggtgagagatgaggatccagtttcattctcttacatgtggcttgccaaatatctcagcaccatttgttgaatagggtgttctttctttactttgtttttgtttgctttgccaaagatcatttggctttaagtatttgggtttatttctgggttctctattctgttccattggtctatgtgcctatttttatatcagtaccatgttgttttgttgactgttgccttatagtatagtctgaaatcaggtaatgtggtacctgcctccatatttgttcttttttgcttagtgttgctttggctatgtgggctcttctttgcttccctatgaatttgggaattgttttttctagttctgtaaagaatgatggtggtactttgatggtaattgcattgaatttgtggattgcttttggcagtatggtcattttcacaatattctacccacccgtgagtatgggatatgttttcatttgtttaggtcatctgtgatttctttcagcagtgttttgtagttttccttgtagaggtctttcacctcctttgttaggtatattcctaagtatttttgtttttttatagctattgtaaaaggggttgagttcttgatttgattctcagcttggttgttattggtgtataggacagctactgatttgtgtatattaattttgtatctggaaatttgctgaatttgtcagttctaagagctttttggaggagtctttagggttttctaggtatataatcatatcatcagcaaacagtgacagtttgacttcctctttaccagtttggatgccctttattttttctcttgtctgattgctctggctaggactcccagtgctatgttgaagaggagtggtgagagtgggcatccttgtcttgttccagttctcagaggaaatcctttcaacgttttgccattctgtattatgttagctgtgggtttgtcatggatgacttttattacattatgtcccttgcatgccaattttgttgagagttttaatcataatggagtgctggattttgtcaaatgctttttctgcatctattaagatgatcatgtagtctttgtttttaattatacatatgtggtgtatcacatttattggcttgcatattttaaaccatccctccatccctggtatgaaacccacttgatcatggtggattatttttttgatatgttgttggattcagttagctagtattttgttaaggattttaacatatgtgttcatcaaggatatcagtccgtagttttcttttttggttatgtcctttcctggtttgggtattagggtgatgctggcttcatagaatgaattatggagatttccttctttctctgtcttgtagaatagtgtcagaaggattggtaccaactctcctttgaatgtcttagaattcttagaattttgctgtgaatccgtgtggtcttggactttttgttggtaatttttaaattaccatttcaatctctctgcttgttattagtctgttcagggtatctaattcttcctgatttaagcaggaaaggttgtatttttccaggaacttattcatctcatctaggttttctagtttatgtgcataaaggtgttcatagtagccttgaatgatcttttgtatttcagtggtgtcagttgtaatatgtactgttttgtttcttagtgaggttatttggattttctctcttcttttcttgcttaatcttgctaatagtctgtcaattttatttattttttcaaagaaccagctttttgtttcatttatcttttgtattttttgtctgtttgtttctatgttatttagttctgctgtgatcttggttattccttttttctgttgggtttgggtttggtttgttcttgtttctctagttttttgagatgtgaccttagaatgtcagtttgagctctttcagccttttcaatgtaggcatttagggctatgaactttcctcttagtaccgcctttgctgtattccagaggttttggtaggttgtgtcattatttttgttcagttcaaagaatgttttcatttccatcttgctttcgtttttgacccaaaaggagcaggttatttaatttccatgtatttgcatggtttcttcttatttgtgtttgttttgtatctcttttcccatcatactattctgtgagattgtatagagaattatagatgcacatttcttggtgaaagggtagagtgctttcattacattagtagtctaatagaatcagaattcattaaaacttgaaaaacactagaataagaataatttggggaagataatcaaatacaatagtaatgatagttatactattcaaagtcaactcttgcatagagacttcgtgttggaaatatttgccaaaaagaacagaaatcaaggtgaggtgctcttaccaaaatagttgaaaaggtctttcacctttttatatggcaagcttcccctgccacccaagcagtgacactactgtccttgatttgttggcataggattttaaaaattttatctccaatcatgacagtgtgagggactaacaaagtcattgagtttcattattgttgtccaggaactaaaccatcttgttgctgattgtttgctgaaactttacctaattatagtgttttttatgcttgatatacagccagacatggtgtcttattttgttttgcttttgtatatgactttaaatcaataaaaagtaaacaaataaaaggtgaaatacatatgcagtcatctggaaaaaaaaacaccttttttatttttttgtaaactgggattcacaaaaacaaataagacctgccatccattctcagagttatttaagtagagtatattattgcattcaagagacagaagaggtactctaggtacagataatttattaagatttccaatgtacttttgatattgcatatcatactggaataaatcagacaaatcagaaagccttatgtgagagagattgtgtacaataatccccaatttgtttttaggaaagaaagaaaagttattcatgatgacagaaaccactctctgttatgaatgccctagataggaatatagcttgaaaagtgttcaggtttgctgatgtgaagaaagctgacagggaacataaaatggtgagtaatctggacagagttagtttcatggtggataaatggcacactctattaagggtgaccaaatataaaacacaaaagagtttaaaatgaaatataaaaaaaaatttcctataaaaaattgaaagcagactcaaagatgtgaaagtagattaggcttgagataaaaagcaatattactgtagaggaaaactcgagaaaaaataatctaaaacataactgaatatcttaagctgaaattatctttataaagttggcacctaatctaattttaggagtgatggtatttcaaaatttctgctttctacgggtcattggtccctcatcaaacagttatttgacatgtactgtgaaccagaccccagggacaaagattaatattacaaaatacctgccctcaatgagctcctagtcctgtaaaaaagagacatgagcaaatatatttaaaatacctaaagttgatgatgtaatttattgggaaaaggttgtggtatttgccagtcttgagtgaagagtagggcagagtagggctttaaccatcagggaaaaagagagagaaaacattccaaatagagaaagagacataaaggagtcttgaccactagacacagtttggaatggtctttgcagttacaaattagttcaaccaaagtttgaacatgtgaaactgggatgttctttactatattcttgacttaatgctttgtttttaaaggttggaatgagtcagggcattacatttccctccctggacacctttaactcatagacacaaaaggctccatcataagtgacagaatatagctgaatgtgtggatagaccctgattgcacaatttaagtcaaccaagaagctgaacacaatgtggctgttgatagtagtgatgagagtcttcctaacttcactgcctttattgccaccacagctaaatcctgagggggaaggttgcacacagtagacacactggcaaatgttaaataccaggaaaaacactctgtgaaagcacagtgcctgtattatttatgcataatttctccttgatgtttacctggcccctatagttctaaatgtttgaagagggaggaaatgttccaaataatttgtatagtctgacagtataagttaaaatttcatgattaagaatgtagttccacatctgatatttgtttaatctataagtctgaatggcaattttccaagtgtgccttaacttcttaataccctcatatattacatcatgttgggcttactgtagaaaatgttagggaaaaatatattaaataaattcagctggttttctgaattcagcccatttcttcttatcatttaagtgagttcttttgtcttatgcagtatcttcccagtgttctgaccaatttcagtactgtcaaaatctgctattttgattatcatttgttgtacatcccagtaatgggggagaaaagaaattaaatggctctcctaggaaaggcagaagcaagtatcaggttttattactaatcacatgggtagtcttgtagaaatgaaaatattatttatttacagtgaaatgcatatgccatagctgtaaaattcagtgaattttgacaagtgtaaatgtctatgtaatacacctccaccaagatataacactttcattaccccagggaatttccttggatcctttctcaatcaaccactctctcagagagaatcaatgctctgattcctttcaccataggtcagttctacctatcctagaatttcatataatatagtcctttaatatgtattctttttctgtttgacatttttgctcaacatcatgtttttgagattcacgcatgttgcatgtgtcaatcgatctttgctttttacttccagacagcatttcactgtacgattctatcacagtttatctattttccttttgatttttgatgaccatttggggtgtttcagtttggggttatgatcaataaagatactatgaatatttgtgtgcaagtctttatgtcaacatagattttaatatttattgggtaaatatttaacagtgaaaaggctgaatcttatggtaggtatatctgtaaccttttaagaaactatcagaacttccaaaatggcagtaccattttatacttgcaacagcaatgtatgggtattggagttgtttcacctcaccagcatttggtgtcaccagtgttttcaattttatctattccattgggtgtgtagtgataatcaattgtgtttttaatgtgcattttccctgatggctaatgatgctgaatagtttttcacgtgcatgttgtctagttgtaaataactgtttgtgaagtaactggtcaatggaacggaagagaaagtcgagaaatgatgctgcacacctacaactatctgatcttcaacaaagctgacaaaaacaagcaatggggaaaggactccctattcaataaatggcactgggaaaactggctagccatgtgcagaagattgaagctggaccccttccttataccatatacaaaaaccaactcaagatagattaaagacttcaattgaaaatctaaaactataaaaaccctggaagacaacctaggcaataccatcctagacataggaacaggcagagattttgtgacaaagacaccaaaatcaattgcaacaaaagcaaaattgacaaatgggatctaattaaacttaagagcttctgcacagcaaaagaaactctcagtaaatagacaacctacagaatggaggaaaatatttgcaaactgtgtgtctgacaaaggtttaatacccaatatatataaggaacttaaatgtataaaagaaaagcaaccccattaaaaagtgggcaaaggacatgaagggacacttttcaaaagaagacacacatacagccaacaatcatgtgaataaaagatcaacattactgatcactggagaaatgcaaatgaaaaccacaatgaaataccatctcacaccagtcagaatggcttttattaaaaagtcaaaaaataacagatgctggcgagggtgtggagaaaaggaaacacttatacactgttggtgggggtgtaaattagttcaaccattgtggaaagcagtatgaggattcctcaaagagctaaaagcagaactagaattcaacccagcaatcccattactgggtatatacccagaagaatatagatcattctaacataaagacacatgcatgtgaactttcattgcagcactattcacaatagcaaagaagcaaagacttggaatcaatctaaatgcccatcaatgacagattggataaagaaaatgaggtacaaatataccatgggatactatgcagtcttaaaaaacaggaccgtgtcttttgcaggatcgcggatggcgctgggtactcatctctgggtactaatccctaacaaacaatagcagtaacagaaaatgtagctcctgcatttcatggaatccatgtaaacaaataaggcctgccgtccattctcagttatttaagtagaatatattattgaactcaggagacagagaaggggtattctagacatagatgatttattgagacgttcgtgagatttctgttttcattcttatgaaatgcaggaatagaaaaccaaataccatgtgttctaacttataaatgggagctaaatgatgagaagtcatgaacacaaagaagaaaacaacaggcactggggtctatttgattggggaagagaagggagaggagcagaaaagatagctattgggtactaggtttaatacctgggtgatgaaataatctgtacaacaaaccccaatgacacaaatttacctatataataaatattcacatgtacccctaaatataaaataaaagtttaaaaaatattaagatgtttattttgtattactaagatatttgttctgggtacaagttctttgtcagatatatgttttgcaaatacttttttctatctgttacaggcttatttctcattaaggctgtgtcataagtgggggaggaaataccccttgtggggtctttaaggttcactccagtatggtcacggaaattatatctggagaggcataagaaattaaaggatttattatactcataggtcctagagaaggagacaccacatgctcagagggccatgcaaagtcacccaaaagccaaacgtttgtggcaggcagggaggaaacagaataaggacctctaggcaagtggctttactgagggtcatgggtgaagtagctgtggcatgcaggaagccttcttatgggtaatttgaatgtaactgagttactatggaaaggaaagaaggggtaaaacggtgaagtcatcatgagacttattgcttgaaaatatacatgttagggatgagtacccagagatgggcaatgactaggtaaaagttcaaaacaagtgggggtgggtgctggcattcaggcaaccatggagcaacaaatagctttacattgcaaaggccttttaatgaggagaagatttttcattttgatgaaatataatttattcatttttcaattaatggttaatgcctattgtgttctgcctcagatattattgcctaccttaagaccaaaaagatctttttgtacattttttgtatactttttatagttttagttatcctggttcattgaaaatgatatgatatgaagtagaggttaaagtttgcttattttttcctatatgaatatctagttgcagcagcaccatttgttggaaagagcttattttccccattgtattgctttggtacctttgcatacacacagacacacacacacacacacacacacacacacatacagacacacacacagatatgagtatgtaagcatggatctatttctgggctcttaattctgttccattgatctatttgcttatattaatgtgaatacctcactattttgattactgaagctttacggtaagtttttaagttatccaactttgttctttagattgttctggccattttagattatttgaattattatataaactttagaatccatttgtttctgttaaaaatacaaggcttctgagactttgataagaattacattgaatttttagatctatttaaagataaaagactttttattaatactgagccttccaaaccctaagcatggtatatcattccatttatttggactttcttgaatttctctcagcaatattttaattgtgtcagcagagcattcttgcacaccacccattaaatttaaccctaaaagttttatgatttgaatattttgaatgacatttttgtttttatttttcaaatgtttattgccggtatatagaatccgaatttttttctagattggattgtattctgcagtattagtgaattcactttagtttcacaggaatttttcttctgcggatttcttagaactgtatgtgttcacaatcacagtgtctataaacaacaatggctttacctctttacaatctctatgccatttatttttattactttactgaactatctaggacctctagtaaaatattaaatgaaatgctgtcaatatacatctgtgtctttttctagatctcagaagaaaagtgttgaatattttataatcatttatgtcattagctataagtttttagcagatacattgtattagtttgaagacttccccccatttctagtttgctaagaatttttccatgattgactgtttagtttttaaaaatagattttttgagccaatctaaatgattatatgctttttttctttaatattttaatggagtaaatcccattaatttaattttgtatatttagccaagcttgaattcctgtactaaattcatttagtcattatatagaacctttttttaaaaaaatgtgttattgggttttgtttactaatattttgttaagaatttttgtgtctgggttcatgagaggtattggtcaggattttgaggggtttttttcccctttgtctggatttggtatcaaagatatgctattttcataaaataaaatgcgaagatttccatctctattctctgaaaaagaatatgctaaatggatattgtacagctcttaaatatttgatagtattcaccagtgaagccatttgtgcctaagaattatttaattaaaattaagtttctaaaatgtatacagggttggtcacactttccatttcctgttctattagttttgctaagttttgtttcatggaatctgcccgtttaatctatattgtaaaactaattagcataaaattatataatatttctttatcatctttataatgtctgtagaaaggtcccttcttttgcttctgatactgctgattcttgttttaccttttcatcgtgatgagttttattaatcaattttactaatcttttcttcaaattttgatcttgttgatttccttttttttgtctttttttcactctcatttttaacattccctttcatttactttcaatttaatttgttttttattttatcttcttaagatgaaatcttagaccattgcttttatagcttttattttcctttctaatgtagacatgtaacactataaatttcccccagacgaactgctttaactgcattctacaaattttaatacatagtgtttgtattttccttatgttcagtaatttttaaaaatttccattgggcttccttgtctgacacataagtattttagaactgtgttgtttaatttctaaatatgtgcgtattttcttaaaataatgattaacttttaatgtatgacagtttggccagagaatgcaatctatgtgattattgatagtctgaaataaactagtagatgatctatcttgaaaagaatatgtatcctgcagttcttatgtgtaatgttttaattaggtcaagatgatttataatgttattcaaaactgctatatcttacagacttttgttcatttcttccaacaattactgaaagactggtgttactgtttttaactacgattgtgaacaaatctaattctccctttagtttagaaactttgagagtttgagagattttctgtgaaatgaatgcacatttaagatttatgtcttcttgatgagttgtcactttcaacattataaaatatgcatcattatctatgataatgcattacttggtgaagtctaatttgtaaggtatctatataactatattggcttctacatgattaacatcttcatgatgttttctccatccctttccttttgacctgtgtctttgtgtttaaagaatattccttataaacagcatatagttgactcttgctttttttttttttttttttttccgagacagagtctaactctgtcacccaggctggagtgcagcggcgcgacctcagctcactgcaacctccgcctcctcggttctaacgatctagcgattttagtgccttagcctcctcagtagctgggactatgggcataccccaccacacccagctaatttttgtatttatttatttattcattcatttgtttttgagacagtctcacaatgtcgcccaggctggagtgcagtgaggcgatctcgcctcatcacaacctctgcctccgggttcagacgattctcctgcctcagcctctcgagtagctggaattacaggcattcgccaccatgcctgtctacgttattgtatttttagtagagacggggtttcaccatgttagccaggctggtcttgaactcctggcctcaggtgatttgcctgccttggtctcccaaagtgctgggattacaggcgtgagtcacttcgcccagccagactcttgctttttaaatataatctgacagtctttgccttttaagtgggccatttagtctgttgacacttaatgtaattatttacaatttagattaagcacactatgattttattttctacttttctatattttctctttgttatttcatttttgctttctatttgttctgtttgctctgttacttcaacttctccttttctacctcctttttggtgaactgaataatctttagtattctatttcctctcctttattgacatttttgccatgcctttttaggttactatttattaatctagagattataatgtgcatgtttaacttactgcagtctctcttcaaaatattaactctccaagaaacacaagttttatttacctatacattttaccatttcttgtgcaattcattctttcaactagatatgtgttccatcgtcctttaacataaaaatattatgacatttcttgcctttaaaattctcctcattttagttttttactgaaatgtctttattttacctttatatttgaaagatattttgttgggtatagaagtctgggctgaacaagagtttttttcagccctatcatgtccccttttcttcttacttgccttgtttctgataagtcagcaacaactcttatcatttttctcttgtatgtaatgtaccttttctgacagcttttaaaattttattttcggtaaaatagtaaaataagttttcagcagctggatcattaattcttcaaataatatttttgccaaatttttctctctcttctccttctagcatttcaattatacattagactatttggactatttgacattgtctcacagatcattgaagctcttttctttctttttttttgttacagttttttgttttgttttagtttgtatgactccttttattcttgtctgcgagtttactaatattactttggcattgtccatctactgataaggctatacaattccttttgtttttgttttttttttttaaatgagatggagtctcactctgttgccaggctggagtgcagtgacgtgatctcggctcactgcaacctccacctcccgggttcaagcgattctcctccctcagcctcccaagtagctgggattacaggctcccaccaccatgcccagttaatttttgtatttttagtagagacggagtttcaccatgttggccaggatggtctcgatctcctgacctcgtgatctgcctgcctctacctcccaaagtgctgggattacaggcgtgagccaccgcgcccagcctataatttctttaaaaatttatcttgtagttttcagttgtagaatttctattcttttttgtagtttttctttaatgagattatataatctcatcaaggaaataagtatatgcttactttatctttttgaagagaaaaattgaacatatttatgatagctacttttataatctttatctgctaattacagcatcagtcttatccacatctgttgacattatacttcccaattatgtgtcatattttcctgcttcacattctagtagttattttattttctgatgtacattgtggtcacttcatatttagagctgaaatattattgtctttctttaaaaagcattgtctctttctaacagaggatagttaattttctggagaatcagatttatgctgtggagacttggatttggctttgttagaatgggtctaaagactactttaaggctcgtgtatccctattctttatttgcaatttttatgaaatttcagctgaatgcttgaggcattaggaaagtctctccactctgaatgtcagaactacagtatttccccatattatgcaggcttcagaaactctattcagctcacaattccccagaagttattctctgctagacctcacaaagtctagccttgcttatgtacactgtaatactcactacagtctaggagactcgtaggcagatttctggagctccttatctgcagagcgtcctcctgtcctcttccctgctgaaagattcctgcccctcacaatctctgtagtccaatgtgtttccttcatccagctgagaatgctcctccttgcatgggctccactccatatgtcaagactcgaaatgtgccctctggcaacaattcaggatcagtatggatctcacttggtgtgtttttctttcacagatcacagccttgtgttctctcttatccatgtctgaaaatattaacttctagtcatatagttgtttatggcaggaagtttgatctggtattcattactctgttatatcaggaactgaaattggtgatgctaattagtatttaatactaaattagattgagaccctgtagaatgctgcctcatcaattggctagtactctgcagacccattttccagcatttcctaatcaatttgaccacatcagcctgaagtgatatgagtgaaattctgtccttgtgattcccaatagccatgcttgcatttttcctcatttttatataggtagcatttggatggtctcttgataagctggccttcatgttttgacacattcttttagtactgcttactaagtttttggttttagatttctgttttttttttctttattacttctctcctttacttactaatttaatcttttctattgtcttcagaggtgaaaagattagcacactatgctagatatttcactttttgttttaagacatggttttcagaaatgtgtgatattttcaaacaagggcctctttttgatcacccagtacattgtgctattacagtatattagatttatatgttcttgaatccacttcctttaatggatggacctcctctaagaccaggagtcttacgaatctctatatcaatggttttacccacctctatatcagttcttattaatctctgtatctataacagtaatgaaggtcacaactgttgttttcagataacttagatgttcagaaaagtgcattgtacaaaacttagtttagaataccatcgataatcttgagtattaactttagatatggaatctaaaaataaagattgaggactcatgaatattagtgaggataaaaagtaaaatgacaaattatgaccatggcatggtttttcagctggtctccaaaaaattttcagtgttcagtctgaacctttccatgaccagaaaaaagaaagaactgagtaatctcacatttcttctgtaatcttgttctttttttgattccccaaatggcatgcttcccttatataactcacatatcacattttctaaaatttctggttctattttgttatataattacatatgcccatatctttttcttcctccgaggctgcaagatatttgaaattaaaaaaattgtgcttattttttaatcccactctagtgtgatcaaatgactactctgataaatcaatagaaactaaataaatgttggttggtagaatacaggaataattattataaattgggaagaaatcaattaaattttcaattttaacttttataatttctaagaaaaatatttaaaattattttaaatatacgttatactagcttaggctaataaaatagatctctagcatctttattttatgtataagtaagaatagctttttattaacacaggacactataaaacacaagttctttttaaaatggtagaaatggaaagctcaaaaatgcattaatatttttaaacatttccaatatcttgttaaaattctggtttgcctactaataaaaaatcagtaaataagattaactttcactcctacattaatgttatctgaaatagcacaagtcctgattaagcaagtaataattttctatagtggttgctctctagctagatcatccccaaataatgttaactaagctttatccttcaacaagaaaagcctagactttctgaagatttcctttataatacaggatccatgtctcatacacagatgtagttttgatttatcatgcccaaggacagacttaaacaaaatctcactaagtattttgtgcttcttatgaaagaaatttctgggtagaagttccatatgatttttctgctcttaatcctatgaagatagtaagcataatgttgccctttacagataagaaactgtaagctcggaggtgcctgtaaaaatgagcatgttttattctaggttcatttctaggcactcctcatggaaatatggagtggtttgagactttccaaaaatgttggtctgaaattaatgaacagctgtagatctttagcttatggaaatattccattcaagtcaaaagtctgatctggaatttctttcatagtgtattttgaaatccatatttagatcatacccactaatgaatgaacaccaattaccaaatagtacctacccaaatatggaatggtcagggcaatatttcccatgcaaatccattgtgtagtcaagtaaattttcatcactgcttgtccactttctctactgcttctctttccagtctcaaaaccacttattattgccgattcttcttggttcctctgtgtaggtattttacctgacaatataaatgtgactttatttttaaaaggaaatagtaagaaagcaaatgaaacttctctgtgatttgtgataagcagaataaacaaaacacaatattttcaggatagaagaataaagaatctgtgaagaatagctttagtaacttggaaagactgatgaattagatcacaaaaggattaatgcatatcatgcttatctcatgcgagttaatggttcaaataattctgaataagccaaatagtcattttagcattggattagcaacacatctatgctctgctataaaaaaattatgcagggtaataacagaatcgcttttcctctctgaaagctatatagaataaaatttaaaatacgctgcagtagtagcttttaattccgatttttagactttccattctctttttattcctcatgtgtaagaggaacaaaaaaataataaaactaaaatattccttttactttgtggaggactttttttttctttcctgaaggaaatgcctttttggataattccttttgtttttcatatatatttttaatccacactctcataaaattaaattgaagaataagactttctagatgtcataaaaggatatttgagaagattgtgctttaataggatttaaatgaagtaaagacttagcttgggtagctcagaattggacaagttttgcccagccttgcatagtatctttttaattaaagaggctatgaaaattctatttggagtaaaaatctacattggcctgaggtgtgcgttccatctttcccctttccactccttgagctagctattctttgagcttatattactctacaaacagctcactcagtaactccatacgccttggtcatttcactgcagttagagcatccaattcccactgtcagacagctgtgaagagaagcaaagagcatttaaggggcagaaagggtagtttctcagagcataatttttattttattttttttccgtttctttgttagtactgtttgcctctgcctggagtggacttttctgcttatttcctactcataagatccccacaaaagtttcttatggtttatttcttttataaaatttttgatctaatctccattgcttaacacaatccctcgcacacagggggtactcaataaatatccatctgtgtggaaatatgaatatgtagctgagttgaaataagaactgggctgtttcttacggttccaatctattcttctattcaacatagcagattagggaagacgttctagaggggacactgttctcctctaagactgtcagtcggtttgctagaaataaggtgaaaaaaggcatcacatttgaaaaactattaagggaaaataagaaaactatcagtgtggtgtagtagtaatagaaagggcatagccatctggactcagacgcacagtgaaattacagctctgtccacttaccagatacgtgaacttgggcaagtgtttaacctagatgagtgtgttttctcgtctgtaaaataggaaccattattttacctggaatgtggtggcatatgtaaagcatctagcaaagtgtctgtcacagagaagatggtaaataatttgtaataaccatattactgttgttaattagttcatcgtggtgggagtgttgagtggagaactaggcaggagatgaagctcaaaaagcatgcttatttaggttttgaagacattttacatgatatttggaacagattgctgcactttatccaaatatatgtgggcttttgttttctttcttatcaaagctcggtggagagaaaaaaatccatgctttgatgattctttaagacctgagcaatgtctattagacgaaggcagcttagaaaaaagatattcaatgtagttcaagttaaaaacaaaagaaaactaatatttaatgcggttaaaaatgagattgtgttcaccttataggtttgttttcaaggtaaatatttaaactgagtaaatcattttttcctaaaactacttggtgagtatcatcatgcccttcattgccacataaatacaaatttgagtttaaaatcttagattacaatgtagaagctaatcaaagcagttcactgtttttattttttatttatgtacaataaaattcactcttttgtggtgtatagttctgagtcacataaccactaccagaatcaggatacagaacagttcactcacccctcaagatcccctagtattacccctctgtggtcaatattaatccccatttcctaacctttggccactacctgtctgtctctatagtgtctgtttctttagaaagtcgtataaatggaaatatacaatagtcaacctttgaatctgttttgtttttgttttgtttttgctcagtgcaatgtatttgagattcattcatggtgttacatgtatcagcaattgattcctttttattactgagtagtatttcatctataacatggaatacttctcagcaacaaaaccactgtttctttatccactcaccagttgaaggacatttagggtatttctagtttggggtgataatgaagaatgctgctataaatatctgcatacaggttttgatttaacatagtgttcatttctgtagggtactgctgtgctgtggcctaggtgggttataaagatgtatgtttaactttataacaaattatcaaactgtttactagagttgctgtactatcttatgttccctccagcaatgttagagtttctcttgctccgtatcctcaccacacttgggatgtctctgactttcctctctgttctcaactggagacaacactaggcttttaaatggatcatgtgattagattacttatacctcaataatctcccttttcaatatagggtaacacacaggaatgatatctcatcatacccacagttccaggcattaagctggaaaatattgggaggccatttttcgtattctatctccttattttctttttttttataatttcaacttttattttagattcagggatacatgtacagtttcattacatgggtatacttcgtgatgctgatgttcagaatgtaaatgattctgtcaccaaggtaggacctgacagtttttcaactctttgtccccttctctcactttcccctgtagtagtcccccatttctattgttcccatctttatgtcaataaatacccaatgtttaggccccacttataagtgagactatgcagtatttagattgctgtttctgaattaatttgctcaggataatggcctccaggtgcatctatgttactgcagaggacatgatatcagtcatttttatagctgcatagtattccatagtatagatgtaccacattttctttatccagtccaccattgagggacacttaggttgatttcacgtctttgctgttgtgaatagtgctacaatgaacatacaagtgcatgtgtctttttggtagaattatttatattcatatatatatatatatatctccagtaatggaattgttgactgaattgtagttctaagattcttcaagaagtttccaaactgctttcacagtggctaaacaaatttacatttctatcaacagtgtataaatgttctcttttctctgtagcttcaccagtatctattgttttttggctttttaatagtagccattctgacacatcagatggtatctctgtggttttgatttgaatttctctgatgattagtgacgctgagaattttttcatatgtttgttgtcttcttttgagaagtggctgttcatgtcttttgcctgctttttaatggggttggttttggcttgttgagttgtttaagtttcttagagattctagatattagaccttcgtcagatgtgtagtttctgaatattttctcccattctgtaggtgtggtctgttgatagtttctttcgctgtacagaagctcttttatttaattaggtcctgcttgccaatttttgtttttgttgcagttgcttttaaggacttattcataaattctgtcccaaggcagaatttatttctgtccagaatggtatttcctaggtttccttctgggattcttataggtggaggtcttacttttaaatctttaattcattctgaattaaggttcatatatggtgaaaggtaggggtccagcttcattcttctgcatacagctaaccagctatcccaggactatttattgaatagggagtcctttcccattgcttatttttcttgactttattgaaaattagatgttcataggtgtgtggcttatatctgggtctctattctattctattgatcaatatgtctgtttttgtaccagtaccatgctgttttggttactgtaggcttgtagtatagcttgaagtcaggtaatgtgatacctctggctgctgctttttgcatagaattgctttggctacttgggctctttttgagtttcatataaattttagaattgttttttctggttctgtgaaaaataacattggtagtataataggaataaaattgaatctgtagattgcactgggcagcatggccattttaaaaatattgatccttccaatttgtgagtatggaatgttcttccgtctgtgtcatctgtgatttcattgagcagtgttttgaagttcttgttgtagagatctctcacctccttggttagatatatttttaggtgttttttgtatggctattgcaaattagattacattcttgatttggctctcagcttgaatgttactggtctatagaaatggtactgatttttgtatgttgactttataacatgaaactttactgaagttgtttgtcagttccaggagccttttgacagagtctttagggttttataggtatagaatcattatcagcagtgtggacaaagagttttacttcctttcttcctatttggatgctttttatttttttctcttgcctgattgttctggctaggacttttagtactatgttaaataggagtggtgagaatgggcatccttgttttatcccagttctaagaaacattttcaaatgctttcagcttttgcctgtttggtattatgttggctgtgggtttgtgatagatggctctaattattttggagtatgttcctttgatgcttagtctcttgagggcttttattatgaagagatgctgaattttataaaaggctttttatgcatctattgagataattgtatgatttttgggtttaattatgtttatgtggtgaattacatgtattgatttgtgtatgttgaaccaaccttgcatctcagaaatgaagcctacttgatcatggtgaattaactttttgatgtgctgctggattcgatttgctagtattttgttaaggatttttgtgtctatggcctgcaggttttttttaattgtctttaccaggttttagtattaggctgatgctggtttcatagaatgagtcagggaagagtccttcctccttgatttcttgaaatagtttcagtaaaattgatactagcttttctttgtcgggtagaatttagctgtgaatctctctggtttggggcttttttatgtgactgattcaatttcagaactcattattgatttgttcagggtttcaatttcttcctgattcagtcatgggaggttgttcatttccaggaatttatccatttcctctaggttttctagtttgcaggcaaagaggtgttcattatactctctgaggatctttttcatttccatggtattggttataatgtcacttttgttgtttctgattgtgcttatctggacctcttctgtttattttttaatctaagtagtggtctattgaaattgtttatcctttcaaacaatgaaccttttgttgaccctttgtatggatttgggggggtctcaatttctttcagttctggtcttgttttagttatttctcttctattgctagctttggggtcagtttgttcttgtttttcaggtttctctaggtacaatgatagatcactaatttgagatctaagtttttgaggtagggatttagtgctttaaactttccttttagcactgtttttgctgcatcacagagactttggtatatggagtcttttatttcaaagattttttttttgactttggcattaaatttgttttttacccaaaagacattcagaagcaagttgttatatttccatgtaattgtgctgttgggggcaggggattttcttggtgtggatttctatttttattccattgtggtctgagagtatggttggtgtaatttcaatttttttttaaattattgagacttgctttatggccaagaatgtggtcaatcttgttgtatgttccatgtgcagttgagaagaatgtatattctgtggtttctgtgtggagtgttatatagatgtccattaggtccaactggtcaaaatgtctaagttcagaatttcttttagttttctgcgttgatgatccatctaatgctgtcattggggtactgaagtccctgatgattattgtgtggctgtgtaagttttttctacagttctagaagttgttttatgtatctgtgtgctccaatgttggatgcatatatatttaggatagtaaaggcttcttgttgaattgaaccttttttcattatttgatgcccctctttttcctttttttaatgttggtggtttaaagtctgttttacgcaatttaagaatactgaccactgctcttttttgttttctatttgtgttatagaaccttctccagccctttactttaacctatgagtgtgtttatgtttgagatgggtctcttgaagaccacagatggatgagtcttgttttttatccaactagcaactctatgccttttaagtggggtgtttagactatttacattgaaggttaatattgatatgcaagatttttatcctattgtgaagttgtttgctggttgctttatagtttctattgtttggttgctttatagggcctgtgagatatgcacttaggtgtatttttatggtagcaggtgtcattaatttgtctccatgtttataattcccttaagggtctcttgtaagccggttctaatagtaacaaattccttcagcacttgtttgtctttaaaatattttatttctccttcacttagaaagcttaatttcacaagttgtgaattcttggttggaatttcttttctttaaaagtgctaaaaatagaccccagcctctcctgacttgtcaggtttgtgctgagaagtccactgttagccttaggtggttccttttgtacatgatctgatctttttctctagctacctctgagatttttttcttagtgttgatcttggacagtctggtgggtaactgctttggtgatgttcattttgcatgggatactgcaagtgttctctggatttcttgtatctagatgtctacctctctagcaagattagggacgttttcttgaattagcccctcaaatatgtttccaaggttgcttatgttttctccttctctctcaggaatgccaataatttgttggtttgttcactttacacaatctcatatttctcaaagactttgttcatttttctaaattttttttcttaatttttgtctgactgggttagttcaaaagactagtcttcaagctttgaaattatttcttctttctagtccagtctattgttaaagctttcaattatattttgcaattccttgagtttttcaattctagaagctctgattgatttctttttaagatgtttgtctctttcttcatttcattgatttatttaggagtttatttgtgttgacttttaaccttgttttagatatcattgagcttcctctcaatacatgctttggattctttgtcatttctgaatttccattctggttggagaccattgctggagaactactgtgatcctttggtggcatcactacattcagatttttcatggtgccagaatttttgcaccatttttttctcatccagagataataggacttctaatttttataattatttaactgtgtgtaggatttttcccttttttctttatttccctataatatcattagcgggttttttctttccctttctctttccccccactccctgtggggtgtgaccatagagaatgttgaatatggttttttgttttgcttctatagccatatgcacttcctcttggtaaatttatattgagttctgtggtttgacttacaagccagtagatggtacttatgggtaagagctggttgtggccaacatgcctgggtatatattttattcttgtttaccagtagaagctctagcttctacctctagcaatgggctcatccatggagcccacagttgtctgagctgtctcctcagtcctgaggggtttggggacccagatgggtgaggtcagaccgggcaggcccatgtacaggtcccccagtgtcagccacatgcatcagcaccaaggaagaaatgagtgaagggccaccaagcccccaaaggtgtgactgggcaaggggctgggaaaccttttttgcctgaagttctctgcacaagtggcaaggtcagcctaaactcctgattcaggaaagtgtgtgctccagatgcctggttatctgcctcatcatagagtgtagagggccccactgcaccacaatttctgcacagaaagggtggggcagttcaggcttataatccatgcaaatatgttgtgctctgactgcctggagatatgcctgggcattgggcagagagggccctgcttcaccacagtctctgcacaggaggagttgggtggctcagtctgctgatcgaggtgacttggtgctttgactgcctggagatctgcttgggcatgaagtggagagggcctggatgcaccatgatttctgtgcaggaaaggtgaggcagctcaggctgtcaatccgggtgagccggtgctttgaatgcccggagatctgcttgggcacggagcagagagggcatcgctgcaccagaatctacgcacagtaagggttgagtgcctcagactgctgatccaggtgaccactacctcccatttcttgtcagttttggtagtttttatctttcaataaaatgattcatttaatctgagttgtcaaatgtgggggaatagagttgtctataattttctcttaatatcattttaatgcctgtgaggtctgtagtattatgtcttctttcatgtctaatagtaatttgctacttctctctttggtcagtcttcttagaagtttatcaaattttattgaccttttcaacaaaccaccttttgatttcattgactctatctgttgttttctattttaaatttcatttattttttttcttttgcctttgacatttctctttttctttgcttggttttggcttaatttggtttttgttttctaatattttaatatggaaacctaggttattgatttgaatttttcacttataattcagtatttagtgctgtaacttttcagtatttaatgtacaacttttttctctaaagctttaaatgcattacagaaattttaatatgaggtgtatcagtcagtttccacaaaagaaactctgtgtgtgtgtgtgtgtgtgtgtgtgtgtgtgtgtgtgtttgtgtgtacatacagagagagagtaggggcaggaaattggctaatgcaatcgtgggttctggctagacaagttcaacattcatagggcaagccattagaaactggaactcttgggcataagttggagctgaagctgcaatctatagttagaatgtcttcttctgcttcagggaagcctcagttctgctcttaacgcctttcaactcagaatcttcttgcttaaagcaaaataattatacagtaatcatgtctacaaaatacctcacaggaatacctagactcatgtttgattaaataacaaggactacctcttagccaagttgaaaatacagaactgaccatcacttgtggtattttcattttcacttagttcagaatatgttctaatgtttcttttgacttcctctctcatattttgattatttgaaagtgagttatttaattttccaatatttagaggtttttaaatatctgtttttgatttctagtttaattttgctatgatcagatggtctttatttcacttttttctgaagaatgtttttggttaatatagaatttagaattaatggttcactgtcaatacttcaaatagattataatactgctttctggcttctatgattttcactaaaatacgttgtcatttgaattatttttttctatatgtaaagtgtttgttttacttgttgttttcaatattttttctttatctttggattttagtgttttaagtatgagaatttgcatgaaattttttttttggtggtggggggtgtttctcagcctcccaaatctgtaaatttatggctttccacagatttgagaagtttttagctatttttttctgcaccaatctcttacctgccccctctgggattctagtaacacaaatgtaagacatgtcccacaggtccctgaggctctgctcatatttttttatttgtgttttctctcttatttataaaggattatttctgttgatctacttttcaaattcaatgactcttcttttttttctggcatctccattctgctattgcattcatccagtttattttttagttattttttatttttaaaatatttacttcgtgtttatattttctattttttacaacatttctttccatccattttaaaagaatttttttcttttcatagaggatagttacaataactcctttaaaatctttgtccaataatttcaacatcatgggtcaccttggggattgatgtcagttgattgacttttgagatgctcttttttatttttagtaatttgggattgccttatggtcatttgagtattatatattagactctggtcctgttaaaatcctctagagaagatttttcttttcttttctttccttttttttttttttttcatcttagcaggtaatcagtctcccatggttcttgtcataagtctaacctcaacctgctctatttagactctggcttctgtgttagtttagttttcaattcctttgtagagctagtttgtctgctccacacacacataccaaccacccaggggtcaacctgagctttgttctatatcatagtttaattatcaaagcagttgttacgctgccttggttaatttcaatgcatgcgccaattagtggtgagcctgagacttcatacacaaaattaggtgtactttttctctaccactttctcctccatgatttctcttcactctctagtccccaggggcttatttctctggtcttctgtcataaatggcagggctttaggttccctatgctatttcacacttcccatgatgacttgcttcccttgagggcaaaacaaccagagagagactggaaagagaaaattaatgacgattcacacacacacacacacacacacacacacacacacacacacacagagagagagagcgagagagagaacaataggaacctagttttccagtttctctgctcaaaaaaaaaaaaaaaaagaatgtcttccagagtttgaggtgtatgcatagctgctgctttcactagtctaaggctttgtgactggggcttttctagaatacagacaggtacatatgtttcccttgaagcatttcctgtctctgcttgatgtgcagttctgggatttgggctgtcctagagtccaagctggaggattaagaagaaaactgaaaatacctttaagcttaataccatattgatactactttccatttcatttcattccccaattcacctgtcattatttacttttctgaattttcagatagactccttatatttatttatttgtaatcaatggaaaatggaggatggtatatgcttaatcacagccagagctggaaccaaaccaaattacatatttttcttctattggtattctcatgttttcttctcgttttgtttttgcttatctgtttgttttgtttgctttgtttttacatcatgaatattttagcctgatatgtttgagttttaaaataattttccttagcctgccttgctaaggtatatttctcttttcctgtaaattatctagagaaaagagcccagatattacttaaggaaaagccattcacaactgtttcaaaaatataatgaaccgcaatattgaggaaaaaataatacacttttatattccctgtctagtgtttttcttcttgcctttaagtttcccttcctaggcacaattatgagctatttatttactttaataaaagcaaacatttcaccctgtgctatctaggaaaggtaatgaatccagtagcaaatggcctgctttgaacataatttctaaatgagattcatgtggaatagcctcacttacccactcaaacatacacaatttgcttgcttgcccagggaattgaacctaagatctcttggtagagccaagggaattaatgccaattatcaaaaaaaaaaaaaaaactcagttattttcagtagaatcatacttacatggaatttgaggcaattctactaccactatctgttgactactctaattcctaatgctacgtgtttttttctttgcagctacatacgtcatttaatgaacttcacattgaacacttactatatgttagcactgtgccacagattgaaggcacgacaaagatgaattagatgagtccctgccttctaagagtaaaggacacagaggcatgcacaatttacgagactatttgtcagactgtgctgagtgctgtattttacagaggcagaaacagccttctctgggaatatacacaagggagggatgattcacccctctcggggggagtgagaaaggtttcctagaaagacaatgcttaaaattagctttaaggttgcattacacagtggataagtacagaatacagggaatgtcattcaaagcaggagtatctgcaaaggcttggaggcttgcaaatgcatggcactctaggagagcagaaaatagttgaatatagctggtgtgtggcacactccattttgtttttattctcttgaactaagttgtattatttttcttacttcatggtttgggcagtgatggaattggccaaactatgaaaaccaggacttggactccaagtagatgtgctattgcaggtgctccttggaggcagtgatagatggttacaacttggccttcacttgcatccaccctctatgtggaacatgcttcctatgtgactctccagaactactcaatctcctgccttccttagtgaaccataccatcactctctctttacaaaaaaaaaaaaagttttcatatattcagggagtagcaagtaacttcttaagagcagacatcatcttattcaccccaatgttctaccaccatgcctatgaaattagatactctcataataaacagaaggaaaaaaagtgataaatgtaaatgtttcagtagaaccagtgggaagtgagatggtacaaggcctgccttgaacaccttggaataacgtttcttactttcctttcaatttgtataaaatcgttacgaaataaatccaagttctactttaattaactcgcaaaatacttgagctcatctattaccctctattcctgtagaatatttataggcatattttaaaactgaggaaaaacaatcatattttttgtaaaagagtttattatttcaacagaaaataaaagcaatctgggccagtactgaatacagaaaactaggatataaagaggtaagactccaggtgccatttggacttaattctgccattctgtataatagcatgaacagcatctcctacctccattcttgagactgggaagagcttggcagacgctaaagggcccctgtagcatgtgtagttcccttaaaaatgctgactgatttccctctgctttgggtgtgggtcaaaaaaaaagcctctgcttttttgtaggtctaaagaataaaaagttttttgctgaaccaaaaggaacaggaagcctctcaccactgccaaatgtatcattttgatttccccataatttcttttctaccctaagggcttaaatgatgtttaaggatgggtaagattcatagttaatggatcaatccagatccacttcctgtttttgctaatacaagcagtgctgcaatgtgcactgttgtatgtttctcttactctacattaaaaaacaaatgagaagctaaaatttctatctgttgaagacaattatttttgtgtatccacacaataaaatactatatagaacattcaataagtgaactacatctgcaaaaatcacaaatgtattgttgagtgaaaatcaaaatatgtacagctgatctatatatagaatgaggtcatatgtgtacaacaacatacaaggcaatcaaatataacttctgggatacatacatgtgtagtgaatatataaaagcaggccaattaaccataaatgccaaatcaggagagtgcttaattctgagtaggaagaattagaatcaagtctccttagaatcaaggagacttacatggagaaccaagtattgttttatatctttaaaaaaaaatctgaatcaaatggcagaatgttgagatttgataaagatggaaaatgagtatacatgtgtttttaatatcattctttatgcttttctataaaatatttcttctaaaaattattaggtggggaactgtctatactatctctgcaacatttttggaaatctaaaattagtccagattttttgttattttaagttctgggacacatgtgcagaatgtgcaggtttgttacataggtatacacgtgccatggtggtttgctgcatccgtcaatccgtcatctaggttttaagccccgcatgcattaggtatttgtcctaatgctctccctcccctttccccctaccccctgataggccccggtgtgtgaggttcccctccctctgtccatgtgttctcattgttcaactcccacttataagtgagaaccaaaaagttatcagatctgttattggtttacaaatggctttgtctttaggtctaatcaaaagaaccagagcttagagtagaaggctttgagaccagagaaaaagcttaggtgggggagtgattcattttggctggaaggtttctcagaaacaggagcctctgatctgagtcttgattcttagggagaatattgattgatgaaagaaaggggaaaaaagtaaaagcatgcccaagagagtgggcagccagtggcatgtttgaggagtggcaagttgccacggtggccaaagcatgagttacctggagaagtggagcagaaaatgaagctggagtggaagctgaatttccaaaaagcacctggcttgctatgctaaggaatgcggactttacaatgtggaaataaccaaggtttctatgggtggtgacaaagtccaacctgtttagcattctgaaggatggtagagatgagttgaggccatcaggaaacctctcagaggtaatgaggctctgagataaaaaaaggtgaccacttcgagatgcagaaagatgaaggagcagtaggaaaccagtttttctcttcttttttgcctcttgctttcttctttctctttttcactctattcctttcagtacttctcccaaagttttcagttcctttatgaaggccatcaaatactccacccaagagccgggctatttttaaaaatgagatgcagtgtattctgtgggaaggtcaccagtaatagagcctcaaacttcctatctcttttgtgaatcttgacagcctgaaaagaagcatacattatctgttacacagactccctggaaggaactgatgttctttcctctggagctgtaatggggtctctatagaaagaagcctcatccctcgacacgcaacctcttttcatttccttacagaggagctgctttgtgcctgcaaagggcaccagggcttccaatttaataattctgaatatcactgttgcacagtattgtactcatttgcagtctctcctgtgcatctttgatgacctttcttggcttcagagaaagcagaataaaagcaatctgatcaggactttattccagctggtcactctctgattaaaccagtgccagattttacaagcatcagaacactggtttgggagtgaggatatctggttttttttactagctctaggacgtagtgccttagcttttttatttataaaccagagagcattatttagaaatcctctaagcccattcaaatcctaagcttatgtgactccgtgactccctagagtctaaagatgaactgtcttcatttgttcatattttatgaccatctgctgagtgcaaagaagtggatgcctcaagtgcttggaaatgcttagagagagatggttggcttgtgctaaatttgcatttcaagggaggcataaaaatggaagtaaatgaacttttttaatgtttagtttaattttcctcaaaacaataaaaatttaggagagggagcattggaatttgaatctgaaattataatagcatacaagctttgtcaaactggcttgtaacactttagtttaaaaagtcacttatctttgaacctcagttttcctttctgtcaaattgtaacactttagtttaaaaagtcatttatctttgaacctcagttttcctttctgtcaaatgagaataatgtttgtctctcagagtttgcagaaaacaaatgataatggacttgaaaatactttatggtggaagctctaatcacaacagagtaatacttatcactattaaaattggttttatttgttggtttaactttcttggagcactgagcaattgccaggtacagtgtctggcactgaagttttgtaattcagttttgaaaccttgctttccctttttatgtttgatatttgtaccctttatatatctaagagcaacaagttaaaaagttataatggaagaaaagatgccatcacaataaccaaaatgatcaaatatttaggaataaaagtaataatatgcaagatttatatgaattaaaatgctattggtatatttatatcaaatatattgtacactataaatatacacagtgctccttttgtgaattaaaaaatgtttaatactgttgagaaacaccaaaagagacttgaactaataaaaagtggctagttcttgagaagactcagatgtcaaatatccctaatctacaaacgtattgcaattcccaataaaatttccagcaggaaatctagacattctgataacaaagttcaaattaaaaaaaaaaaacaaaaatatccagggactattcctatcagatattaaacagatattcaaacaatgtggtagtggagatggaaaagacagagtgtaatggaatacaatttaaagtctggaataaacccaaatacatgtgggaattgagtatataataaagatggtatttaaaatgagttaggaaaaaagtttttcaataaatgtttggatcaaccagatagccatctgtgaaaaataaagctagatccatactcacagcttataccaagataaactcctgatggagcaaatatttcaatgtaaaaacaaactggtactagaacagactgcatcagtctgagtccaatcaggagacaaaccacacagtgatttaaacgaggaaagtttgtataagactttgaatctaggctgcatgcagtgactcacacctataattctaatactttaggagactgaggcaggagtatctcttgaggccaggagttcaagaccagcctagtccttttttaattctcctattttgaatgacctccacaaagcaagttgctgtagatatgtcacataagtctctggatgggttttcatataggatgagtcactgctgctacttcccctccacaaatgcatgtgagtctcagctttgggaagaatgaaataaaggcagtgtgtgctttggaaagcaccagagcagagccttgtgcctcgtgctctgagtctatgttgctattgctgacaggtaaccctggataagacattttccctttctatttatcactaaaaaacaaaagagctggaccaagtgtttcttagtattttcttaagacctaacattttttatttttaccatttgttgtggttaaattgtgctcccccaaatttattgatcttcttttagttttaattttttttttttgagacagggtccctctctgtcacccaggctggaatgcagtggcatgatactggcttattgcagccttgaacgcttgaactcctgggctcaagtgatcttcccacctcagcctctcaaatagctgagcatgagccagtgtgcagttacatcccctttcccaaatgtacaagttgcagtcctaacccccggtacctcagaatataacctcacttggaaaaagggttgttgcaaatataattattcaagttaaatgagaactctctccagaactgtgagacagtaaagttctgttgtttcaccacccagtgtgtgatacttgttatagcagctttagcaaagtaatacaacattggagagtcataccactgctggcagagggaaatacaaacgccattcaagtgaaagaaaattatatcttactttgcacttacctattcatgcaagctgttctattctggttctaatagaaagtagagttccattttaataattttggcagttaattttctcttcttcccaaagactgtttgaacatcacaatgttttgatttacagctcaagaaactcaaaaccacacgagaaaactcttactcatgccactatatatagccagagatgagcacagcattaaaaattgtagccacatgcacatagaagttattgtgtgtacagaatgtttcctcctggatacaggattcagcagtttctcaccacttaggttctccctcccaaggcaacctcagcaggttccacgaggttgtcttgaagatcagattttgttcagtatggtagcaactcttagagtacatctgcagttattgattagtacaaagaaaggaaactcaggcatgtgaaaaataatctggtttttccaatagtaaagtaatgggcatgtttaataggcatagagcaattcataaagaatccatcacccaaatttttgcatggaggacaaaaaggtatttgtatgtgtttgtcatttttttaaaaaatcattttcttttgagttagctctttgctgtaagggatgttgttaccaaagatgattgttaagtctgatttgggcaactaagccctaagagttataagataattaagtaatggagcatcatatgcaaattaagtaactgagccggggaacaggattttgatgatttttctcctgttgcaagtagggacaaagtgagtgagccaaggctttgcttccttgggcagtttttatggtccttattgaaagaaaagaagaaatgttcttaaaacggaaatcaggagggagaaagaaaatctgttaaagacaacttgaaaaggtgaactaataaggtccttctcatgattggctcaatatctgttggagctttcattatgagaatcttggaggaggaacctgagaactttcaggagagtttcctgctacattacatttcatgtgctttgaaaataatcagggatatgtattatgtaggaattaagctaggttagtccaacacttagtaaaacctggtgaagaataatatatatttgttccttaagttggtgatttccaaaatggaatgtgcaagacaatccattgggacctaggaggaaaatattattcatctatgtatttggcaggtacctgggtgcctactaaatgctgtgcactatcctaggagctaagcacatagcagaaaacaacaacaggtgaaaaatctctgcgctcggctattttccattcaaatgggaggaatcagactatcaatataaatatatgctatatttattggtgataagtgctgtatcattcagggtcttgggaagaaacagatggcatgctcaaagtaaatgtctgaggagagtgcacgaaaagctatttatagaaagctaggcagagtttaagagaaactaacaaggaatggtgaagtcgtctagggccttctaataatagggaactatctcctccagggcaagaagcggtggcccaaatgaagaggaagcagtgattggtggtaggagaaggacacccaataggaggtgtgaccttgggagaggaaaacagccatttcccatccatagccctgcaagggtggttgctgatggaataaacgtccaggcatctctcttctcaccctccagttccctgcgagtgcctcctattggccaaacccaaagagaagccataattcaggggagcccagttgaatgtaatccatgcaaatcagcctcccagggcacagaaaaggacagagaaggggaaagcagtgtctgcaaggtaaacagaggaacccagcacaagtgttctagagtaaagaggagacagagggtcagaggtaacacaggaagtcagagaagcccttctgagattgacctttgagcagccctgaagtaggtgagaatatgaaccaagtggctagtggacagagaggcatccagtgcagggatggtgagacagggcatgtttagcaaggctaatgatcagtaagaaggtcagtgtgactacaactgaatgagagggtgctggctgatattcagtgtcttggagggtacccaatactaattgttcctaattgtactaataattagtataacagcatccatatgtaatttatgaataaatattcacatggtggcattgcacgcaaatttttttccccaacagggatatactatccaaaatttttgcaactactgccttagactgagttgctttaagacattgtagttaagtgatcttgtataatggcaggctgcacaggggccacaaagctctatagtccaatgtccatcttcacagattaagattagcccaaggttcctctatggaacatcacccttaaggctaaccttctgtagttcctgctcaacatttgcttccatacatcatactcccctcctgctttataagactctgagggccaactgtcttaataaggagttctgcgttggcttacacgctaaatgaacattctttggcgtggaatcttggccacagtgagagactaacctccttgcctgtgccttagagcctcacccacacagctctaagtggaaattttgacaaaggaatcaaagtgtagaaatttccaacatatgtgcagatattcaaacactgtcattttctgacaggtacttatggcttgattgaaggcagaggcacagagttaaaattaattcatgaatgagtttgaaaatagaagtgtaaatgagaccacaattaaagtttttactaattcttcttcccagctgtagacttttctgtgagttggttttagttatatttagttaaaaagttaaattttagatgcagtagcatgtgtgcctttgaattacacatattatataaatgttttgggtttcaaattgtgacaaagacataaattgcatcttaattgtttgatagttattgcaatcccaactaaatattgggcagaagaaaaatcctgctgccccaattacttatgctaaagatattctcaaagttatttaaataggaataacaaagtattctcatagagatcatagtatccgttatttttaacttcttcataattttatttatttttcttatatatgaaacaaatgcttactaataaaaaatcactgctgttatcactcaatatattatggacatctttctggacagtaatagtgatctatcatgttctttttaatagatgcagattaatcatacatttttagcatgtaaatataccttcaaaaatatataatatcagcaatttagcaaacatctgtgtaactctgttacaagtaataagttatgtcaattagggcccagtgaagaaaatagaaaccatgcaattatctcaactgtgataatttcatataaaataattgtttaattggatattagagggctggaaaggcacacacataaaagaccctggtgcaccacaaaaaagtcataataaaaggaaccaactaccacttcagggacggcagaataaggagaagggactgggaaaagaatttagaagctgagcatcggagagcacagaactggagactcatagcagggctttctccacctgctgttgaggactctggagcttggaggaggcccttgcagaactggaacccagtcctctggggagcgttgcagctggttggtgttggtgtgtccaaggggttatgatgagtcttgttctaggaatatgggagggtaaatctgaagagtggaaccaagtgccagggcaatgacccatcgctggaataatgccaaccggaacaggaggcaaacaggaagagctccagccttccagtgtctctctagatttcctatgggcagagcctgcaggaatgagctgacaaagcagaaatatggcttattgagcccctgccccagcaatacaggcggagtgtagaaaagtggattgaaaatggagagaacctcacaggggtggcagtcttgttgctgagtcccagcagtaaaagaaatttcactgtgtctaaacttgagttgagctcagtttccttggcctcctttacttgaagtcctaaaggataattaaccttgacaacaactagcaagttgaagatggatctgtttgttgaatgccaaagcccccaagaatgaatctagatatgtgggtttggtctatccccagctactttttctttttccttgaattttttgagccttgctgatatctctaggataggcatgtttcatattctcctaagaggggaacctcacaactggacatatgttgctccatgttattctatagggctttgcaagcagaagtgtttgatagtgctcagagagactgataaatatcctcacagccacctcctgcatcatctcaggattgtcaaggtgtgctaagtgcaccatggcccctgcacatggtgctacaagaggggcttgaaagaaagagcagaaagttttagtcagaaagaggtagtgacttaatctatgctacaaagtgctgcattgttaaaactttgcatgtgtagtttcaccctagctccaacaggacctctgtctcacattaagaattcagattatagtgtcatattaaagtgaagctaaacatctgtctgtttgctgggagaataatttccctgagtataatgtgcctttacaattgagtagaaatatttgcacagcactaatatagtctgcaaagagaccggcaaggtcacatctacactgacaagaacatatgctgtgtttacaaacctcaggtatgtgaacctttgtcggattttatgaggctctcccattcactgtagccatttgggctgctcctaccggtcttttacagtacacaaataaaggtgactcaaagtctagacaaggtttttggctttttttttttttttttttttttgcacatgaagatgcattccaaaatcaagatgttgcattgtaaaaagtgcctgagggcctctaaagagcaaggtggattctacatacagaaatacttaaataattacattataaaggccaagtagaaaaaggtctgtcatttctgagacaatggaagcattcatcatatttttgtttttactgtttttctctctgcttatcaatattttatttttcaatttagataccctaattgtgctgacagaaatgtgcgaatatatgagagccagagcaagtaaacaagaataagagaaaggtccagctgtgtggtgtggtagcattcactcagaatttatgcccaggataccttaaaaattcactcctcattcattcatcaaacaacgtatatttcattatcatactataagctacaaggattattaagacgcaaaaacatgctttctgctattgttataagacatgttacaaatggcagagacattggataaaacagaattttagaggaagaagaaagtatcacttaatgtaaggagcattgaggaaaatcctcaaaggaagcaatacttgagtccagccttggaaaatgagtaagatttgaatgagtaggcatgccaggtgagggacatggtgtgatggagaaaggaaagcaccaggacacactggaaatgtcagactctcatccagccagaggccaagatgaggagccacagaaaacaggtcccacgggatggattgctgccagacagcaaagggcagtcaaagccagactaaaggaggttcagtgcaccagtggcaatgaggagccattgagtgttcttaatccccagagatactacaagcatctgatcagtagattgaagtagttaaactaaatcaagttaattaacatacgtcttacctcacacacttatttttttgtggtgaaaacacttaaaatctgttcttagcactttccaagtagacaatgcattgtttttaactgtaattaccatgttaataaaatagatttctggaacttattccacttaactgaaattttatatcctttgactaacatctccccaattgctcctcttgtcccagccctggtaactaccattctgttctctgcttctgtgagttcaactattttagaatccacgtgtaagtgagataatgcagtatttgttttcggggcctggcttagttaataagccgccccccaggttcatccatgttgtcccaaatgacaagatttcctgtgatctttttaggatggtttggtcatagccctcatctggcctgaatttcttagctagcacaaatttctatcatcattcccacctttcctaagtgtgtttttgtttatatctgatcgtaagtaccaatgagcagttcagactgtgtgactgtgagaggtgtaatcttgcatggggagcaggagagctagactgaaagggagtgagaaatggaaatagcctacctgataagggagtcgaggggaaggaggcttaaaaggcaggtgacaaggtgtggaagaccaatttagcccacctcaacattttgcagaaggctagctctactaagtggttttattctgatactttgatgacagtcccaagaaatgagattactaatccccctgttaagtggtagaactgactgatgtgggaaaagtaggagcaaactcagctgacatcggcttacctggcaccttcagaaggcccacataatgcaagagcctcagccccctggagttttctgtccctaccccagaacgagtccgtgttgatttaatctgaatttagcattagatgacaaaatcgaatgtgtgccatcgttttcggtttttcttcaatgagacaggaaagcctgtggtctcccagcaaggatatttaccccacccttgatggagccccagtctcccggaaagctaatactctgagctccaggacctcagacctcatgacacataaaatgccgtctctaaaacatcaattggcagctgagccctcatttgtttcttcctctgcaatttttcttgagattggaatggattcatcagccaattaggatgaaaaccagccaattaactaaatccctattagcttctcttgtccaagggcagggatgaaaaggaggaattcttgcttgatatagagaagtctcccaggtcttctttctgacaactgctaagtgtgactgccctttctctcctttcctacaaggggagggtgtaccacctgcatgttattcctgggtctacccggatcatcccagttgacccagaaattcggaaagtgggtgcagagaagtagagtctctttatcatttccttgctaatgaaaagagatgtgataagaaaattaatcagtttaacagaatataattctctgtagtgttaaaatctggcccaaataagcagtcttatttttcaaatgttttaactctgaaagtactacctcctcattgtaaatagcttggaatatacatgtatgttaatattcacctgtaatttcactatccagagataacatctatccacattttggttatttttttgtccctccagtgcacattgttttatatatttgagactatatataaaaatttgctgtattgttaaaatttatgttaatgatggcaccaatattctttatgtgagtatacctaatttactaaaccgttcccctattattgttgcacatttagattgttttcagtgtttcattatgataaattatgttcttgttaatgtctttgtgcacaaatcatttttggtttttaaatgcagcttattgtttcttacgtgatgataagttgcagactctcttcccataaggtgagggtagcctgcagaggtaggccattgaggggcagggtctggttgctggcagtgcctgttggaggccacataccggttaaaacttcatggccccatgtctgataaacatattcttaattccagaaacaggatagtcctggtatattcactgatttggaccttaggcctgactggtgatcattaaaatagcacaggatggtgaataagccattatgaccgttcattttaaaatgtgggaattgggaaatcccctttctataacagaactattcatgtctgccatctaagacattctttttctttcttgggattagaacacttggtaacctctatccaaaggttgtttggtggacgaagaattagaacaaaaggtggagaaaattgagagcaatggtgggtcccagtgaaattttactaaccccaccaggagatactgttctgtaactctctcaaggggcagggcaggaggcaacatttgaatgtttgtttctctgttccatactttcttattgaccctttagtcgatgtgtttttccctttaggcctgtcattgttaaggtcatgttgctgaccttgtaaagctgagaaaaacctgctttcttccaataaatgttaatttcatcagctggtttctcctattatcatgacctatggacaattgcatgggaagtagctgggctgcttgttaaataatgcaaatctctggatcccgccatagacttatttaatcagagtctctggtttgagtcccagatcatgcttgcaacaagcactccatgcataggaaagtaaggaaggatgctccaggcagtgcagccactgcaggcaaaggcttgttggtggaactgccaggagccccgaaaggctgggcatacatttgggtacaaggtgttgaggagtgccagaaattcactaaatctattttcctgctagagtcattttgaatacaagagattttctttaaaaaccctttagagatatttacttttggtcagtcaccttttataggcccaggccctgtaattaggtcttgtgccatatcagagttcctgatcttgaagaacttgcatctatttaggaaatgcatttttaagacaatgaacaatatagccatgcataattaagtaggaatcctctagcacctaaccagcttctctagaaatccagagtgatgatttcaatagtaaaggatgacttaatggagggattagtatttaaattaggggtgctaagaggtatagaatttgactatggggtgtagaaagtggaaagaataattaaagcaaaagcacaaaagtaagcatgagcatattgtgttattgggggtattgaaatgaagtagaataattctccactcattctacaaattatattgtaagatcatagtatgacaaggacgggagagaaaatggtatgcaaagcagacacttggtcctgccctctctcatgcatccatccatgcatccatccacccactcaataagtagttgttgagtatctacattgtgtcaagtattggaatggaaactggcaacatggtggtagcatcaaatcagaactccagggctgcaagggaacacaggtctagagtaacatcatccttacattgctgtgcactaaattctgttgtggaccatggacctagcccaatttttagtcctggttcttccttgtctgccaagctctcatgtcatttgtaaaagggaactttagtaagatactgtagtaaaaactaaggcacctggcagtgggaacctgcattaggctactagtagctaggttcaatattcaaagcattcaaagctatcacccagatttgatcatggtaagatttgggagatgacagatatatatatatatataatgcctgcaagatttccttcctggctaataggaagtgtaattatacaaaagtctaacaggaaagttaagaggacaagtgaaatgtgttggtcaagacactatatcatagaagcaaaatctagcacctcgataaaaaatacattgcacatttattggacaatgaatcctagtgcaaaatcattaaaacaccaacggattatatatgtggtttcgttccatctttggtgaccagttgtgttgtgtttgggttccaagactcagtggcagcatgaagattatttctcctgatgtctcatgaagataactaagccctgttatttgtgtaaataataaagaaaataccctacatacacataaacctcaagacagactggaacagctggaggtttctatagaattacacaaatgtgaagacaatgagaaattgcaaaaactgaggtatccactgctgcaatgggctgtaaggctaagttcaactgatctccatatacagttattaatatgtggtagggtttgcaattctactgtacccttcattattcacctacttttgccatgtgtgtaagggtataattttgcatgtacgtacagagagagtgagtgttaaagggatagagggacagtgagatgtttacatactaaacatatacatacatacatatgtattccatgatatccagatgttttgcaggattttagaagtgcttcaccagatgtttgaatttgtgggaaatcatcacctgatactgttttggtgaactttcagaatttacaaaggctgaagaagatcacctattttcagtggtcatattatttttttctggcatttaattcttgtgtccctgctggtttcaacattactggtatttgcttctgaaagccaagaagattcagcttttgtataaacatcaagtaggtcatgtgattatccagaggcatcagcctggtcgttttcttcagagttgagtaggtagaaataattaatgggctggtttattgacatgcattgagacattcctctctttgtggttttaattcccagtttctatcaactaatttcagattttatctgaagcacctgtaattacatggggcaagaaaaattgctagccaaatgtaacctgataatgcttaatacaactgttagactaaatcttaaacctgatacaggcacacaagagcttaatgcctacgtcaaccagactgtcttttatgccttcctgtggattctcgcaagaatgagtcacctgattcaggaggcttaattctcagaaagcaaaatattgaggaggaaaccataatggcagcttaattcatcttaattctgtgctaggtctgagggatgaatgagagcagaataagagtgggaattttagacctgggttcaaatcaccagctcagctgtgcactggctgaataaccttggataaattactcaactctttgagcctcagtttcctatctgtaaaatgggaaaactagtacccatctttggggactgcaattatgtagaatttgatgtaaatctaccttctttctgatttcccaccaatggcatactccatgacttggtgaataaaaagaattggctatgatgatcattgctaattttattgttttgatttttcactatcactttggtggacaaagatattcagcaaagtgtgtcctcttatgaccctgattttacaaaggaggagactgaggctcagaagaaaacatgtttggcttaagtcagggcaccaggttagggaggaagtatagcacaggagttataagaacacaaggaatctggagccagaacaacctgagttttgaattttgacctcaccacttgccagggtgttttttttttttttgtttatcttgaacaagttagtttgacgtctctatgtctcagattccattaagactggtgagaatcagggcgataataaagtctacttccaaggtgattaaaagagcaaatttccccttgagggctttttgaggaaaggggcagacactgtcctctatcaagtatgactgaagtacctaactacctgaagacatgaggaggagccagataacctctgacagtcttgtgcccccaagaatggtccaacagcttaagggttcctaggatcactagtcctaactccagatttccgtggagcttgggtgtttacggtcccgtagtggtagcaggggaagagcagcatctttttgatcaggaaggaagttttgtcgtataaattaccataaatgttactacactcaaaacagtatgacacttacacaagaatacacaaataggtgaaacaatctagaaagaccagaagcaaatccaatacatatggaaacttaatctgtgatcaaaggggcgttcagtttgatggtgaaagatggtttgtttaataaataatgctggcattattcactttttatcagggaaaaaatattagacccctgtctcatagcatatacaaatattaatcactggtatatttttaaataatcaagttgtaaaaagtataacaataaaaatattttataaaaatgtaagaaaaacacgtatataacctgtagttggaaaggccatcttaaatgagagagaaaacccagaaaccttataaagaaaattatcaacaaatccaaccatacaaaatggtaaaatccttatatagcaaaatatcaaaaacaaggtttaaaagctagataagaggctataagaaaatatttataccatgtcacaaaaggttaatatctccataattcacatgacagctgaagttgaaatgaaaaacataaataacccagagaaaaatatgtgaagaatacgatcagaagagaaatgcaaataatcaatgagcatatgagaatatactagaaatatttctagtagctagaaaatgcaaattcaatcagtgagataccatttcttcctgtagattgctaaaaataaataataaataacatccaatactatggagattttggggaaatggatgcatcacacattgccgataggagagtaaatgttcatcatagtcactaccagtatctttgaaactaatttgacagcatctattaaaataaagcatgtgcctaccttgactgaacaatactacctttaggaatcttttctactgaaatgaaagcaccagtatgaaaaagaatatctctgaggctatttattgcagcattgattttcatggtaaagtaagatggaaataactgtaatgtctttcatctagggaatgattgagaaaagtgaagtgcattcaaactgtagaagttctgtagctttacacaagaaagagaagctctattagtatggacatggagggacatccatggcataatgttactttttataaaaatacttcttttttagaaaagaacctctcaaatatatatatacatgtgtatatatttgtatgtatgtttgtaggagtatactgaaagatgttgaatgatgcctaatacactttcacactggtttcctcaggatgttactggaaggaggaagagatgattacctcttgctttatacacctgtggatcatttgacctgttaccatacatacattacttcctttggtttttttctttgtttgttttaaagaaagaaactgatctcaaattctagttccctaacctactggccaggtgaccttagaaagtcatttaacctctttgagtattattttcctcacctgtaaaataataataatgaggaggattgagcaagataagatgtgtcaagttcctagcacagagcttgttaaacagggggtgatcagcaaaagagaattccctcttcctcctttctctttacctttagtgatgtgcttttggggatccagccagtcaccacttggaaccaagtacaaacaggaagaaggacgaagctgctgctgcacaaataagtaatctgacaactcccaaaagctacattaaaatgatttttctttggagttaaaaaccctattggatgacccatatcactgctcactgccttcatttatccagacattgagacctatggatccaagaaataaatgcacatggctcattgaaagtatggaattaagcaattaatcccttgacctagactcccatcagagtgccctgttctgaaaccaggctgggttgggtgggcatctgaaagttgcctccctgtacccttctgcctggatccttcaccctcgactgtttctgccctgagaatgctacagtgttggaatcacactgtggttcatgctgttccccctcctcactcaaccccttctccaatgttttaaatccttattatagagccaacattatgctagaccatttataaatacattctcacaatcttcccaacagctctgtgaagtagctgtcacccccatttttacagctagagaaatgaagccacctagtaatttagccaccttctgatggttctgtggtaaggacatggtactaatgatcttttccccatggaataatagctgtatgggagaaatattggagaagtgagaagatggaagatgcagtggcttaaattttccctgtataatagttggcattccggtgataatccatcttagttgttaggactagtatatctctgtttgaggagatgattcaatgttttaactagttacaagactaaaaacacacctaaagcaataggattaaaataatgcactctctatgagtaaggcttaccttagcacttgagaaaagggccaggtcagcttgcttcttgctctgaattaatttaagccttaatatacacatacccttattataacatctatcatattttgttataactatttgttagcttgtctatcttcccaccatactgagtgtcctgaagagtgggagcattttgatttatctttctatccctggttcatcagatacagtccattaattttttagatgaatgcacaaattaatgattatgggttaaataggatatatgcaattccttagaggttcccaagtgacagccctagttctcaatgggagaacttacctttaacaatgggcagccctagttaaagaccctccatgtgctatgagtcagaggccctgcaatggaggaagaaatcatcagcaaaggggttaactttaaggccaattccatctatgaaataaatcaaatcagaaacagaccaaaagcctgcagcagtgggtattttaaacttgctcattaataatggctcaaagtggagatttattacagttgagaagagaggaagagacagtaaatcaggattggtgaggaaaagagcaagggaaagatatgagttcttatttaaaatgtattcatatgctttataaccccaaagtagagattgctatattgaagtggaaggctttatctgtaggattgaattcactagagatatgttttatgccagcgttcattttcccaactttcatttgctttcccttgaccaaaaagtaggggacttagtttattgcttgaaaacgagaaaagattgctttagctgagtgtcttcatgaaaatattccttgcttcaaagaatggcttgtaaagcactagttcctaggaaaacacgattttattggcacatattttgaagagaataattttaaaacattcaattagttctgcctttgaaatagaatttaaacacaccaaaagcaataggattaaattcacttaaaaacctatgtccccaactgttgcttgggaaccaattcttttcccattcaaactacttcaaggatagtcgagcttgctcttggctgtgttccatctgaggcagatacctgcctttaattaaaaaatcagaccatggtatttccctgctaaactctcagtggctttctattaacttggagtaaaatgcaaactccttagtgtggcctgcagagcactgagccatctgttcctggtctacccagccagcccccatctcatttcgctcttctcctcatctggtccatcaggctcaagtcgactgacttcctctctgttcctgaacacatccagctcttctctgccaagactgctcactttcgctctgccttggacatcctttctcctgccactgtttagaagcaactttcccagtccttccagagtctaccagctgacccttccagagagaccacccttgaccatgctacctaggttttctctcccatacatgctttaagctatgatccattaccgtcttgtctctacaacatgcttaccaaaaactttacacagatagacatatagaaacttgtttatctcccatatttcccactagcctgcaagattcatgagaataggaaccatatctctcattcataattgacttcccagaactgatggcagtgcctgacacatagtaggtcctcagtaaagatttgttgcatcaactttcagtgccaaccctaatgcctggcacatcagaggctgtcagtaaatgcttttgaattgaatttatcttgttgccataggacttagcaaattcacataagctgtataaacttattccaagtgcctaatatcctgcccacagcagcaaattctgctggcttaggacaaatgaataaggaagatgcctaaaagcacaatctaacttcggaacaccttctctaggacaaagaagtcaaggccagttttaactctccttatcggacttgattcctctggttccttgctcttctgacctatttgtttttggtgaaaactttgttgtttttgtccagacgttgccaaggtgtgttattaaacagctggagcttttttatttcatgggtctgaacaagcagctgataagttttgctttgggtttgccaaggctcatgatttaagcagttgaaatcacagagtcactgagcatctttcaaaactcactggacccagagccaagagaacgtttgggatttgtaatttatggtaagaatggcagtagtgccattgggaaatactttggcaagataacacatcgctgtgatgcagcagttaagttccatggtttaggctgtgtgaaaattaatttgcaaaaatatttgggtctgttttgtgttctagtttatatgtaaattagaagattgtacaaaaaggatgccaaggatgatggaattcaaacatcgtcagactggttgtccattaattagagtgattcttactctattttgctttatttacattttctctcaacagtaagttgtattgatcaagtaaagacacagcattagctaataagccataataatggatgctttaaaaataaaagtttaaacatctgattttggaggatagccatggaaactaagagaaaaaaattcaacaatatttctcttaccttggaaatagaggcagtgcctgccacagcattatataacccacttttgctccaaaaggtgacacgggtgtctataaacctgaaagataacactatgaagggtagatgaagggtagttaagtatcagaaccttggatataactgacagttctgcacaaacccacagggcaagtttctcactctaaatcttgaagctttcattcatacgcccatccttgctctgcatgtaaagtgggccatctgactcccatgccccagtaggcacaggcacttcatggacgcctgttttcacagccttcgtcctaaaccatttccctagaatctagattacaccacatttgcagacctagtctggtccattcggcacttgagttccctagactagcttcaatatcttaattattgtcccaacacttaacaccgctcctaacagcactgacttctcatttttatctgcactaaaaccttgcccggtgcagctgaccccaggaactatccctggagcagctctttgtgtgcaatcatccccatcaggtctcctcagaggcctgcagatgggacccaaacacatcgcctgaactgaagtcttttcacacccaggcccttctatgtatgttactccatggttgtatggctcctttaaaatcctaagtttatttagaatagttgactttcaaagcagtttgattcaaacctttgcacttgaaatttattttaactggaaaattggcactaatgttattcttgatttaccaaaagagaaatgatagcaaaagtcttacaggggtcttggcagcaattaactgaaatttcctaaaatgatctgctcatgtatagagcctgctggagaggaaggggtttagagcagcagaggctcagtagcactggaaatcttgagtaatgttctttactctgtccttcctcgcctctacctggctgtgtgacctagagtggaggactttactccctgcctctatggccttaaatccatgtaatgaatttaagtcagacgatctctaaggtggcttctatttctgaaaagctattaattcatagctgatttaaaatcagccatccaggggtaaataaacttagatagcagttcagggctggagccaatgagggacacagctgagcaggagagaggtttctcacttcttcctcgattggctgagcaggtgattagcatcagagacgcaggctttgatcgtgaagtggggatataaaaccccgaaactgttcgtcataaagaattccatgcccaataaaagagaaggcagatgttcgcataaagtttttcctgtttgtgtttttgcgggggtactttttgggcatgacgtttattagtgaagtacagcagcagctgcccacccatgttgccacataatagcagtcttataatccatttatgggcttggaattatttttgttaatgcttttcatgggagtagatgaaatgcaatgtgcaccagctgtaactactttaatcatgcagctgccttctagggagagccctgcaagcatcatagatgtcttcattgtcaaagaggttattgtctcacagagttttaaaggtaaaggggtgctgtattacttttccgttactgccataacaaatgatcacaactgcatggcttaaaacagcagaaatttattatcctacgtttctggaggtcaaatatattctcaaggggttaaacatcatggtatcagcaggcctatattccttacagcaggaagctctaggtggagaatccattgtcttgcctcttccagcttctagaggccacctgcattccttggttcatgtccccttcctccatcttcaaagccagcagagtattatcttctctcctggctgacctctgtttccatctgtatatctttatatctctgaccctcctacatttctcttataaagacttctgtgattacattgggcccacccagataatcctagataatctctccatcccaaaacgattaacttaattacatctgcaaaataccctttaccatctaagatagcatattcacatgttctgaggattaggatagtaaacatcattggtggagagccattcggcctaccacaggaaccatgaagaaggtccaagggacacatgacttaccaagggccactcagttcacttgtggaggtgccatgactatatccctggcatgctcacatttgccacttgtgtgtgcgttacggacaaagactgctaggaggatgccctaatgaaggctttattttcataatttgagatgattgagggataaataaatataagatcaagtcagtgttttttttaaaaaaaagtagtttagaaaagacaagtttatatttataatataagtgcattcataatgcaagaactttcttaaatattgtagtcttgctaggacgtggtaccttctaaaggtggagtaacttgtagtgataacatattttaagaaatgataagaaatgagagggccgaggaagcccatgcacatgtgtcaatgtttctcctcttcctcctcctcctctttctccctctgtaactcaggccattgctaccattttgaaagtcattaatgactaaaaagccaattcaaactccttaaactaaaggaaatggtctaccagaggcttattggcatggatgaaaccaaattagatatttgtcatattttaaaatgagacccatcttattttgatgttgaagtgtttgtctaggccaaggaacttatttttagttctcctcccatgtctgttacagttgcctataacaaataagagagtcaaagaatttgagtatctttggcaagtgtctccaaactcctcttttgccttagttttctccatctatgctataggcaagaatgatggctactgtaagttaaagcctttattcaatttaagtttaattaaacttgagtttctgagaggacaggtccatttaagaaggctaatgtgattgttaggctcatcttctccaggagtcactccctgcctcccctctaccatggcaggattggcttcccctcatccggagtctcataacatactcgacctcacactagtgagcctccccagtgtgttagttgttcttgtgcttacctgccttcctcgagattcagcctaacccagtgcgtgatgccaaataggagttcactgcatgtactatgggtggatgaatgaatggccatataatctcaggggaatctgaaggacacatggatccagagactcgatggaagtactgaaaggggcagggaaaggctgaaagtatagttttgatcttcactgatataaaattagtaggttggctccccacccttgccctgaaaactttcttaaatagagagaaatcgaactggaaattgccacagaaatacattctaatagaagttttcatgtgacactgaaaatgagtggacggtttcctttgggtatttgtgctcagctcttaatgtcatttttctgcctatcaaatgaacaccaattctttatctacaagtacattaggttaatgacacagtgttgaactaaacaaagatgaagtcaagttgctaagctcttgtctggcattgattagggggctcataaaataagtcactccctcagtttagtcttgacaacccaaagaaaaactttgtgtacactgaatgacactttccttgaaaaacttccaaataggataaggttgattttcacatcgttcttgccagataggaaaagcacagcatcaactccagggaattgctaaatatttgtgctaccccaggcatattgcaaagatgatgagacctgaacaatgatgttagcattaaagtgttaatgatgactgcagtcaacaaagaaactgcaggatgagtgggcctcaaacaagaaaatctgatgacaagagaccatgcaggtaagacttagagaagtggaccaagattcagaccaggaaaataccatagcaacccccaaggatctccatgggtgggaacatttggtggttctcttccattttaccacgtttgtacatagctctgtttatttatgttgtttccccaacctgctactcagcctaattctataatttctttttgtttctagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtaagccaccatattgcttccatggtaaagttgaagatggggccatcttgattctgaaagctaatcctcaaggcttcagtctctgtgatgagtttgtcctcccacctaggaataccacagacttcagacctgccgccattagatagaaatatgtctaaattgtgctttttctccctaactagtcaaacttttgtgcttctgattactctgtacctcctggaggttgcctgaagtcttatcagacaaccttggtacccccataaaggacagaaagcatagtggccacccctgcctatcatgctgggaaaatctttcctctaagaaactgctttactaggccttcttttaacctcagtgaagtgagaaaaccaattaacaaaaataaaatcagacgttcatcatcttgggaggaaaaaaacagacaaaaatcaccttagatgatttataagaaaatcaataattaatcttcctaggggcatcttgcttgctaagaatcctagctcctgcacagaaatgctgagctgggctttgtgattctcacacctaaatccctccttcactctcctccccccataacgagctcctctttaatttgtggaagggcacaagtgcccattgggtcttctcatcactggaatcttagcacttctcttgctggttcatgtctacttggctatcttttactgttgagtaggttgttaaaggtaaaaaaaaaatgcacatgcagaaaattgtgttcaaaggtaatttagctattgttaagagaaatggaaaataatttgtgtgcaaaaaattgaggttaaaattattgacaacttttgataataccagcggctgattcttcagggtttgggtcattgggctctgttctctcttcctttgtgcagtctgttcaccataaataccatgaagtttgtaagttaactttttccccttctgatgtattgaaatatattttcttgtaccatgtaactgtcacagatacacacacccctaatgactcatcaaaaagctgtaagtgactttgactcaggtcacaaagcaggttttaaaagacattgcatgtggtcgacaccatttagttatgcagtatttgtgtactgttttaaatatgacttgagaagcatttttgtggaaaggtcatatataggtcatttagtttattgctctgattccatataaaacgatgctatcctaattattgttccatttatagttttatttttataaattctgcaaggagcttgtcatggcttctaagtacatttctctttaaaaaggtgaattatttatttaaagtcgtgaacacgtgtgagttcgctggtcagtatttaagaaggaaaagttgtagttatgattaaatattcagtcattctttctttcttggagagggtgatgtaggggataattgcattctaggcaaaaggaaaagcagggggtggaaaagcccaagatacagaatggggtttggtgcctgagttccagaatgcagctgaaaggtagccagcaaggctgaacacagggagcgaagagaggcttgcaagatggtaggctagagaggacagcagagggcaggtcctgaggcagtgttcgggagctgaatccttcgcctacgagttatggcaagcatttgaaggggttttagataaagtacagattgggattgagatggaaaatgtgtcaaactaacacaaacaatggatatataatttttactttccatcagaatgtcttaaaggaaaaatgttgatgtgaaagaaaaaaatgtcaacacagcttctccctaaaatttattgggaaagaagagattgggagatagtctagtgttaaaaatcactcacatgttatgacttgggtttttttttgttttagagatattttttgaacagatgattttgtatctttccaattcaggaaagtatacctgatccaaaccaattttcaaatgcattggagtttggaatcttggcaacatttacttttcatgatgtaaatatttatatctggcacaatttttgttgtcagtggtttgaagagctgagaactgtctgatggttccttttgcatttgtgaaaggtagaaaataaaatatagttggtcgtgataaactaattggtaatgaaatgccttaatttgctaggcaataggtaaatcatgtttgtatcacattttgaaggtgatgtttaatgagttggaaacttgttttgaaagtgagaattcaaatcactgctctgatttttgttttcccttaaagaaatacccaacttaatcgatttgaaaatcaccctgtaagactgggaagttttgttgaatttgggcaagatgtcacattttgaagtctgagccaagctgggtgtcagtacgtgaaatgcagcctagtaactacatgttttgtgtcgcatttttatccacaagcattattctttctggtgttcaagtgtatcttatgcacaaaactgtgatgcagctctctggaagcccctgacttgcgttactatgtttattttaacatatttgacctgacattgggctcaaatgaaggaacaagggctttccttaccatagtttaaggctaaaattcaacctcagtacaagaatagcaaggaataatagttattccttctcatcctatgcactgtgccttgagtgtaatagaaaatattcatttttatttaaaaatgagatttatttcaccttttagcctcatgtgacaggttgcagtcaaaatgcagttcaaactgtgtttcatgcaaaaagttatttaaaatattgtatataattaccttcaggctatctacataagacataatgtatatgaaacatacatgaattttttgtttcgacttggatcccatccccaataaatctcattagatatatgcaagtatccaaaattagtaaaatttgaagcacttatgatcccaaacattttgcataatgaatattaaatctgtaattgtatttttacaaatggcacgcccttaaggctgggttgtatgtagatataagactcctaccttggaaccaatctccaccctttgaccctgttaaatttaacatccaattgctacattgtttggagctaattaatccattctagttaaagctactaaattaacttaatcaaaaagaggaggttggggagataattctttgtggtttcaggttgcttaaagtttccatatatgaagaagtttgattatgatataaatgatgttttacactgagttaagcctcactgactgttttaaagattgagacccttgttagccattgaacttgtaaaatttcacaaaaatgttcacctttcatgtctttttgctcagaccaaagtgagtgtacgcagtgtgtttgtgttttaattttagtgtatagtcacataagtgagattcttggtaatttgaaaatgaaatacaggatgagaaggttaccgcagagtaaaatatggataacttcaatcaattattttggaatatagatatttgctttgaggatttgatataggtgggtattgaaaggtcgtgagtttagctttcaggaaggaaatatggcacatagaaacctatctgctgatctaaaatatctaaaaggagaaaaaacatattaaaactgagactaaaacccacttgccgattctatcattttaaccaaaactcagttccgtcatcttttctcatcttttaactcatttaataaaatagacacctcagtagttaaggacatgacaattgcttatcatatgttaagtataaaaagtaggatctgtcatatgttaggtataaaaggtaggatctaaacataattatcatatattaagtataaaaggtaggatcatatgttaagtataagaagtaggatctaagtataaaaggtagttgatgacacgacaaatccttatcatatgttaagtatagaaggtaggatctaaaaaagagactgggatgaaggataatactgttttattttttcttttctaaagtttctagatttgctaaaacagacttgcattaatttggtaatctgaaaaatacgtatgttctaacctctctttccatttcatttgaaaatatatttggagttgataaatgtggtagacagaataatgtccccttccaaaaatgtccacatcttaatccacaggacttctaaatgtgtcactttacatagcagaaggtatcttgaagatatgattaaatataggattttaaaactggaaggttaccctggactatccaggcaaaccccttgtaaccatagagtccttaaaaggaaaagacagaagcaggagagtccgaatcagaacagagacgtgaggatggaagcagaggtcggagtgacacagggccatgagccaaggaggcctctggaagctgcaaagcgcaaagaaacagattcttccttggagcttccagaaggaatacagccctactgacactttaattttagcccagcaaaactgatttcagatttctaactccccaaatataagataataaatttgagttcacttgagccactaattatggggtaatttgttgcagtgccaaaaggaatctaaaataatagatgtgaacataaagattatactggtttactaaccacaaatcaacaaattatttttaaaactttttggcatttttgtaaaattatagtcagaaacagcctttttcctgtacaacagggaaacaataaaaatgaatctaatcacagattcatagcagcttagatttgtgagagcacctttggaagccagctcctgacacttccagtccaatgctgtggggtctaagttcctctccactctcagtatcatcttgtcatttctaggagttcttaactaccgatagttcttcatatgggtcctgtgtttggtctctgctgcagaatatttgacagccattttttctttaaccattttaaagtggatggttcagtgacattgagtacattcaggctattgtgcagtcatcacaactatgcatttttgtaacttttttatcatcccaacttgaaactctgtacccagtaaacaagaactccccattttccatccccctcagcccctggtaacctctgtcctacgttctgtttctatgaatttgcctgctctaggtacctcatataagtagaattacataatatttatcttttttatgtctggcttatttcactgagcataatgttttcaaggtccatccatgttggagcatgtatcaaaatttaattcatttttaaggctgaataatactccattgtatgtatataccacattttgtttgtctgttcttctgtcgatagacatttgggttgcatccagcttttgattattgtgaataaggctgcaatgaaaattggtatacaatgaactgtttgagtccctgcttccagtttttctgggtgtatggcaaggagtggaattactggggcatatctatgtttaactttttgaggtttgtcacacttttttacacagtggctatactattttacattctcatcagcaacacacaaggattccaatctttccatatcctcacagaaacttgttgtttttttttttttgttatttattttgaaatagccatcctaatggttgtgaagtgatctctcactgtgattttgatttacatttccctaatgaattggcagactttcacagacatccagtacaagtttttggaatacaacctgttcctgatacagagggtagaagatcttgaaacctctgagaaggagataggttgtagaaataattgaccttagcctaatggcacagtcaggaatataagaagtaaaaagaagcagggtgcagtggcttgcacctgcaatcccagctccccagaaggcttaaagcaagaggatcacttgaagccaggagttcaagaccagcctgagcaacataataagaccccatctttaaaaagagagacagagaaagagagagaagcaaaaaagagaagaagctggccatcagcagactgaagacctacattggttatctcaaagaagctgatttttccccatatcttcaggttttttgtttgaaattttgcccagcaaaggctaaaactactgttgtcgccaatttccttttgatttctggatacctggggattatatcagggagagtctcagcaagagacatggaacatgttgagtcatgaggatccctcatagagggaccgtttataaccaccccaggtctggaaggggtgaggagagggagtgaggaccagaacctggagaccaaatgaaccaaccatggagaggaacacctgaccttcagtgagggaagcaaccagctcagggcaacccctaagggtggagctggggaacaaggctctgactgcactcctttcctcccctcttatggaaagaaggcagaagccaaaggagcttgttgaatcagtccatgcaagccagcctccaagcccctaagcaaggtaaagatggatccaaatggacgatcggaagacatccaacacaaagctataggtgtatctacatggaagtttccacatttcccatgaaataaatacgagctaataaaactcttaattgcttataaatcaggtataaatgcttcagcctggcattcacagcccttgtaatacagcaccaaatctcctttccacagacatttgcattatacttcgtacataccttttgttcccagtgagagtgtaaactttaaaaaacaaacaaacaaaacaaacaaagtgaatgcatctctccttttcctgggatctgtgctttggccacaatatacccttcaccccacttgcctaaggagtccgaacccctgcttttaacctctgtggctccaatactatctcttaaattcctcttgatctctttagctaactgtgaaatctctctttatttggcttcttaagcaccttacttatatttattttaggatctgaaccttggcctgtaatattaatatcgctttccttgtaaggaatagtaagacaaatatactatagatattagcccttagattaagagctccttatgataaacatgctttcatattttcattttatatccttggggttatccatgacagcgctgactgatttgaatggaaccaagagtacccttgcttaccaagaaatgcgtttaggtggaattcaccaaaagttgctacgatccaaggtggggggaatgtgagaaggcccatggggaaaagaactttgctatccacagaatctgttactaaaactaattttcagttatgttttttatgactattaaaataagttgaaaaaataagaaatgtgaattggtttggtatttaaaatcttatcacttctctattttaaaattttcctctgaacctgattgcaaaatttaatcattgccattcacggcatgtccacattgctatgttctgaaacctcttatgtttgaggcttttatgttccttcaaaaaatttacgatatatttggggagaaaatatagacacacagaagctaaatggcagtaactgatttaaataactatttgagataatagcggtatagatattaagaaatgattaattagcaaatcaatcatcttggcattaatgttttaatagagtgagaagttgggtttgtcaaacaagactttatggaagaggtaggatatgagctagcatgaaaagggagatagaaagaaatgtaacttgcaggaggatcttaaatgtcagatgatcttactctatatgcagaaggtggaaagaaaacaaaaaggtcgatcaattttgtcatctaaatgtgttgccgtggtgctggtttttattggataactgatgttaaattttcctggataagtatccttacccatttaaaactcaatagctgtctttaagcaccaaaggtctttttacactgaaactctgatatgaaaatggtatgtataattttatgtatgtttgtgggatacagcagatctttaagagctgctgaagaagtggatgcaattcttactcatctgtattttgtggttagacaaattcctttattgacatatcaattatatcctttccaggagaaagtgataggggtctggttatttaattctaaccaacaaggaaaggcttagtgatgtggagtggacagtaactctaggaaaaagtaggtgtgttatcttagaaataatggtagcaaggttaaaaaaagaaaaaaagctaggcattgtcagacatggatatgaaaacttcaaaaggcagatttttaaaatatcatgattaaaattgatgtgatctcattgcttcatggaagatggctctagtggattgggaagctcttaaaaataagattatggtgatagaatcacaaacgatagtaccgaaaaaggaactggcaggagctaaagatatcgaagtggcagcacggggaattttatgagaaataatattgttaaatggcatgtagagatgcaggagaaagggcttagagccaaggaggaccagaggagaaatcatttgtcaatggtttcacagagaatcaagcccaggacaagttgaagtttccagaaaatgaggagcactttaaaaagttgtggttagaggaaagcaggataagcaagacaatgtatacctccatttgggagagaatacatggccatggatgaccagatgtgagaactgagtttgaattttagattgctactgtctagccagcactatcgtagataaatgtgagaaggtgctggttgattcaaaatgaaccaagattatctttgattactaaacaaagggtttatttggcttaacttctctaagcttcagtttcctcatttgtaaaaggagcatcatcattctaccttccttgcagggtggtggtggagagaattatatgaaaaaatgcacttagtaggcaggtaataatgcaagttatcaagccaatgactggcagagaagaacatgctgttagctaccatcacaggtgtttttgttttcagcaagaaaacataactcccagttgaatttctttgtcagagaaactaatgtttgcattagaattcatagcatatgtagagagaggtgaagtgatttcaactctatggaagacagaagaagaattcagagccacctcgctagtaccccaaacccaaaaggcataaagataaaactttcctctcaaactatatttacataaaatgtcacagattcaggccgagcaacatattctgtaagaacactacatgtgaaaaagtacaggaagttaatgaataatatgctcagttgagtaaatagcacaggggaaatgccaagagatgaattcagtctaattacacagtacctgaggttctacatccatgacaagtgaggccattgtcatgcaatacccttcactgagaagacagtatctggaatgttagcatcagttcccctagtgctgacagtaaggttaactaatagaaaacacattgacacagtaaagtacagaagaagaggaagaaagtaatgaaaaatcaaaatgttttatattcagttttctctgtctatgcatctattggaaaggaaaatattttaagaagtcattacagctgattttaaatgtaccttttctgtgcaggctcagacataggggagaactagctctgctgtttgaaagtaactttggccagacttcaattcaaaataagaattcaagctatgtgaaaattgaatgaccttctgtttcatggagacccgtggcacagaaagagttctgatgggcactgaggggtacttgaaattgtagaacacaatgaggcatcagatgagagctttgacttgacctgtgaatccccttccaaccttgatgtactttgattctgtatgagcagtggttagatgggacgtgtggaatatatttgcttgcagccatcctggaatgaagatttaactaggatgtaaatcctcctaaaggaaaacaccctttaaagcactaacattggaagaaacttgcattgtcctcttattaaccactatcaaaattattcctcaaagttttggatacaggctctctcctttggtatattgtactctgagtagctggaatgaaggattcagagcaaaatgaatgttataaaagaggattttgattacagattttaaaatgagatcaaggtagttgtgtttatactcagagcagagctttttgcagggagcggaagatttcagtgcatagcagtgaaaagtgatgaaagataagcaaaatgtgaaagtctaagatgctgtattttaagttgggaaatggattcagtgcagaagcattctgttgtgggtatcaggttctcatgcaccattgctgagtttagatcttggctgaggattgccgctcactgtcttggcagttctttgtaatgtttacctcttgacatcatccagaaaatcaatgcagagtcattaggcaaatctcccaaggaaacacctggttgttggctttagtatttcataagtgtctctaattctctctcattctttactcctcctgtgggtattagaaaggactttactcttctttcctgcatcatgttcctttatttctctatacttcttctcattttttctcattttttcatctcttttactctcttagccttttcttttctctccagtctttatctccaacctcctccctccctttcatcatttccctgtgtctctttccctgtccttctttccctgtcctttcacttcctcttttctcctggttctgtatacatatgaccaaggaacatgtgccttctcttttctgtatgagtgaaattggttctccactttcatggaacattttaactaaacacagaaagattgacagttgtacaattttagtgacggtacttaaatgagagaaaattcaagttatcccagaactgagtataatttttattaaaaattatagaaggactagcttgagatgtttaattaatttataggcagatgaattcctacaagagagaatgttttccaggaatctcatgagttcagtagccatcacatcataccactttagttttctggttacataatcccacagataaaactaacaggcatttggccaggagcagtggctcacgcctgtaatcccagcactttagcaggccaaggcaggcagatcatggggtcaggagttcaagaccagcctggccaatatggtgaaaccccgtctctactaaaaaattacaaaaattagccaggtgtggtggtgcgcacctgtagtcccagctactcgggaggctgaggcaggagaattgcttgaaccagggaggtggaggttgcagtgagcagagatcgtgccactgcactccaacctgggcgacaaagtgagactccatctcaaaaacaaacgaacaatcaaacaaagagaacaactaacaggcattttacaaaacaaccagcctcttaaacataggcaacaaaatgtgttattcacataatactgcttgcagctcagctctcttaccatccatctaaacatgggagagaaaagaaaaaaacatgagctaagttttacagactagctccacctgtcaagcagcctgagacaaatggttttacattagttaaaaaggtaagactggtagatctcctggacagcggcagaaacagtcacacacacccaagataagcttttgatgctgatcttaaaaagctggtatcagttgtacattctctccaagaaggctctgaaattggtcgatctactccttgtaagcctgaccatttgaataaacccacaaagttgttctatgtaaacctcagacactttgaatcctattaaagggatattattgcctataaaccaggtatctttggttggaaaattaaaataaaaataaataataatatatctactacctcagaaaagaaaagaaatatagtagattctttttgaaggacttaagaaaatgctcattttcttctaagcttggtttctgaaacaaaagaaccaaattaaaactgaaaaactggaataaataatgcaatttgaggagtctatgcagcgtaggcagttgaacatctgagcagctcccagacttaatttttctgatgaagatttaatgtcatatagatacaactttattaatgttgcacgaaagattaagaataactaaaataatccatctctttccagtatctcatattcttaacgttttaaaaagttagatgttttagttccttgctctgtagtatgctagggccaaaatccaaactgcaaataatgtgaaaataagccattcagcctaatatctgtttttctcatagagcaaacccagtgtctattcagtaaggcgagagttttattttgttaatgttatctttgcccacctgatgttctgaacagattagtgttgtgtttttactcagatcttcatcagatgtaacacttgataggatgttagtccattctggcccttagctctgaaacatgcatgctctaacccacatgaaacatttacatacaatatcataagatgaaggtacatgatttcatttttaccagtgggtgaaaatgtatacacgcacacagtttggtacgttatatctaatagaaacctatcaaactagcagcatctcatctgcctaaaaatattttctgccaccttcctatcaagaatatttttcacatctcatctaaggagcagagatttttctcaatttgcattttcctctgaaatattcagaaactattttttttaagttaaggaaaagccactcttgcttccttttaagccaagtagctattttcactattctcagtataagcaaaatgcattacttgcactatgatggagaaaatgaatacacattatacttagtatgttgctatttaatgcatcgttgctaggtaggtttgaatacagaaatcaattcagtgtttgttgactctcacgtcatttattctgagcttgtcaaattcaaatagaataagagtttcacaaaattatctgttcaaaataagtgttgtgtcacccttccagagtctgatgctgtctaagcataggtttagagcttgagatgagaattcttatgcaaataattttctgaagaagtttctcacgtgaaagctgccagggaatgggggaagtaggcctggggagaagttcagcaaagatgatagtttaactggagtccaaccatagcctgatcccacagtaatatagttgggatattgtgccctccaaatctcatgttgaattataatccccaatattgaaggtagggcctggcaggaggtaattggaccatgggggtggatttcccatgaatggttgagtgccatcctcttggtgctgtactcgtgagtgagttctcactaggtccagttgtttaaaaatgtgtggcatcttcttccttactggctcttgttcctgcttttgccatgtgacttgtctgctgacactttttctgccatgagtaaaaactccccgaggcttccccagaagctaagcagatgccagtgccatgcttatatagcctacagaactgtaagccacttaaacctcttttcgttataaattacccagccttggctatttctgtataacaatgcaagaacagcttaacatacacagggacctcctaagcgtgaataacaccaaagtgctctcatcctgccatgcactcctagggtctagggaggcagccttcagtaccttctgaaaggcacatctcttccctggtattcccaggcaaggtgtctcctgtacagtggtatccttaaggagctggcttatcctgcctttcagagcccatcatgtgtatctattcccacctccacattgggtgccatcaaggtggtgacttgaaatccaccatggtaggggtgttaacaccacagaaatctgcaaatgctacatataagcccccttttttatctggagagctggatgatagagatttatcagcacacagcacaccactgttcttagaggtcaagggcaattcccagaagaaaggtgagttgattgcagtcaaaattaatagaaactgggggacatgtctagtggccttaaaaagtaaacccaggtggatcaccaactattgtagctggtgttggaaagaaagcctcagattagttacaaatattcatatcggaaaggactccggtggccatggtttggcctcctgaagaatgattccaacggaactgcctgtgccctgtatttcaggtcccccaggcccagttggcactacctcattccaaagatgaggggcaggggagagcataggcttgattatatggagctatgacttttcttactttcatcttaattcctcttttaatacaactttgtattagtctgctttcatactgctgataaagatatacccaaggctgggtaatttataagggaaaagaggttcaatggacctacagttccacatggctggggaggcctcacaatcatggtggaaggtcaaaggcatgtctcacacggcagcagacaagagaatttgtgcagggaaactcccttttataaaaccatcagatctcatgaaacttactctcacaagaataccatgggaaagacccattcccgtgattcaattacctcccaccagatccgtctcatgacacatgggaattgtgggagctacaattccaggtgagatttgggtggggacaaagccaaaccatatcaatcttctttctttgcttgcctcctccaagaccatagtccttctagtggcacctttgcaatgataaggatggcatataggtatggcttttgcctaatgcctttgcagtcacaatgttctcaacttctttaccagtttaagcttctacccctccagagcctgggaagtcctgggctatttcacaacccaggtggcaaccagcttctggccaatgacactgtttccagcagcgtagcatgcaacaatgtgaatgcatgctggaaatacgttcaaaatctaaagagaggaaatagaggggagcttttaggcttcttcaagtatgtgatctttattctacaaattgccttttaatgattcacagtttctgaatctaaaaggtaaggtttttttttttttaaccaaaatcttaatagcagtgaggaaatagccctatgccaagcagtttgggtccatgctgttcaatcaattcgacgtattactagcattttcctcaagagtgtaatatatgacaactgccaagctttccttttgcgattacaaaaaggacagatactggagtgagccatatttctgcactgcagggatataaaaaatgaactgctaaaaacggcccgggaggaatgaatagcaataagacatcaatgtcatctgtatactgatttgtgatgaatttccaaaaggcttaatggtatgatgctatgatatataggggcctcctgaaagttaataactgtaagttatccacttggaggaatgtaatgggggaaaggaagtggtcacagataatatataaataagtaattttattaatatagtcaaactgttctgtgttgttggcctctgtgattagaaatataaaattaaaagaattgtgaagacatgggaaagctgaatgttacacaaactcccaggattacacacttggtgagaactttaatttgacttttaatagatcggaatcaatctattaaccaaagggaagaatgtaagagtttgttgatcacctttcagaggtgaattaataacagagacttctaaaggaggcattcaagtgggagcaacaaaatctgttttgacgaacaaattgtccttgccgattaccgtgagatctggtatttcctacgtggatggtgtaacatccctgtaggatgcttgagacatcaacagatatgaggcataagatgtgcataaagatgacccctttcaatctacagtctgggttccttttggcccactaatttttatggctgtgtcagcatctggttagcagcaaagtatgtaatatacagaaagcagtcaataaatgtttattgaatgaaataataaatagatgaattctaaaataccccagatcctggaattacatatagatgaaaaaagggaaaggaactaaatatattgagtacttactactgccatttatacatacatattttatctcatttagttccccaaatgacctcagatggccagttttacaaaccaggaaactgaaatgtgcagttgttaaataatttacccagagttacagagatgacaagaaacagagctgagtttcaatcttaggttgtctgactccaaaactggtttcctttacagaacattgcactgaaactgaagacaggggagaaatacattccatctatatcaagggcttaggaagaaggcagcatgggtcagaagagccctgaccttcagccaatttccttctctttgccatgttttgagagcatgagggatggtgggtgctctgataccaccatatttcagcctattaattgcatctctgcagcctgtttgttttggctctagcactatacgtattttatccttaggagtggtgttacatgtctgttttgttatctgaccattgctctcttccctggcaaggtggcaaatcacatagtgaatttcatttctgaatgggtagttaatttttttacacgttccatcaaaaaaatggcacataaaatgcccaagatagttgtcatcactgaagcagttctggcagccatagagtcaggggaaaacacatagttttaatttctaggtcacgatatgtatgctttttctctgtaaaaaatggcaatggtgctctctctgtctcctctgcagcctctcttcctggctctgtctcttactgtgaaatgaggacagaccttactgtttttgcagctggggtgttcaccccaaaagcatgattgcactttggaaaccgtaataggcacatttccaagttcctcagggctcagagtggatcaggaataacttttaaagtcatgagcctcaaaggactggccagtgtaaatggcctgtctctgtttctcctaggcagtcatcctttaagtcatttcatatgatgtgcataatttaacaggggcaaagctgacacatctctgccattcatttctcaggctgccctcagttctctgtggataataataatggtaatagatggaaatttaagatttgtgcttctcctagttcagtgttaagactgaaaggaattcaagggtgaccctcagttcccaagtcacaccaacaagaggatgatcaaaggctttgattgcaatggtatttggctcagcatccccaccaaacactgttgctgccagcttaccccagcctcccagggtcatcccttctgcacagtcctgggagacatatgtttccttggaggctggtgcttggggaggtgcggtcattcggacttctctaacactccactcttgcaagcactgctgaaacatgacacagctactcccatcatgacagtggtatttctccaaagcaaataaattgttcccaagcctgaaaggtctgaccttgaagggactttagtcttctttcgagtttcccagaagatggcatggctttcccaaatttcacaaaaatctcagacaaacaatttaaaacaggatccctgaagacttgctaggataccatttgagtgaactgcaccaggtgagactcagagactgagtcaccaacacaaagatgtctctcctaggcatatatgtctttagactcaccctgccttcagttcttcaactgccaaaaattggtgcatttcctcccccctgcttttctggggattctcactctcagttccaaagtttcctttgctatttcctgagagtgtcctgaaacctttatgtaaatgtcttagaggctagaatcaatacccttgtgattctaaagagatatgcaaattcagctccgacttaactccctgtgcacgggaaagaaattcctcccactagcctgccattcaggaggaagacttagttaatggatgccttccacactgccccttagcttctgcctcttccccagctataaagagtgggcaaagccactgggttgagcttttcctcctgtaactgaaggatagattcttagcacagacaagtgaactgcctgcagaaggctatgagattctttgaatgctattaatgtgaatgcagcattattagaatgtactttgagttttagatggatattttatccttttgttaccaaggcttttcaaaagataaaatatacattgtactgcatggagtatatgaaagttcggtagaatatgatagtgttgcttcacatgctgttctcttgggtatgatatcaggaaaatgttttcctctgacagcctcttataatggatgaaaatattccctttcattgcacacacagtgcaaggtttgaggcatattattggagtcaggtaatctgcctctgaaatactggtatttgaaaagcaaatttaaggcttaggacgttttagctttatgatcattgacactgatgttagtaaactctttcactagctatgaagaagagaaatggcaggcaagtttttttctttttttctttttcattgccatttgcttggtagtgactgcaccatatggagcacagtaaataaactatgaagttggcaggatgcatgaaaacaaggaatgcacttggactccaggggtccctaagcaagttactttacctccttgagcctccttcctgacttgtagactggagctaatattttaaaatggtggtaaggattacagcttattggaatgctcccattactgtgcctagcacatagtgttttcagaatttaattttaattttacagagaaatagctgacccttgaaattatgtcagtagaggctactcatgtaatacccttgtgatttgaagtcggtgttatttattccatcaagtttgctatactacttagtccacaaaagaggtaacggtgctacatataacatggtgaaataggtgctagatttgtgggctttatagaatgtgatatctgtacttgttagtcttcatgaagtgtagtaatttacatgaattactaaagtaattgctcatgtaattataatttgtcatacatttaaccatgtctaatggtctgtttgcttatctctgaggctgcaaattatttggcacatagtaggtgcccaattaatatgcactgaaattgtttgtcggtgcttgataaatgcttattatatttttttggactaggatggccaagctaggttgaagaatatccagaaatttgagtgatttcattatcacttctatgatgttccccagaaaatgacaagtagataattcaaaattctacagattctgcagaggtatctccatcatatcagatgattagtgcctaattatagaccaactagacttccattttggttttcagactccttctgtagctcattactattctgtctcattcttttgcacttctcgattgtcctttttgtatcattccaaccagcagtctcaactcagtgtttcattcctgcttggcagaccaaatacaaccagggcctattgcaatacagaagcatccatataacatgtcaactaatggatctggtaatgctatgcagaatgaatcattttctctaactcttcatttgctcattcaatttggatatgcgaataatatccaagagcattctctcacttagtctgcacaacttcatgaagtcgtcaaggcagggtgttagtaagttattgccgcaataacgctatctatccaccacaaaaatctcagtggtataaaacatcagcgtgtatttcttgctcatgagtcttcaggtctgctgggggaggtctgattcaagcttcaagtcaaggtcagatgtattctatggcccagggtgaagaggcagcagctacctagagcatggcctcttgactgagattaaaagcgcctggaggggcaagtggaaccacgtaatgtcacataatgctttaggttcaaaatcggcccacagccgtctccacttttcttccactagccaaggtgcattatcacctatgtcttccacccacattcttttcactgcagagactggcttttacttgaaaatttaacatagaacagttcagacttgacaaaagtgataaattgaaaggcgataacttacagaccaaatgtgtcccctccctgcaatgacaaacacatttaagattcattttgctttgcaaaacttaattttatgagcagtttgggggaattgctgttggcattttgtaaaggacattgtgtcattgggtcttcctgaaggaagccccagatgagaaatttctttaaccctaattgctaggaaaaaccttgcttcctttgaacaatcgatgtgttttatttttcctctctgcaagaacggcgtaactacgttgtccatttccctttgagtgtcaaggccttcagaaccaaattttcacttgtaataaagttagaggaactttataaactggtgaattactctagatcctgccattctatctgaatttgtctttaatctgcttcgatttttgttgttgtttttgttgttaaacgtaatgttagatacaatatgtttttcttatcctgtaagccataacaactcttgtggaatgaggcagggtagaaggaagaacaaaacaattaagtgaagctgtgcaccatcaggaacagctgattcagaagagggacatcagctggtgtgtttccctgctctttcgttgttatcagttaccattggtagaaggatattttgtttataatcaaaattaaactaaatctttggagattaagttttctgaaagagcttaagggcaggatcaagggggattgagtacattgtctctaatgctgccctctcaccatgcccctctctaagcctctcctccccccaccttccaggatgaacccacaaaaggacatgagcctccccttctgttattcattcctattaccctgcttctcatggtgcatctggtttaaacagcttcagtcaccaggatgtgaaaagaaacgatgacgataagaggaggagcagatagattaagcaagcagtgcagggcaacattttattacatgtctataatttttaaaattgaagcgaaaaatttttccaattacagagtggaagaacttgcagtagtttaaaagagccagtgcagtgaaaatagagaaggtggttatgggatggcaggcaggctgttgaagaaaggagtctttctcgacattcttgttactttctgcagttaacatcgatgagatgcaaatattgcggaagagtgaatactgcaaatctcagaggtactaaatgatctaagagaataggatgctttttctgggaaactaaattataaaaagctgagcctccagttgactattaaataaaaagctatcaaaagaacatctgtagaagattccctgaaatggggtctttgtcctctgaatagatgattggaaattgacaggttccgtttcatctcaacactgtaattttgttcttataaaggattgctttttatttctaatacttgccatgtttctttagtgtcttcccatgtctcaaaatagctcgaaaaaagagcagaggacactgagcttccccttttcaaatttgtagcatttacctctgaatttcacctgacttgtgtggctttcagttccttgaaatcatggtaacaagctggattctcggtcttcagataaatagtgactaattctgcaagcctgacctccagttccaaagaactctgagctcccccttcagtgtaattctacagaaccagggatgacatccagtcatctttggtattgctttagctggaaaaaatgagtttttttgtctttaacagaggctaggaaagagatatctcagtacacctttcaccttctatctcacctgtgacgaggaagtgcctgcacatttatagtggctatggaaagatagcacggctgctttgaaatatcatgtgcgctggagcatgttttcactggaggtacagtcttccctgaaatgtaagcagctctatctctggcttttgcagaaaaccagatgacgtcaaaaaatcagttatgaaagccaaggacattttattcagtgagagtggcctattttactaatgtctttgtgtcgatatcagattagcataatcagagtttgattctctctgcatttggacagatgttacagtccatggctttcctagtgatttggtaaagtagggtactaaatacatcactggaatataagtggtgacgctctgggttttaatccagtgaatgcgacaggagtcatttggaagatatagcatcattccttatctgaactggctttttatttagtaactggatttgtgtttccccagtagtcaggaatgaatgtggtcagtatacttagctattcctattggctccctcccattttattttggtgtagagctagctaataccaaagtgtctaaagtggaagtcaagaataagaagatgtggagttgaatgctgtcagaggaaaactcggcttcttaacaaaatcaaatctagcaggcaggaactgccaacatgataaatattctagtctttaatatcagtatacataccagggcagaagaaaagaagaaattattcacacactcaaaatttgttaaaattatgtcatttgacttcaagggagagaggcctacggaaatgcaaagttcagatggaaacctcaggctgagcctgactctgggctctcctgatgtgtcaatatgaccaaagtaattacactgccatgcatgagctctcccagggtcaccatttgtgggaatgagttctttcaattaatctgtgtgccttaactaactgcaagtttcatctggtaccaggtgcatgcagaagcaagggcagaatttcaaatggaactgaatttctaattgtaagttggaattgcctggatggtagtgtttgtgggtcagagaacacagtgcctttgagatcacacaggactgggtctgatcccagcccttctactttattcattcatttactcactatttattgaacacctgctatgtgccaggcactgttttaggctctgggaagataactgaaaattagacagatgaggtctaagcactggtgaaccttatgttttcatgaaggttttacagatcaggttccccaggaaacatcctctgacatggacattgtgcacaggaagttcattggaaagggctcttgggcttaagtcctgcggggaaaaggaagaaagaaggaatggaccgtgaagcaggctcaacaaaggctgaagctgacctcgtggaaagctctgaaactgggatgacccttcaaaatggtcccccattgtggcgagggaaccctcatctttagacaggtgtataggtcagtcattgactgtgggctcactgggaatgaggtgcgatcttgcacaggggctcttatcagctaaagacaatcctgggaaagagatggccactgagaactcccagcagttgggggaataagtccttcagcctcgaagagggatctggtcaggaacagatattaaaccaataaagtacgtagatatatatacacacatatatacatatatatgtaaaatatttttaatgtggtaagttaataaataaaacagaatgaaaaaaggccagggttgctattttagatggggcagccgggaaggccccactgaaggaagaggagccaacctcttccttcctcttcctcaaatggccaacatttgagccaacctaagtggagtaagcaagtgaacagcaggaagttgattattgagccaaagagaacagctgctcaaagaccatcaggtggtacagacttggcacattccataaacaggaagaaggtcactatgaacagaggacagtgagcagagggcgaattcaggttacagaaaaatggtcaaaagtctgattgtcaagagccacataggctatggaaaggagtttggttttaatgctgatgttacagggaaccactagaaagctttcaatagatattggaaagacttggtacaggttattgaaagatcactccaactgctgtgtgctgtgtgaagctgactgtacaaggtaaggatggaaacaaaacactaggaaaccactgtgtcatctggaagagacataagacatggttgatgcaaggtgcagataagtgatgtagtgcaatatctgtttcaaacgtagggcaagcaggacatgcagatggattggacattggttgtgagagaaggagagtagtcattgagtgaatggccctttgatatattgagatagagaagactgaggaaggagtggactttggcagggatgggagatcaggaattctaatctggagttactgagtttgaggtgccttttaaacatgcaaatagaaatgtcaaataggcaaaatacatgtctggaaactaagaaagtggggctgaagatataaatttgttggtccatggcatataacaaatatttaaagccatgggcatacattagactatccagggagtgaatgtagttagaaaagagggctaagaattgagtgctatggtatcctgacgtttagagattggcaggcagggaaggcaccagcaatggagaccgagatggcacatccggtgagaaaggagggacatccagaaagtgtggtgccataaaagccaaaagaagaacaaagttttttcctggagagagcaattagctgatcatttgatttagcaagacagaaatcattgatgggagcagtttcagtggaataccggggggaaaaacctgcttggaaggttgataaatgaatatagaatgagatagcgaagacagtataaaaaactatttaaaaattttttgacataaaagggagcacaaaatgggggtaggctagctagagagaaatagggatcaaaataaggatatattttaatccaggacatattaggatatacttgtactgatgggaataatccaattcactggtgatgctaaggaaagacagagtctctgtaggtgtcaagtcctcctccacgcaagataatgtaggatcctatccaagaaaggaggtgctggccaccagcaggtgaagggacagcttacccccataactggagggacagaggagggtttctgtgtgggtacagctggggaagtaggtttggttgtgggaggataaagtagccctgctttatattctcaaatgagaatcaaggtcatcaactgagagtgaggagcgggaattggaaatttgggtgatggggaaggcagataataaaatagctagccctgaatgtgggagcgtgagttgactagagtaatgtgggagaatggtgaaacacacttgagatttatggttacagatgaaatgataactgtatatctttatccagattcattaaatagcctggggataagaacagagaaggcagagagctaggtccaaccagctataaggaatgacaggtgagtttgtttgatgaaagacagcagcaaagggtagagttgtaaaaaaaaaaaaaaaaaaaaaaaaaggactgatagggatgatgggccataaactctaagcaggtaaggaggagagccagaaaatgatagaaattccacttactagcatgtggcacttctatgccttgtgccaacaggagaaaagaagtgtgcccaacttaaccaacagtcaagagcttactctgtgtgtcatacacttttagatcacttctcaattaatctttacaatgggcctatgaggtcagggagaattaactccacctgaggcagtgcaaaccttttgcgcaaagactcctatctccaagcctaagccccattttccaccttgacagctgtcttagtgccacagggaagcgtcaactgcaatttatggagcactgatggataaactttttgatttccaatcttagggcaaatattcaactgcttattttgtcatcatgaagagaatatagagaatttacttacacctttgatggttgaaattcttgtatgccttacaattatctatcgtgctgaatgtgagagcaaacgaagcagccaccttaggaggttgggaacatgtaaatagtattttttaatgtttctaggtctctgtgaaaatgtaacaagtgaactgagatttagaggattaaataattcatctaagtatactgaactaaaaagtggcagagcaaggagcttcaaccagctctgaacaagctggagaggtcccaattccatagggtttgtattacatgcattgcctccgataggcatgagaagcagaagcagcgtaggatagaggctccctcaccaagcctgcaaataatagaggtaaaggggcttagggatagattagagaaggcattgaccctcttgggcatgaacttaatatataaacaaactgagctagaacttgctccttatgcatataagatttccaaatgcatatttttattgtgagttttttgtcctttttatgacttaaaagtgtatcacgtgactttttttctatactctggtgaaaaatccctagcaaatataaaaggagctctgggccttcttcatggataaaggatggatgaagctgggggactcttcttgcgctgcagtggctaattgagtattcagccccaaagctgtgagcatgaccattaagaggcaaggagctgggcctgaggaaaagaaaaatggtgggagaggggtgaggggtttggatagatgagccagtttaggaattagaaagatctctgatattcctgtaagcaggcagcctcattcctccacattggtcaaaggagagaacaaaggcgacagcactgtactggtcaacatgaccttctaagaatataataagagttttttttttttaagagccatacattacatacatcaagggttatctcagattgcctggggctttctcagttttaacactgaaattcttgcatcctagaaagcccctccatcctgagcaaacagggtgggttggtcaccctgtgatgcataccagataaacagaaactgtatttacttcaaacatgcctgcttctagtcccacatacatgcacaccagaccatacgtttcccacatacatgtcaggtcatagatttttccatttttgtatagaagatatggcaaccctggtacatccagggaacccagaaaattttctcccatttctgattatccaagaaagaattaaggccttgataatagaaaatagcttactaccttattctctttctttgtgttctaagaattctctgcctgccagaatattttggagctctcttctcttgttcttgaaagtgtagtttttgacataatgtagatggggtacaagtgttggctaattaagttttgacacatcaccatattctgtgaggtggctacagcatgcttcatgtaggaggggaaaaaattagaaagagtataatcaggtttgcattacttctaacataggcaccctgatgccatctgctaccctcagcagaggatgcttcaggttgggatctaatgttttactatgaacactgtggatatgattgcagttttctctccattagtgtttgcctggctcattgggcaaagaggaacagtccaacattacactccatatataaactgagaacaggaagattaccatctactatatgcagggctgtgaaggaggaaaaggaagcggcagtgtggtaagaaatagcctatcagattattacaataaaggatataagcaatattaagtaagccacttccaatcagcacctgcaaactctcctttgaatagccaagccttggaggaaatacaaaatttctcatgttctagtagagggctgtaaagaaactcacccttgaatcagaagaaactcaccctagatcacatgcttcttacaccactaactatcctttgccatatttatcacttctgatttaatgtacgtctgtataatcatttggtcaatcttaagtttcccactagatgataatccttgaggataaatatcatgtgtctgtattaactgtgcatccccggaattcaacacaaagcatggcaacaagaaggcagtttttatttgttgaatgaatgagtcaatgaatgatgagcagcgtgtccctcttctgagagccacgacacttcattatgtctccttcacgttactgattccattgtgttatacttctagatttgattaactgcttccccactataagctacccgaagacaagcatcactgaatgcctaacactttcatagttctctgcatgcaatcaatgagtgttgcatgaatggcagagtaaaaggtgggatacaactggtattcctttgattttgctgagagttgtagtaaactgaatttacagcagacattacacagaatcttcatccataaatatcttagatagctgatatattgataggcttgtctttcctgccaagaggaatcagggctcccagataagctgttgtcatggaagaaagcactgagttaagagttaagattgtgttctgtgttcaggtttttactagctcattgtgtggccttggcaggtaactatgctcactgcccctcattttctgtaacatgggcattgataatgcctggtgtcctagtctctcagggctcttgtaaggcacaaatggggaaaaaaagataaaattaaatttactgagaaaagcataaatcatcatgacacctgaggtgacttatttctttacattatcactcatcagagacatctttctatctctgagcaatctataaccatgtttctcttttgctgaattctgctatggtgcctccaacagagaatggtaggaaatacatttttacctgatgaatagcaaaatctaacctaggttttctcgaggccccaaaagatcctttgagaaaaaacattgcctagtcatctccagaaatgaaattgcacatcgtctgtttattttaaatacattttcttgtattttccccttgtaacaagggcttataagagaaaaataagacagaaaagatgaaaggaaaaactacacatagttttacctttgagaaccagcagctattagtactatactgtatttctttccaggtttttcagtaagttgttttcccttataaaagataaaattttctgtcttgctttttccatttctccactttattttaaactcttggtaacattatcttatactaactttataacttagctttgtaagattgttgtgaggacaaaatgagagggtgaatctgttcctaatgatttctaatgaggaatcaataaatgttagctgctgctatcatcaacaacaacattgtcatcattattaaaattaccatggtgtacctaatgttttcttttgagatggagtctcactctgtcacccagactagagtgcagtggcgcaatctcagctccagactgagagtcctttaaattaaaaaattcagactagtaccccatccctgccacaccaccaccactgccagtgcaagtacatgcaggaacactgacaccctactcccactggtacctttctttagccaacacgtgtaccccatgatgctgctgcagttgctggcatgtgtgagtgagcacagatcccatggccactgccccaacaaaacactttggctggcaccccctattggagtattgtggctagggaatacctcagcccctcttgtacagcagctttctaacctcaagggaccagagaacaaagctgggggctgggtaccaggcccccagagttagagcatacagcccagaaatactaagctgagcctttgccccctaaaatattccagaaatgaagccagttgactgaacccactttataccgcaatcaaacacccacaggcatcaaagggaaaaaaaagcaatgaaatccatccaaaggacagtaacatcaaatataaaaaggaacatcagcccatacagataagaaagaaccaggataagaactctggcaaatcaaaaagccaagatgtcttcttagctccaaacaactgcactggttctccagcagtggtttttaaccaggctgaaatggccgaaatgacagacattaaattcagaatatggataagaataaagatcattgagatacaggagaaagttgagacccaatccaaggaatctaaggaatataacaaaatgattcaggagctgaaagacaaaatgaatattttaagaaataatcaaattgatctgatagagctgaaaaatgacttcgagaattttataatacaattgcaagtattaacagcagaattgaccaagctgaggaaagaattgcagagctcgaacactgcttttccaaaataacttagacaaaaataaagaaaaaaatgaacaaaaccaccaagggatatagaattacgtaaagaaataaaatctgctacttactggcatccctgaaagagagagcgagaaggcaaggaacttggaaaatatacttgaagatatggttcatgaaaatttctccaaccttgttaggccaacattcaaatttgagaaatacagagaacctctgtgagatactatacaagatgaccatccccaagacaaatagtcatctgattctccaaggttgaaatgaaagaaacaaatgttaaagtaagctagagagaaggggcaggtcacctacaaagagaaccccatcaggctaacagtggctctgtcagcaagaaccctagcccagaagagattgggggcctatattcagcattcttaaagacaggaaattctaaccaagaatttgatatcctgccaaactaagcttcataagcaaaggaaacataagaatctttttagacaagtaaatgctaagggaatttgttacttccagacctgccttataagaggtccttaagggaatgctaaatatggaaaggaaagaccattatgggccaccacaggaacacacaaatgtgtagaatattgacactataaagccactatacaatcaagtctgcataacaactagctagtgacacaaagccaggattaaatctacacatatcaaaattgaatgtaaacaggctaaatgttccaattaaaaggcacagagcggcaagttggataaagaagtaaaacccaactatatgctatcttcaagagacccatctcacatgcagtgacacccatagtctcaaagtaaagggatgtagaaaaatctaccaagcaaatggaaaacaaatcaggagttgatattaatttcagacaaagtagactttaaaccaacaacaatcaaaaaatacaaagaagggcattatataatggctaagggttgaattcaacaagaagacctaacctgaatatatatgcacccaacatagaagcacccagattcataaaacaagttcttagagacctaaaagagacttagattaccatacaacaatagtaggagacttcaacatgccactgacagtattagacagatcgttgaggcagaaaactaacaaatatgtttgggacctgagctagacacttgaccaaatgggcataatagagacctacagaacactccacccaaaaacaacagtatatacatttttctcatctacacatggcactctaaaatcaaccacaaaattgacattaaaatatcatcatcaaattcaaaaaaatatatgttaccaaccacactctcataccccagtgcaatcaaataagaatcaatactaagaagattacataaaaccatacaattacatggaagttaaacaacctgctcctgaatgaatgacttttgttaaacaacaaaatcaaggtaaaaaattctttgaaaattttctttgaactaacgagaacaaagatataccataccagaatctctggaatacagctaaagcagttccaacttaagaaaaatattcatagtgctaaatgcccacatcaaaactttagaaaggtctcaaattaacaacctaacatctcaactagaggaacaagaaaaacaagagccagccaaccccaaagctagcagaagacaagaaaaaaacaaaatcagagctaaactaaatgaaattaagatgggaaaaccatacaaaagataaatccaggaggtttttttgaaagaacaaataagattgacagactgctagctagactaataaagaaaaaaaagaagatctaaataaacacaaccagaaatggcaaaggggacgttaccactgaccccacagaaatattaaaaaaaacctcagagactactatgaatacctctatgcacacatactataaaacctagaagaaatggatacatttctggaaatgtacaatctcctaagaatgaaccagaaagaaactgaatacctgaacagaccaagaatgagttctgaaattgaatcaataataaaaagcctatcaaccagacaaagcccaggaccagatgaattcacagccaaattctaccagatgtgttaaagagctggcaccattcctactgaaacttttcctaaaagctgaggagaagggacttgtctctaactcattctgcgaggcaagcatcattctgaccaaacaaacaggaagaggcacaacaaaaaaggaaaacctcaggccactctccttgaagaaaatagatgcaaaaatcgtcaacaaaatactggcaaaccaaacccagcagcacatcaaaaaactaattcatcatgataaagtaggttttacccctgggatgcaagtttggttcaacataggcaaatcaataaatgttatttatcacataagcagaactaaaaaactacatgatcatctcaatagattcagaaaaggctttcaataaaattcaacattttaaaaaaacaacaaaccagacactgtgaaaacatattttaaaataataagagccacttatgacaaacccacagccaacatcgtactgaaaatgcaaaagctggaagaattccccttgagaagcagaacaagacaaggatgtccagcctcaccacttctattcaacatagtactggaagtcccagctagagcaatcaggaatgagaaagaaagaaaagacacccaaataggaagagcataagtccaactatctctgtttgcagacaatatgattctatacctagaaaaccccatagactttgcccaaaagctcctagatctgataaacaacttcagcagagtttcatgatacaaaatcaatgtacaaaaatcaatagcatttctatacatcaataacatccaagctgacagtcaaatctagaacatgatcttattcacaacagccacaaaaaagaataaaatacctaggaatacagctaaccagggaggtaaaagatctctacaatgagaattacaaaacacttctcaaggaaatcagagatgacaaaaacaaatgggaacacattatatgctcatgtatagatgaatccatcttgttaaaatggccataatgcccagagcaatttatagattcaatgctactcctgtcaaattaccaatgacattcttcccagaattagaaaaaaccattttaaaattaatatgtaaccaataaagagcctgaatatgcaaagcaatcacaaccaaaaagaacaaagctgcaggcattacattacctgacttcaaattatactacaaggctacagtaaccaaaacagcatggtgcaagtacaaaaacaggcacacagaacaatggaacagaatagacagatcaaaataaagcttcacacctacaaccatctgatctcctacaaagttgagaaaaacaatggagaaaggactctctattcaataaatggtgttgggataactggctagccatatgcagaagattgaaactgggcccctcacttatatacaaaaatcaaatcaattcaaggtggattaaagacttaaatgtaaaacctaaaaccacaaaaaccctagaagataacctacaaaataccattctggacataggctctggcaaaaatttcatgatgaaaacactaaaagtaattgcaacagcaacaaaattgacaagtcagatataattaaactaaagggcttctaaacagcaaaagaaactatcaacagagtaaacagagaacctacagaataggagaaaatatttgcaaactatgcatctgacaaaggtctaattcccagcatctacaagcaacttaaacaaattaaaaaaaaaatttaaaagtgggcaaaggacatggacagacacttttcaaaagaagacatacacatggccaacaagcatgtgaaaaaatgctcaacatcactaatcattagagaaatgcaaatcaaaaccacaatgagataccacctcatatcagtcagaatggctattattaaaaagtcaaaaagtaacagatgctggggaggttacagagaaaagggaatgcttatacactgctggtgggagtgtaaattagttcagccactgtggaaacagtttgacagtttctcagagaacttaaaacagaactaccatttgacccagcaatcccattgttgggtatataaccaaagatatataaattgtgctgccataaagacacttgcatgcgtatcttcatcacagcactgttcacaatagcaaagacatggaatcaacctaaatgtccatcaacattagactggagaaagaaaatgtggtacttatacaccttggttcacagccataaaaggaatgagatcatgtcctttgcagtaacatggatagagctgaactcattatcctcagtaaactaattcaggcatagaaaacgaaataccacatgttttcactgatgagtgacagctaaacattgagcatatgtggacacaaagaagggaacaacagacactggggcctccttgagggtagagggggacaggaagatgaggactggaaaactacctgccgggtactatgcttattacctggctgattaaataatttgtacaccaaactcccatgacatgcaatttacctatataccaaacctgcacatgtacccctgaacccaatataaaagcttagaataaataaataaaaatctgtgcattttattgtatgcaaataataccttgatgaagttgatttttttaaaaaaataacatggaacattgcctatttctagaatagtttagaaaaattcaactgatattcattatattgtctcatatattcttattttatgtttttattctttaatttcttattttttatttacagtttacctcatagtagtttgaaattttcaccttacatttttgttctgctagtgaacatccttaaacttgccgaaatcagaaattgttttcctgtccaaataaaaataaagcagtgtctacaacaatctcgcttaaacaaaatacaggttgtatcattggtattttataacttccctttgtttcttccttactacctctttcatattgttaaaaattatcttgaattttggttccagattgttaattttttactttgtgcctcttctgttttatgactacctacttaacaattccattaaatttcactgccatattttcaaccattacttagtattaactataagttttactgatatcattgctcattttattggtatgttatgtatttctgtttttcaactttatcttgctgaagtacaacctgaagattttgttgttgctttgttttcagaaaaggttatgtgggtggtaagccttctatgttcttgtatgtctaaaaatgtcattcccctctgccccatactttaatgataggacttgagcttgaaaacgtacttctttaactttttacaggcattggtctgttgttttcctgttttctgtattgtaaatgagaagtttgatgctagcaaataatgtaattgtcttcagaatcccatgtttctgaacttgacttttaattccatttctaccacttactaactgtagaactgcataacctcagggatcctctttttccatatccgcatgcaagtagataagagtgtggtatagggtcctggtgtggtgaagattaaagtaaaatacttagctcaaataaataatgggctcagtgatgagaataataattcatttataccaaaaaatgtattttttaatgggagcttgtaagatttttctttatccttagggattccaatttttttacaattttgccataagggactcagttggccttttcttctctgaaaactcaagtccctttccagcttcaagtcagtctttctattatttatttgattacatcataccctccatctgtatctctttctttccttgtgatttctcactacagagttattgggtctattgagtctgttctccatgtgtattagtttcctattgctgctgtaacaaagtaccacaaacttagtgactacaaacaacacaaattcattattttaattttttagaggtcagaatctgaaatggatttcatagggctaaaatcaagatgtcaacagggtggcattcctttggaggaataaaattacttatttacatttataaatcaggatctaagaaaatagaattggttcctgaaatgtaattctccttacatgaaaaaaattgtatctccaacaatgggtataaattcttaagacagaagccctggctcctttcagggattggggcactgggaagtcttttctttaggaggtatgacactttatcctttagtagcccattatggtaatcaaagttacttgggagttcagtgctgcaatttttttaatgctagtgcccactctggaaacctctcacagatgattcaccagtttattcaggaagctattctttcagctttgcttgggggacaaacgtggggtcagccttttgaacgggacagctctttcaggtctctttattcagtcatccctcacctttctctgccccctgatcttggagtcccccagaattttgctgagaaagcctcttctttcttccattttgtgttatgaattgtttagctttttgatattctcagtcaatgtgttgctatctgccttacagctttcagaaattcctcagtattcagatctgccaaacacaagctccctatacttttctagtggtgttataattttgtcctctttgtgaatatcttatgtcatttaatgggatatgaggttggagacatgcatagtcaactatcttgaattctaaattttttattgtttattctattgccatatatgtgtttttgtaaattgtaacaaatatttttcaaaaatgtatacgtgaatatatagagacaatagataagttgataaaaattttgatctattgacctcacaaatacaggatctctgattttgtctgaataaccatgttgtttactgggtcaattgcttgtttggcaagcatatctatgcctgggctatgttattcactggagttacttttaaaaaataagccttttaattcttcatggtgtctattgttcgtacaattcaattttgcactttagtttcattctgaaaatttagcatacattatagattatcagtttatctcactcagtagttggctagagaagtctgaaggtcagagaattcatttccatggaccttagcttttcctatttctaaattctttaccagaaaccagactctctttggtagtttgactactttttatccccataaacactgaacactgtatttaagtcaaagagacaaaatccctcttgtatagtccaagcactaattttacagtcatcactcaaaataccccagtagaaatgcttcccttcccgtatcccctgccatggttgctatgtttctgcatctggaaagattgccctttactataaccctggcttcggacttagagcgtggatttttccaacatccgtacagacaatttccacccacgcagaaccagtgtggtttcatgttactctcaatccttcatggtggctttatttttattttttcgttaggatatcacatatttgtttatgtattttgattatagtctttttatctgttagcctgtaacttgatattatgcaacttataaaaacaataacaataatactgatgatgacaagaataataataaacatcacttattaagcataaagtaggtaccaagtgcttttataaactatcaattttaagtgtttttaactggaagtaatgaaaaataaagccatagtgtctaatacaagtagtttatttttgacacataatgagaagtttgaggatttgcagctgctagcgttgttccagttgttcaatgttattcataatgaagcctctagtactcacgtggtcttttccccattgtgctaaaatgactgcatcaactccagccatcatgcccaccagcaggaagaaaggagtataaaatggaggaacctgaatcagaaaagtaaaaatatcattgagactatagctgatcccacctatgtctgattggccagaatagtaacacaccaactgccttagccggaattggctagggagaataaatttggaacggaggctgggccaactaacccatattggccatatgtttgccataacaagattatctcattttatacatttctgccattgttattcctctaaggatattgaaagccagagaatttatgtgactcatgcaaaatcacaccattggcaagagaaatggctggacttgaacttatctctacctttctctgaattctcattatttccttttattatactatctcccaggattgtttataaaacaacagtatacataattaaagcagaattgaaggaataaatgaattaatggcttcctagcattgttgtttatgcagatggctctatataagagatagttctgttaaagtccttactgagtagctttgagagataggtggaaaaaggctgggaacaactagcctggattcaaatcccagttccaccacttactcatacaggaccatgaatccggcacttcatgtctctgcaccttgagttctcatctttctctttgtaactattctctccaagtccagccatgcattacagccaaattaatcatcaagcagtgttttattcccctgctcaaaaaccataatagttctctggcgaatgccatgaactagctactcaaaagggactcatagttaccttttccctgggctttctttgccaaagactcagaaaatagaaaatactcaatttctcagccccccatgtaggtagggatggcatgatacattcctcaccggtgagatgtaggtgacagtcttgggaggggattggccctccctttacccttaaaccttcttcctgcttatagtgcagacatggggctggaagaggagcagtcatattcccatcgtgagagtgaaagctacctgtgcagaatgacagggcggggcaaaaggaaagagcctaagtcttccatggcctcctgagccaccataccaaccctcacctgcctgcctcctgacttcttcttccatagagtaaaccaactgctttctcatgtaaaccactgtctatttttccatcaattgcagctggctgcattcttacgtgataacactttccaagtaaaacgtaaaccctgtacatcaatcttgaagatgctctagagtctggtctcaaccttctttccagacttttcttccacttcttccattcacaaactctattattcatccaaaccaaatcgctaactattaccacctctgtttcaaggccaggctgaagtctgacttccccattcaacaggttttcctcatgttgcctgagtggtgctatttctcgttccttagaacttcagtcttctttaatacttagcactttctctcttgaattacagttatttgggtatctgtctcatctctccctttgtgcattactaaaagccctattattcactaccaacaacccctcccaatcacacacaccacctcagtccccacatggcaccttggcccggtggatccttagtgtctccgtggtaatgaatgcgtagtagtagatgtgattgttttgggctatttcgttttgttttaaataccactgataatcattggaatctcttatttgtctctactgccttttgcatctttttcaatcaaaattattttcttagatctggaattccatctttcctgaactattgttgacctacttataaaaatctggaaaggaggagatatggccttgtttgcagtgcttggttcataagactctttccgggctgtctgctgtgcactgagcagaaacaagtttttaattctctccttgacaggcaggcagactggtgtgttctcctggcataactgtcaactagctccaaattcagtaacctctggataagtagaataaaggcagcttttgcttttatgaattcagtcctctacagagcctagcacagtgcactatatatactagtgacccaataaatattttttacgggtttgaaactatggtttgagtccaaattttcaaacaggcttactttgctttaatatactgttcactcattttttatttatgtgtattattcataccctgactacttctcaaagagatgtgtggtaactaaaagctacaggtacaccataactattaaatcattcaagcgaggtttaaaaggcaaaaaaaacaaacaaacaacaaaatagcccagtagtagggagacctagggtagggtcttaaagttcagctcctttgttccttccaacaaaattatgggtttggtattttttacaaatgaggaagccaaggatcaaaaatattgagcaaatggcaacaagtcttaaactcgagaatttacgaacccacaactgaagcccaacatctgcagatgtcatggtctgaagtcttcactcagtttcatgctgtgatggaagaagattctacacaccctgcctactctatccccatgaatgacctgaaacacagacaagagagattattaagtaaaaatgcgttacaacaaccagaagttaaccgaactgttctattctgtgaagttccttgcaaaacactaagccattggcacattaatggaatgtcaggagagaagtgcccctaaaatttatccggtgttgctacccccttttcttcaactgaagaaaactaagtgaattgagctgcctaagataatcaatgtaaagggttcatcggtgccaacctacttccccaggactgcttgcaaactgggagacaccaactctttttctgtctagggattgaggtcagaaagtctcaaagcatgatgtctccagtgggtgttcagctaatgaaaaagctttcacaaattctttagcaaaaacacttttggtcatttgttttgttacctttgatggaaaccttgttttcatacatgcaggtgaaacttccattagaaatttgtagttaaatggtaagtgatgctactattgatctgacaaagatagaaatgctcctatgggtaggaaagtttaattataatgtaggcaagcctagcagctagtctccaaaggtggcccccaatgaaccatgcttcccagtagtgatgtccttgtgtactcaagtacttgtgcacttgattcttttttattttattttgttttgtttggtttggtttggtttggttttattttatttttgagacagggcctcactgtcatctaggctggagcacagtggcgcaatcatggttcactgcagcctcgacctcccaggtttgggtgatcctcccacctcagcctcctggttagctgggactatgggtgttcaccccaacacctagctaatttttttgtatttttcgtagagacaggatttcaccacattgcccaggctagtgttgagctcctgggctcaagcaatctgccttctccagcctcccaaagtgttaggatgacatgcatgagccaccatacctgcccacctgcttgattcttgactagccctgtataagtaacagaatgtggtagaggtgacactgcatgacttccacatctaggtcataagaagccttgcaatctccacctgggtctcttgaaatgcccacttgtgggactctccctcacagaattcagccaccatgcccaagaagacaaagcctagagaggccatgtgttgttattctgattggcagcaccagctgagctcccggccaacttctaagagcaactgtcagccttgaaagtgagccatcttagacagccatcccagagaaccttcacataatgtatctccagacgacaaccatattaaagatccccaagtgagagtcacccagctgatcccagtcaatccatggaaccatgagttataataataaataactattttaagccactgaattttgaagatgatttattatgtagcaataggtaatgggaacagcagaacacactacaaagattatttttctctccagtttccacaaatctcagtggcaaagcattatcagtatctaccaagatctagaagacggtcaaattggaatttatttaaactcctctcccatcctaccagagattatgtcatttccaactaagttatttatttcattcctaagcaagagacacaagggatagaaggatcttgaaagaggaatgcaatttaaaaatatctattgagataggtattttgacatttgaaggaagaaaagacaatttaggatgctttaagagctttccaatgtttaccttcaaattatttcattctcagctatagaaagtaatccttattctactatttagttaccatttttatttagtttggagaaatctacaatggcatggtgtaccgcttaaagattttaatgtaaatgttcagtaaaagatgatatttgaaagtagcttattttgtctggaaaactctgaaccaagctaattttcttctatttgtgtatcttttctttttttctatttctttttccttcctccttttgttacttcctctctcccttccttctttcctttcttctccttttttttaaaaatcaataccaccttctgattatctcttactggagacaaggaaaagaaatctagaagatgtcatatttcagggacttaccaagtttcaactatcatgtgaagtgatcacacacagttttttttgttttgttttgtttttgtttttgttttcttgagatggagtctcattctgtctcccagactggagtgcagtggcgcaatctcggcttactgcaacctctgcctcctgggttcaagcaattctttgcctcagcctactgagtagctgggattacaggcacctgccaccacacccgactaattttttttcttttttttttttctttttttttttgtatttttagtagagaaggggtttaggggtttcaccatcttggccaggctggtcttgaactgctgacctcatgatccacctgccttggcctcccaaagtgctgggattacaagctagcctcccaaagtgctggggttacaagtgtgagccactgcgcccagccaacacacacttttattttattttatcttcacaataagccagccaagtggtgatgttgttcgcattgtgcagatgtggaaactgaggctgaggtaaataacttacccagattcgctgaaccaaaagtaattggcagagcaaggatcccaaccatgttatttgttagtccaaagactttgctgttcccataatataactctgtatctgaagcctacatttagttctgggttgctgaaaagtatactgaatggctgcccagagtttctactcatctcagagtccccgcctgccttcaggtttgattgctaacaagctctcaagaactgctgctctcctccattctgtgtttcagccttgtgggcctgcttgcctcagcctagaggcttctttctgcgtgtctattctttaagagcagttctattggagggggtatttaagaagaccctaacttgaagacaaatctatacaaagacttgtgggtttttttttttcatttttttcctttccagattttcaagaataagattgtattagccgaagttctctactgaaacagacttataggatatatatatgaggaggtttattataggaattggtttacattattagggatgccaagaattttcattatctgctatatgcaagctggagaacctggaaagacagtggtgtgattcagtcccaagtccaaaggcatgagaatagagcagggtgcacagggggagctgatggcataagtaaggcgtgagaatggagcagggtgcacacggggagctaatggcataagtccaggttctagtttgaaggcccaagaacaagaagtaccaaaatcccagggtgagagaagatggatatccaagctcaaacagagaacaaattcactcttcctttgcctttttgttctatttgagctttcaacagattggataattctggcccattctgtgaggacaatattctttactagttctactgattcaaatgctaatctcttccagaaacacctacacagacacccaaaaataatgttttacctgttatctgggcatccgttagtgcagtcatgttgacacataaaattaaccaacacaatggctgaccatgataaatcatatacatggatttagggatggatttccttaatgtaggaatccttaaatattagtattctcatattttcctgggagcttattgccagtgcaaattctagtacactactgcaaagatctgattccagggcatcttagatgagacccaggaattaggttttttaaaagcattcaagttattctaacagaatgactctaagattttgtagaacactctttaaagataagatcaattgcacttttcaattacattgtgggagggaattgttactccaggaagtttttatagttggaaggtgcagtttttatagccactccttctcatctatatctaagactacactgccacattcacccacaatgctcaaaatacctctaaaaacagctctaagggatggtctttagaaaataatgcaggtggctgtgggaggattctgcccttcacttactggatgggcattagctattagacagcttaagtccagttttttgtcctcctgagtagtctattttgtgttctcctttgctaatctctctgcactctctgaccatgactaaggccttttctcgaaggcttttgtttattgtaacttccaaaatgccttagttagaaacctcatctttcccacctacttattggctaactatgtagtacatatatcctggggcccagtggccaaaattatatttgctgttacttcaaagcttaagaaggcaaatctaccctacttctttcatttggtcaacaggtgtttagcatgcagctgttacagtccaagcactggatagatgctgggggttggactgaaggaaaaatgaagagataaggaaggcattggcccctgtctgaaagatctcccagttgaatggagaagatttgtgttgtcatgattctacaccaatgcactcatgtgctaagatgataaaatttctagtgagaaaaataataactaactgaaagggacccagaaaaagaggttgttaactgttcatatggaaggtttcagagtgagaactgagctggtcttaggagaatgtgtaagattttaacagagaaatatgtgttgtagaggaaaagaggagtagatgggggtgaaggggagagaaagagcaaataaggagagttgtgaacgtgtttgagtaagatccaggagttcaccttagtagaaacaggagatactgagggaagtgatgaaagctaagggtgaaaacttcagtgaggcccagtttgtctaacagcatgaatgctgtatccattgtttggaccttcgtcctcttggtcatgaggagctagcagagggatttagtcattcaacaagtctttatgggttgcatcccacccaggtatagcagtgaaaaaaaaatcagacaaaactctgggctttcttagagcttgcattcttgtataaagagaaagacaaaaaatgaagtaaaaatatgttgtatgtcatatggtgctaggggttgaattgtctctcccaataatatatgttgaacccctaatccctgatacttgtgaatgtgatttcatttggaaatagtctgcagatacagtcgaactaagatgaggtcatactggattagggtgggcactaatttcaatgactgatatcctcatagagaaagggcatgtgaagatacaagaatacagacaaataaggaagaaagccaggtgatgatggaggaaagggattggaatgatgtgtctacaaacaaaggaactcctaggattgctggtgactaccataagctaggacagaggcacagcacagattctccctcagaacctccagaaagaaccaaccatgccagcaccttgatttcacagttcatggggcaatacttttctgtcgtgctaagcctcccagtttgcgctaagcctcccagtttgtgctaatttgtaacacagcactaggacactaatcattttgtactaagtgctatgaagaagaaaatgctgaaaaggttcggaaatacagagagggtaggagaagctgtgtgctattttaaataccatagtcatggaaagcctcaatgagaatagaacataaagtcaaagacctggatgagttaaatttgcaagccattgggtgtttgcaggggagaatagcccaagcagggagaagagcagatgcaaagatctcaagacaacccgttctagagaaagcttggaggctggagagggagagtggaggagtagagggcaatgaggtgagagggattgcaaggattttgctttcaatttgagtacaatgaggaacttatgtagggctgcgagcaaagtggccatctgttttagagttttacagcatcactctgtgttgaaaattactgaaggttctcaaagactgagtccaggtgtccagtgaaaaggccattacaacaatccagggaaagggtggctgtgtcttgacccaaggaggcaacagaagagctagtgagaagtattcagaatctggatataatttgaaggtagagtcaacaaattttgctgataggttaaatatggaatgcaaagaaaaaagaagggtcaaggatgactacaagggtttctcttgagcatgaagggattgaagttatcctttatcattttgcagaaaaatataagaaaagcagatttgggagagaataccatgagatgagccagttttgagtatgccaagtttgacatatttgtcaaacatccaagtggagaccccaaataggaggtagagtgtataaacctagaatcctggacagggttaagctaaaagaaaaattttgaggtgtatttaacatagatgatatttaaagccatggctaatgaaatcatgttagacaaaaggcttaaggactgagccctggagcacctaacattaagatggggaggagctgaggtggaatcaggaagggaacttaagatggagctgccagggagggagctgggaaactggaagagtgtggtatcctggaagatgaaagaagaaagggttctcaggcagaaggagctgttcatgggtcaagtatggtaaagactgaaaatgaccacggagtcaacaacttggaggccattcattagtggccttaacaagagcagtagaagtgagtgggatgggggatcattagcatatattcatgagaaaatgggaggaaaggatttacaaatgaatatggataactcttgaggacttttaatgtaaaaagctcaaagaaatggagtaataaaagcacaagtgggaagagtgatcaggaggggattttttttaagttgggaagaataacagaacattgagtatacacagagaagaatgatccaacagaaaacgaaaaattagaagagagaaagaaaatttattgtattatttttaagttgatttgcatgagtgtttatgtatgtgtgtgtatgtccaagtttgttaaccctgtcaaaataaaatcaaaccacagtttactccaaagtgctaaggagtaaatgtgactgacagtagttacttagtttcactcccattacttcctgccttcccaaaaggagatgacccaccactaatagtttagtgtgaattcttctagacctgcactgtacacataaaatctatcatacaaacaaaattttccaccagtaccttacccaagatgtacccagccaggattatatctgttgggagcacaacttttttcaagagagaagtgccaaactattactctattctgagaaaggagaacaaatagcaacttctgacattttaaaaagaaaaccttcctggacctctttgtaggctccctagagagggaaggaggatggcaaggttaggtctgtaagctgacaaattccagtcttgactcggtgctctggctggcagagacccgtgaagttgtttgtgtaggaacaagagagctgagcacagagagccacactcacagctgaactcagcccaaaagccatagggagcatcaccctatgagtaccaagtacttgacatcctaaatcaggcggcattatcacagtcaagtgttaccatcatagacttgactatgccaggtcgatgtagtcaggtgatacctggagaaagccagccccatttagttccatcttttgaatctggaagatggattgccatcctcccccaacacccatacacacacacaatttacaattggcattaatgaggtgctgaggttttgggacaattctggggataggcaatctcaagtgggagatcctggattttcttgtactaaggcttatgggaattcaaatgattaactgggaaaaatgaaaaaggatatgataatataacacgataattttatgaaacagtttttcatcaattacttatattttgtatatataaatagctatcttttataaaatatttttataaacacatatatacatagcgaatactgtacatgttatatcattttgcaacttttctttctttttagccaacagcataacatacgcatctattttaaagtcaggccgtgtaactctattcttttcttttctttttttttttttttgttgccactgcgaagttttccacaatattcaactgtgggctattgatgaaccattagcattcctccacttttttactattacaaatcatatagcttctaacattttgcgcatgtgtctttatgcatgtgagcaagcattccaataggatatgtgcctagaagtgaaattgccaaaccaaaaactcactaacttgtagtttagatgggttctgcctatttgtcttctccaaagctgttctcctgtcattaacagtgaaagatgttccgttcctacccacctcccacacagctttgccaaacctggatattaccagtctttataatttttgacaacttaatatgggaaaaatgccctctcattattgactgaatttgtgtctccttgttagtgaggttcatcaccttttcatatgtttgccttttgtatttgtttgtaaattgcctatacatatccccgttctttttttctatcagataggctgtcttttttatattgatttttatgtttttatactttatgaatattaaccattcttatgttttaggtgttgcaaattttttcttttttatcatttgtcttttgaatgtgtttatagtgacttttgctggtgtaccaaagcttccatttttaaaatacaaaatacatgaatctttgtgaatcctgggtttcgtcctttattgataaatccttctttagcataagattataaaaacattatgctattaatttaatcattatggttttttatatccgtaatctatctcaaaattattttgagttcattgtatgataaaaggataaaactttttttttttttttttttcttgagacggagtctcgctctgtcgcccaggctggagtgcagtggcgtgatctcggctcatttcaagctccgcctcccaggttcacgccattcttctgcctcagcctcccgagtagctgggactacaggcgccagccaccatgcctggctaattttttttttaatttttagtagagacagggtttcaccgtattagccaggatggtctcgatctcctgacctcatgatccgcctgtctcggcctcccaaagtgctgggattacaggcgtgagccacccgcgcccggccgataaaacttttttctaattactcaatatattaaataaattgtctaatcaccactaatttgaaatacaactacatttctacatatatttgtagaaataagttctgtgctccctcttttagtttctttcttcatctatcaatgcactatgaacattggtttttttcatgcttccacgtaagtctttcattacttatttttttttattactgaaacttaccagatatgccaataaataagatttcctataggagattggcagggagtcaacagttaagttgggaaggtattaaaaatgtgaggtgcagtgagcccaacagattagaaaataattgccacggaaaagacattttgtggcagggcacaatgtctcacacctatactcccagcactttgaaaggctgaggcaggaggatcgcttgagcccaggagttcaagacaagcctgggcaacatggcaagacaccatctctacaaaagatacaaaaattagctgggtgcattggcacatgccgtcccatctacttgttaggctgaggaggaaggatcacttgagccctggaaatggggttgcagtgaggcaagatcatgccactgcactccagcctgggtgacagagcaagaccctgcctcaaaaaaaaagaaaaaaaaatatttttttgctgacagttcccaagaggaaggggcatgccaatctactcagtaccacacggggacataccagggttggtcaggaggaataaagggaggagggaactatggggaagagccttattacggtttctgctggaagaggtaaggcaaggaaagcagggttaggactggcttattagtttcagcaggctctggggtgattagagcaggtggttagtggcctggagtatgagagccctataaagaagatagttgaggtgtggattctggattggccagtttgcatatgaaaggcatgcttagaggcaaattgttcattatgtctaggaattggctaacccttggaggggcacttcctcctgagtcacctaggccccagatatcaaagcatacagaaaatagaagacatgattaatacaccttcactcaaggagtgccattggtcagtgaagttcactcacggacacatgtcacttccttttctttttagaagaattctcctccctaatgtggataagaagaatttaataggggactttttgcatttcatttctgctcctcatgctcacagtttctccaggattctgttgggagcaatgacctctctgcagtgagcttttcattggtcagctttgggacactctgttctctggtcctcacttcagccaagcctatcttacttgctctttatcattcagaagtttctcaacgtttctatctactcctgttttctagagttttcgttgatgtaggtctttattttagacctttttgttcatcttaataatattgagaagtctggagttatcaaataagtgtgctcagctccactgtcttgaatggggatcccatagtagatttaatgaagtagaatagagagtagaatctctgggttagatagataatcttgggagcagtaagaaagatgagtagaagaagaaaataattaaaataggacattttaaaggcttatgcagctatttgtagtatttgtctccccagtaattccaattctggtagtttatcctaaagaaatagagctacacatgaaaaaattcactgtaacaccatgttcagtggacaataattagaaaccacctgaaatatctgacagtagataaatggctacacaagtgtgataaccaactgataagaaactattcagttgtttaagttccattttgaataaattgaatcatggggaaattctcatgttataatggaaaataaaaaggaaagtcacaaagttatatagtatatgtttttatttaaaaatgaaaacaataatctaaaatgccaaaagtggttattttgagatttgggaattatagaattttattgttatatttgttcattatatatatatatacacaaacacacatacacacatacacacacacacacacacacccatatatatatatatatatatatatatatatatatatatatatatatatatatatatatatatgaacatgaaaaaattgaaaaagagttccttggaagagcaccctgtttgtcagtgaatgaatagttataagcttgaaaaacatttctttggctcatattatgtattaaaatcctggaaaatgtagaagattcctcaatacatgcaataatctgattgagtaattaaaatgaatacctggatcacagaagataatggatcaaagatttttataggtggaagcccaactcacacaatttgcagatatgaaccctggtgcctacagagttgagttctcttcctcaggtctgtctgccagttagatcagagccagggatacatttcaatcttgaacaataatgtgaaaaatatcctatgacagattgtgattctgccaggtaggtaatagaaactcttcacatctctaaatagctggggtaattgcaggagtttttctgcgtcttgccaagtttcttagggtcatacttcctacatttctacaactaatgcaggggcttctgaacttgtctacttatcagaattatatggagaactttaaaaaatatgttaagtcttaggcctcagtgtggttaaatcttagaaccagaattcccaactttctggaggtaattctgatgcactatcagctttgtgaatcattgtgtttttttcttttttcctttttcttttttttttttttttttttttttgagacggagtcatgctctgtcacccaggctggagtgcagtggtgcgatcttggctcactgtaacctccgccttctgggttcaagcaattctcctgcctcagcctcccgagtagctgggactacatacgtgtgccaccatgcctggctaattttttgtatttttagtagagttggggtttcaccatgttagccaggatggtctcaatctcctgaccttgtgatccgtctgcctcggcctcccaaagtgctgggattacaggtgtgagtcaccacacccagccgagaatcactgtgtttttatacctctttacctctctttatattcttaggaaatggacaaatagacaaaaaatgtgaaaaagttgctggttaatgaaagaccttctatacactgacctatagaagacaggttttaaaatgacttagtaatactaattgtcatttagagatgtttgcaccaatacagtgatgctacccccttgaaccttagatggtgtaccagcacacctgatgatcaggtggtcaatgaaatgggtacttaacttcatatctttgaatttgatttattgccaaggtgcattgaagaagctaaagtagttctgctaatgcattacagagagtaaaagctgtgagtttatcaaagagagaatcatcatgatgcgggatggtcagggaagagtaaatagttataatagtagcaatcattcactctgaactccttttgagccaagaattgtgttaaatgcattacccacatttgtcacataaatgctcacaatgagtctatcacatagtaatttgatttagtcaaaataagctagcaaacaatctcaaaataccagtggatttaaacaaagttttatttctcacacatacctcatgtccatttgaggtttggcagggtactctcttccatgtcatttctactcagcaacattggctgatgacatctccaccatctggactgtaggtggttgctaaagcttgggggagggaagatggagcagtgtgcaacagctcctacacatgtccaccatgaagtgacccaccccactttcactctagccaagccaattcatatagtcacatgcaacctaaaaggagcaggaaatgaaactttctcaagtgaggagaatttcagaactagaaatattagtgagctgcatgcactaatatttgccacggtgtcgttcctgattttaaaatcaagggactccctaattacagaatggcaaaaaatttaagaaacctgctaatatcaagtactcacaaagatacagaacaattggagctctcaggcatagctgggggaatgcaaaatggtacagatgccctgaaaaatagcttggcagcttcatttaaagtgaaacatatactaccatatggaccaggatcttgcttatgagtttttactgaagtcttcagtaagtcactgaattcttcactgaagtcttcactgaagtcaattttgccccccaacatttggtaatgtgaggagacattttggttttcacaactggttcagaggctgttacgggtacctaatggatagatccaaggatgctgccaaacatcctgcaatgcacaggacattccccacaacaaagggttattccactttaaattcaaggtggagacattttgcactaaagaaataaaaactgccaggtgcactgactcatgctgtaatcccagcactctgagaggccaaggcaggaggatcacttgagctcaggagtttgagaccagcctgggcaacatagagagacctcatctctaccaaaaaaaaaaaaaaaaagatgaaaaaaaagtagctgggtgtggtggcatgcacctgtagtcccagctactcaagaggccgaggtgggaggattgcttgagcctgagaggtccaggctgcagtgagctgagatcatgccactgtactccagcctgggtgacagggtgagaccttgttcaaaaaaaaaaaaaaaaaaaaaaaaacgagagaagaaataaaattttatcttcacataaaacctacacatgaatgtttatagctgcattatctatatcactgacaactggagacaactctcatgtctttccatagttaaacagataaaccatggtccccatgcaatgggatactactcagcaataaaaagaaatgaactattgataaatgcaatagcatatatgaatctcaaaggcattgtgctaagtcaaggaaactgactccaaaaagttttatattattccatttatagaacattctggaaaaaagaaataggaatagataacaatcagcggtctccaggagtaagaagtgtcagagggtggtgaaggggagttaagttaaaagaaactgcttgagggaaatgttgggggtgttggaattgttctgtatcctgattttggcagtggctacaataatccacatgtactaaaactcatttaactatataccccccccaaaaaataaactttagtaatataaataactttttaagttgaaaaaattaaaaataagtaaaaacacaaaagaacagggctgagagacttgtctctgtcccagagattggggtgcagtataaagaatagaacccagattagaatgactgcagaaacagccttcttccccattgcataaagctgcctccacatgaagaaggactgtgagctgtaaacagagcttaaatgacttttaagttcaaaagtatttgtcgttccattgtgttgactcttgaaagtgttaagtgtatcacggtgacttggtaaccttctaataataccatggttctccatcagtctaggaacacagatctagatccaggtcaaaactgcctttctaggctgggcacagtgcctcatacccataatcccagcactttggaaggccagtatgggaggattgcttgaacccaggagttcaagactaacttgggcagtataagagtataagcagctctcctggttcctgggaaatatagggagaccctatctctaaaaaacatttagaaattagctgggggtggtgtcttacacctgtagtcccagctacttgggaggttgaggtgggaggatggcttgagcccaggaggtcaagcctgcagtgaaccatgatcaaaccactccagcctgggcaacaaagaaagaccctaagaaaagaaaagaaaagaaaagaaaagaaaagaaaaaaaagaaaaaaaaacagaagaaaaacatcttccttactcactacccctcaccctaccctatacaggatgcccaagggtaagcgtggagacatgtcaacaggaggaaagacccagtttaagttgcaatagccttgggtaaaacagacactctatatgagtaatagaaatagatgctgaatttggtgttagagttatttcaactcatatctacatttcatttttctgtccttcattttgtaataatcttgcagtggttaattctaatagtgggctattgcttgaggtatcagaaacaaaacaaggaagagctgagtatcaatgttttcagtacattttacatgtgtaacaaggttaatataatagaccacgttaataatgaggtcacctggtgctctctcatatgcctttcctggtgcatgtggtcagaggctattctaatcaactctgcccgcctcctgacattttaattactgaaacaattactattgcctgggaaacaaatttgaaaatgacttgaataaaagagcagataaaggagagctgagttttcagtttttgttttttttttttttttttaataattactccaagagtagatgctcagatgagaaatttttaatggaattaataagatgatattaggggttggacaaaacctccactaagaatgggcataaatgaacccaaacctgattcttaactctcaaggaaaatataccacatagtcctggccatgaaagccacagtcttgtaatattgtttggtatccttcaagtatttatatgtacaaaaatggacttagagcattggtctggattcttcaggaagcaaatatatacatttcccctacactctacacaggaagttcataaaacaagtcatgctgattaaaagccatagttaactgggtctttttcttccattgacaaaggagggttgacaagtctgggaagaaaaggaactcagatttattaagaacacacaatagaagccaggcacaatagtaagtgttgcaggtctggtgcactatcctatgtgcttgtgtaatcctcccaaacactgcttatcaatcagggtctagttgcagaacacaaacacgtttttggtcattttaggcagtgaaatgtgtatttacatcattgggtgggctgaagaaaaacactaggctggacactcagagtgactcccagaacaacactgtggaaaccaggagagctgcttctactgccacagtcaaaaggagcagaaccaaaggcccaccccagccagcacaattgcctctcagcacacccatggccagtcatggacactagaattgtgctgcagtgaagcccaacatctccacagccatgcttgccaataaagaaagccaaaaagcaaaaaattggcctctctcttgcatctacatttcaaacaagtacgttgtattggtggaacctaatttgcttatgaatgctagctccaagggagtgtgggagatgtagttttttgcctcccaggtcctgtaatactgagatcaggatgatagaacgattgctgagtgccaactacctaatgcactgcactctgtgaaggagtttatgtttttccaattctttataggaaaaataccgaggctcagagaagtgaaataagtttaacaagatggtacaaactgaaaagtagcagtgccagcatttgaacctagttgtctatcctcattgtcatcatttattgggtacttactctgttctgtaccttgttctaagtaccttcaaatattattttatttaatctttaacgctgttacataagtattatggtccccactttgcaggtgagggaaaaaaaacaatgcagagacttaaataacttccctcaaatcccacagttagtaaagattagagccagcatgcttagaaactaaactccagcacttctcttcttctcctacagcacattgaactcttgacagtgggtgtttgatcagcaccattgttgatatatatctctcaacactccctgagacaccaacattccatgcatatggagtaagatggtaatcctctgaaagccacttaggtgcttttggctaactggtgtggaaggtttgagggctatttagagttacatacttggtgcagtactggcaagaacctaacaataagctccctggaaataagagtcctaatttgtagcctttaccagtctctgtgatataaattctccaaccatggccaatttcaagctaccaatatggtattaaccagtttgcaaaattcctgaaaatttaacaattggctcttgcaagctagtatgagccagctccagacagctctgtaaatggtctctatttgttcaggacctagtatacccttacaaggagacttgaatcctttctacatttggagttctgacatgtattgagatgtctaaacactggaaatctcttgacagaaggcagatagcagagagatacaaagaggtctctgaagggggaagaacaccgtaggtttgtcataaatctggtgggatggggctgataatttctgaagaaacaatggtttggggtgctactcttgaacttgcttggtctctggcccctgtgtcaactatgagccctacgaaggagagacaaacttttagtgattcaagacactttgctgggagaggcccttatcacaggtaggtgagtaataaagctgaaaaaacactatgactaaggttccaagtcactctgtggaataaaccctattctttgtgctatcaaaaggaaggaaatgtatttccattctagccagagacttatgggagcacaggcactgcagaaattctccatagaaaagaccaagtgtagccactgcctttctgctctctgtctttaacgtgctgtttcttacctgggtatgcttttcccatttctttaccaataaaaaaaatcctattcctcagtcaaaattcaaatgccatcttgtacaggacactgggaccctttcccaaaatctctgcagttgggattagtaattcttcctttggttatattatcttttaaggtacatgtttcattcttcttggcatttgcattagttgcctacacatgagtctttgaaggtacatgatgaactctctcagggtagtggtggtagttcatttgtgtctgtggttctgaccctctggtacatagaaaagggctgtcgcatacacatgctcagtaagtaatgctgacattgcttatatagcaagtagagaagcaactggtattaaagtacactcaaaaaaaaaaagtttaaagaagaaggaagggctggcatggtggctcacacctgtaatcccagcactttgggaggctgaggcaggtggatcacctgaggtcaggagttcaagaccaggctgaccaacatggcgtaaccccatctcaactaaaaatacaaaaattacccaggtgtggctgggcgcgatggctcacatctgtaatcccaacactttgggaggccaaggcaggtggatcacctgaggtcaggagttcgtgaccagcctggccaacatggtgaagccccgtctctactaaaaaaaaaaaaaaaaaaaaaaaaattaggcctggtggtgggcacctgtaatcccagctattcgggaggctgaggcaggagaatcgcttgaacctgggaggcgaaggttgcagtgagctgagatcatgccattgcactccagcctgggcaacaagagcgaaactccatcttaaataaataaataaataaataagcaagccaggcatggttgggcacacctgtagtcccagctactcaggaggctgagacaggagaattgcttgaacccaggaagcagaggttgcagtgagccaagatcatgccactccactccaccctgagtgacagagcaagactctgtctcaaaaaaaaaaaaaaaaaaaaaaaaaagtaaagtgggaagaaagtaaagaaggaaggagggaggggtggaaaaagagaagaaatctctaccattcaatgttttgtctgaagggtgagggtacattttcaccccatgatctgatattaaaaacatgtttttagaggaaagcgaagaatctctttagaacatcttagagctagctgcctgagtcatggcataagaataatcccaccaccccctgtatttcttatttgtaattcatcctttctagggatacacatgttccccacaagaagtgttcaccagtgagattatccttggcaaagccattgatcagagggcaaaggattgtttcagtccctgtgccaatgcttccttgatggcgattgcttccacgaagcaaacaccttaatcactttgttttctctagcatgtcaataagtgctcatatataataaatgtgtgcttacagcatatataatatatatggatgtatgtggtgttttgtattccatgcctgaaagaacagttgatttatttcatagcttttatggactgttttattattctcaacaacatcacatccattctctttgcatgcatattttatagcaccttgatggacttatttgatttgacccagtgttttgatgacagcacagccataggaggttcacattagcttacacaaatcatttgctcaagtcactttagagtgtgatcctgccctcaggttatttgtggactgccagctctttcatgatgggcaaaatagcatagcatgccctataaagctatggctcaggaaaagctcttggtgattcttggatcaacagggcaatctcctaggaggggctgctaactgtataagtataatcagtcattgacagaattctatcactggctttgattcaatgtgattcttctggctgtcaacatccttataaggagaggctaagacagagtatcataactgtatgtcagattcttgaatcctaaaagttcatgcagcaatagattggccttagtaaatactaattaaagagtggtttgggcaggaaggtctgaggattggctgtgatgactcggacaagcactaaaacttgagaagccctgctttaagaagttcatgatattgccagggatgttaacatgggttctaatagacatctttatacagtgctttaggagcacaaataatgtagtaagaaacaccactttgggtagttgaggacagtcttcctaaaaattgacattcagacattttcttgtcctttgatttttttcctactctggcagacaaactgcttttttatattactattttttgtagagacagggggtttgctctattgcccaggctagtctcaagctcttgacctcaagtgatcctctcccctcagcctcccaaagttctgggatcacaagcatgagccactatacccagcctaaatggctttcactccgtgcctcattctgagtcaaaatggctctgtccagggttctgaaacctgccttctaaatgttcttcatgtgaaatcagttcaaggatctgacagggagactcctgttaagtttactgctgtgttttatgttgtttcctggtgatcccatattaaacagacctgggaggcctcaggagtaaactttcacgtcaggaaactgagtctagaagaggcctagcaactcagcccccagcacaaagtgagttgatggcaggaccaggaagaccagctcttaggctttctgaccttcaagcagctactctttccatgacattggggtcttttcctggtccatttgaaatggtttatgattggatttgtggccataagttagtgttcaaggctgaaattttcataacatcaatagagatgaacttcttaatcttattaatattttcttcttgtatgtgtacccttaatttgtgaaaatagtcctttttctattggagtttgacttttcccccctgataatttatatataaaaattattatgagcatcaaaatctttctatgctgatatattttgaacggctttagaggtgtataaatcttttttaaagtaatacgttttcatcaaaagtaattagcttaacttaaattagacattatcttgattttccattttttatacttgtgtgtgcatgtcaccttttataacatcttttgtaaaaaaaaaaaaacaaaaaaacttttggcttcatagctaacttgaatttctttcttaaaagatttgagaatgatcatgagtgttctatatcaacactcttgggcaagaatcgaggagagctggtgactataaacactgagtggtgtccaacagagctgctcataagtgttatttgtaaaggaaggtcataaggccaagcaggagatgtcagaataccaggtggttagtctgagcagtgctggactagggagagaaaaaaacaggaatcaaatctttcagttagagatgtagctaaatcaaagccacaactctgtggagtttattaaaagggaggccagaagatcaggagacatatcaacaaaagtcaggtggagattgggcagggttggtagtgtaaaataaggtcagttctgggataaatcttgtaatcttaaccactgagtgccttttactggggacttgacacccttatactgggtgaggcaggagacggcacgcttaaagcagtaagcaccttctaagcaataggtcagtttctctcagaagcagtaatacaaacatgcatttataacccatggcagtaaaaataatttgagcattatgagaaggagcggaatagattctggtgctttgtgtaaaaccctttaaattcccatttcattaaaaattcttctctgcagctggtagcagagattaccgtggttcaccatctgtggggattaatgtttacttaaaaagaaagagggagagcgagcagcagataagatgaatgatttccagatacgagagagctaaagtagaatatctttgtgtgtgtgtgtgtgtgtgtgtgtgtgtgtgtgtgtgttacacctgctttatttgaactctgtgatagaattgtttaaagaaaacctaggcttatttatgtttaaagactgaataatgtagaaacagtggatcatcatcaaactgtttagatttacattttatgcagaattcattttgagaggtttttagaatctgttagaaataattaggcatgtttggaactttctttttacatttcccattctgggaagatttttcctgatacttacagattgagttcatgaggcagaactccacattctgtcctgaggggaccagattaccaattccctctaggtctgaatctgatcaattacagacatgcacctcatccgtagactgacttagcttcagtagatcactgactggttgccttccaggaactggaattgctggtgaactatgaaaacaatatagatagttttttgcttggggttggttggtttgtctgttttagcactggctgtgtgacaagtgcagtctgtgctttacctgcaacatcgctttaattctcacaaccacctagagaataaacactgtgagcatctcgtctcattatagaggagactgagacttaaagaatttaaagaacttgctgcacttcaaagctaatacatgttaaaacagatatttgcattcagatctgtcttcccctaaagcccatgctcttaaccattacactctacagtctcattcaatacttaggttatttccaattctatttaggcacttttagaccccatcttaatattgagaatctcatttccttgaacatcatgctttttcctttcaatatgccacgagtcatcagtaccaggagcagaaagcatcttacttactgcaattacacttgctaatcaattctgcatcactgcccagtgttataaatgtgtagttacctatattctattgacatgtggcctcatttcttactgaaatgggcagtagtctcaatttagaggctcttttttttttaatagcacaggggagccaaagaaatatgtcaatctcattgccaatcaaacagaaataaaccattgtgttcattcctcataccggggatccataagctcagtgtgatccaggtacttctgagttttaacttctgaattaaggagactatttctgagaaactgttcttaccattattttgaaatttccctttaatttttatattgataattatctaacttgcattaaaatattcagtattattttatagggtttgaaaaccactatatggagctacatttctgctaagctttacaaaataaaacatcataaaccatgtgactatgttagaagacatctggattgattcagtggttgactagccaaccaccctaaaagtggtataatgaagggtaaggaagccctgtcacctccaaaggagaagccaggaattataaagtcgagcgggtatcttgagtgttagttcaatgaaggtcagcaatgatgtccagggtgcagaaggagcaagggcaattaagaggcagaggtcttagcatcagctagttgcttaagctgtagatacagagaaatctactgtcatggctgaggagtcactggaagcatggtctgcttttggggaaacactgataaaagtgagatgagaagagcacaggaaagaaaggagtaaaaactagctgccaagaaaaatagccacaaagtggcaaggaggtttagggggagtgcagagggcatggttacttaaagaagctgttatgtgaactccagtccacctttaagcaaggcatggagacaatatactattttcagagtcttcttcctgctcaagggatggaatatttcctaacctagtaccttcctggggcattgttggctcagacatgggagcagtagtccttaaccagaatgagtcagactaggattaatgacagttgaaatgggcttagtggcatcgtcaggaactatcaggacatgacagagacttttaaaacattgcctttgtttatttggcaatagccatttatttcctcatttgatgtctcttaagagtaagtcaccagggcacagttaatagggagatgagggaagccaacagctcattcactgcatcatttttatatctgccctgttcagccttctttgaatggtgcaaaggggtgcatggtcccatcttacagaatcaacgtggtttcctctgtgaatatttgtctagcttaggctgtgggtgcttctagtggagcaaatgcatcttgcttacttttcacattcactaagatatgatatagaggcagcctaacatcatagatgaggaaagcatgaaccatggcatctctcaggcatggatttaaagcttagctctagcactgatgagctgtggggctgtaggcaagctatttcaccacccatcttctcatttctgaaattggaagaataacttctatctcacagggatacatcaagggttgaatgagacaacacacattatattgtctggttttgactgcatattggttcccccccaccggctccctgaggccatggacactgccctgcggcctggcagcttaaggaacatgtccagcccactctggaggatcattgcactataaatgtcttttcaactttttcactacccaagaggagtcttagacatttgggcagcaggaggaaccccctgtttagtagattcgttcattaattcagcacatttttattgaacacctaccatgttccagacccagattttaaaactagacatgcagctatgaatgactagacaaaaacacttgccttcatggagcttacattctagctgggggagagacaagcaaataaaccaataggcaaattacatagtgtgtcagaggttggtgagtaccatggagaaaaataaagcaggaaagtgagatgaggagtgtcagggtgcagtagaataaatgcaatttgatgtataccagtcatacttcagaaggtgatgaagagaccctgaagaatttttttgaattaaaggacctcagagggaaagtccattctgcctgtccccatccccactctccctaagacactaggttcctcaggaagatgctgccccttcttagtactggtattcttggcacccagcacaacatctgacacatacaaggcactcaataattgtttgttgaaccaaactgcactcctcaaaccttgctcaggagccaatgtgccctttgacacctgaaatatcagtttgcattaacagctccacctgcacgcctcagtttgacatgcagtgagttgtgagcctgcatgttgtttattgatttgactaataataagtaatggagtggcaactcaaatgacattaatgtggaaggaaatgaacaccataattgaaatgctgtcctgcatcaaggcacctttgttactgagagaagaatttgattttcttacacagtgttttctgtttcacttcctcagctctcagaactgtaaaatcccattgaaaaggtgtgaaaggcaaaagcagggttttaagtagaaattcaaagtctgtttcacagtagtaagaaatggtgatagtgggatgaactcaatgaaaataggagaaagtagagaaggaaatagaacaagagatgtgagggcttcaaatgccagaagtaaatctatccagaaaaataaagataattggccaactctcctttcataaggttaaaacaatggccttgtcttgacttttattattcactctgttattcatttagcaaatatttatggaccacttaccatgttttgggtgatctactaagcaacttagggtgcataatcattatccctatgtcataaaaaaaaattggctttcctttttccccggttcctgggaggtaaccactaaacttttgtaatttcccaagtgataggaatgtctctgttttccatggtggaccccttggaacatacacctgatagtttttgctaatgaggtgactcatggtgggctcccagatagattatgctaataaggtgagtcaagatgggagctggctgcattagaaagaccaactgtgtgattagaaggctggggctttgagctgcctaatattaacccatggggaaaggaaagggactggttattgatggccagtgaatcatggccaatgattcagtcaatcagtggacacaattaagcctcaataaaaactctggacaccaaagctcaggtgagctttcccggttggcagtcctataagtattgtcatatattgatgtgctaagagggtaagatatccttgaggatggtgggagtttcacatttagaatcctcccagacttctttctatgcatctcttactttggttggtccctgtttgtattctaatcacaagtatagcatgatcctgagttctgggaggagttctattgaattaccaaacctgagggtgtccgtggggaccagtgaatttgtatccagctcatcaaaagtgacagtggcccaagagacctccaaacttgtgactggcatcttaagtgagaggagtttgtggaaaactatgcccttaactgtgaagctgggactaactccaggtggttcttcaagtatctcagagtctagctagcaaaatcaaagaaagaaaatcacattcacccagcaatggtaaggctatttgcatgcaaatgcatcctagtatgtcatgaaagagcaaggtccgtgccatctaactcatggggataatcaaaggtggccttctagacaaagtaaaacttgagctggatttaagcataactactaattagcaaagcaaggcaggggctaggtaatggagacagaaagagcagcgtatggaataacttccagattcatccttgtcctatcggaatcgatgatgataacaacaacagtagtagtggctacatttacttggactattttttatgtgaaacatgcttactgtttgttgacttatgcagtaccccaaaacctcatcgagaagttattgtggttcatattttccagtgaagtaaatgagatttagagggtgtatacaatttacccaaagccatccaactagtaagttgccacacctttgcttcacactttggtttatgttatagagtgaatatttgtgcctcccctccacattcatgtattgaagccttaatgtctagagtattgatatttggatatggggcttttggtagataattagggttagatgaggttgtgaggataggactctcatgatgggattagtgcccttttaagaagagacatcagatagtttgttctcttctctccccaacttcccccgtccccgccccatacacatacacacaaacacacagagaaaaaaaaaggccatgtgaacagaggaaaagcaccctcaccagaactcaaccacaatggcaccctataatcttggagttccagactccataactgtacagaaataaatttctgttgtttaaaccactcagtctatggtattttgttatggcgatccaagcaaagatagtttctgaacccagaactcttatacatgattatggcactgtatttcctttgggaagagcaacttagcctctgaaaaatatgattactgtaaggcatcctgtctcctctagagtataatgcacaccttgaggtgggagaaggtgctaaggttgaagccaaaaaaaaaaaagactccagttaaaggctggttctgtctcaaatcctctcttatctaaatgaatagagctgttaatttctgttgtaacatattcttgttactggctgctaaagaatcctgagaatctcagtgcaaaagggactctcccgtctgattctagattcaagcagtcctccaacttaagcttcactaatactagttggagcaaattaactaccttcctaggtagctgatccttcatcatacagatgagatcattagaaactttcttcaaggagttgaaatttaccactgtgtgttttccactaattggtcttgactttatctgtgagaaaattaaggcaaacattaatggcattagcaagagggtggctgttgtatctggttctatctgtaagagaattaaggcagaaattaatggcaatagcaagcaggtggctgttgtatatagtggaccatatgagaagtcttacagttctgtcttgaaccctttctagccttacagaatccattatagttcattttaagaaaatcatgggtctggagttcttttcagatatagcctttggtgattcatctttcactataagcctttgaagtgtctagtcatatacataagtaatcttttattcaactcttattttctgtgtatgtattcattgttcacactggatttattttatgtaaatcaagtccctagacatgagggaaacaaagcaaagccagattaattggctaattttcaaagactcattctacattgattgcagcttttttcccatgaattttttactatgctctctctttgctatgctgagtctcctttgaaacaactatatataaagttggtatatagaaagttgacccaaatcatctcattaaaaaaaaaaaaaacacacatctgcaatagtgacctagttctcattttatcaaactcagcaggtttaaaatataatagggggaaaggggtttttcacaggtaaagcttttcctaatgcctttctaatcctatacttgctgtatgtacatcttttttctctctctctctcatccttatttttccacttttgccattttaactcatgcatttagaaaatctccacaatgaggctggttctgcaacgttggagaaactgcaaactgaattagatttctgttagagggaggaactgctgctgccagaatgaaaaagcgaggccagcaacactttgcttgaagcaaacactaagctgacactactaggagtatcagatctctcccgtgtcctctggcctcgcagtctcctttagcaccccctactggcagaacctaacaaggatcagctggcaaagcagaaacgcaggttgctagtccttagtcccagcacctcaaagcaaagtacagaaagttagatttgaagctgagggacagtggcttcataaatggcatggaaggtattttatgttaagatttcagagagtacagtttctgtccttggcttcataggaggtcagcgcaatacagcccacaggttgtggggagtaggattaagtcaaatacttagtgtaatatctttgtcccattctcagtctatttttgtttgcttccccaaatcttagtgtatcaagatggctgctggaggggcgtctattctgaatacccctaaaggtattttagtgggagagataaatcaataactgctatgtagtgtttattatagacacatagcagagcaactattaatacacagctatatcatctctatatattatatgttactggcatatataaatatatcattagaagtctgtttctgttatataggtaaaagcctaaggggaggagaaaacctaacttaaggaaaaagcatccatcctccaagactgtctaggaaaagtgaatgtggacaggggccaactatgccccaccagttggttctttcctccagttattcttgcatatctgcagcatggaatgtcaggcccacctcctccatattcagaaacatcacatatttggccactatcctaaccattgttttgcagtcagacttccagccattcagtttcctggatgttttggagaaagaaaacaagacaatgctgaaaataaagccttaagacttatgaggcaaagagaattgcagatctcattgtgcttgagtctctacataattgggtggttctaaatagggagggctaatttcatggggtcagcactggatcctgtaaaagcatatgccatttaaaaattaatgcttcatgagtgctaagtccaaagtgtctcaagagactaggggagaaagggtttccaggaatgagatttggaaagaacataaggatgaaatgggatatgcctgtaaggaaggaagaaaaatgtaaagaaattcagttctaataaatcaggaataagtaaatcttgctctgtctttgcacacttctttttctgcatccctgtagcctggcacagccctgtacaaacagccactcacctctcaccattgtaccttatccttatccaatctcaccactctgacctttaaataagaaatataacatttattcttatgtgtatcatggcaatcttcagccacagaaaccctcagaattcttaatataagcaactgatccaacaatgatgatcctgtttaccaaaagttataataacatctatgtggctctttatactttacaatgcccttttgcatcacgtcttttagtcttcacaaaaaccctgtgaaataaataatattatccccattcttcattttttatatgaggaaacagaggctcagagttcatataatgtgcccaaaatcacatcatcaataggaggtagatccaggacttgaactcagctctcctgatgccaatattgacagcccttcagtggcctgtgtgaaacgtggcacagagaaccatgtaccacaaagcctcactgtgtgactgggtatcccaaggtgatttcaaaacccagccaaaagtatattattggcagatctcctgagccaagtaattccaatatgagggaacaggataacaaacgtggccactggggagacattaacatactagtttgggatgctgacaattgtttacctgctgtcactcacttacagacatggccaggcagcagtgtcaatcttgctgtgggctgaaaccccttgttgaaggaggcacaaggtagagttttgtcattgttcactttcagtactcttaagaaagtgattacaacactttcttgtatggatttggtcatgaaatttcattctgccacagattgaagaactctgccctgatgtagaagagaaaaagatatcaccccaacaattaactaacatttaatgttaattattaactaattataattaactagcttatgttaattattaactaacaattaattaataattaactaacattgggcacttactagatgctttgtatatctcatttaattcccaccacatcctatatagggaggtacccttattgttcccattttgcaaatgggaacaccgagactttgataggctaagtgacctgctcccatagggattaataggcagatctaggattcaagcttagtccctctgactctagcacctttcctcttaatcactgcatcatatggcctagatgttaaggttgtccttaactacccttcactagccactgaaattatttccatatgatgtttctctcagtaggtttgcacaaatgtgctagccataacaatttacaatgttccagcagaggcaaggaccaagacacataggagccaagtgttttaataacttcctgtgctagcagttataaaaatgtaattgttggtgcacgttcaaagaattaaaatatggcaaggtagaaggagctcttaaagccagctttcagaactacggctttgcccttgtaaacaacttttatataccccttttggagtgtgtataatgaaatgactaacattttcagctgtaaccggagctattacccagcagctgactgttttgttgcttgaaatctgttcaggaaaacactgaaaattggtggaaggggtagactgtggggactccttgtctctgcacgggcacattttcctcgttgtcccagtgaaaatggcctgcaggtaaattgcacccatgccttctcagtataaaatgaagctctcatctgcctattttgcttctgcttttaataccgatgtcccttcactcttgctcactaaagtggaacatatggttttctttatttttaatcttctccaaagaaaactacaagtggaagattccaggtgcccacctagaattctgaaacttacatgatttacatttttgatggaagttcccagagagatatataatgagtcatttctctcctttccgtttctcaatttacataataatatagttatagttgcatgtcacagttataaatattaagaaaaagttaatatgaagttgactgagccccttttcccctgaatttcagacagtgggcctctgaagattgaacaactgaggctaaggagaaacccctgaatttctcatccaatttcaaccctgactgtgctaaaaatgagtgttttctaaggacagatgctatcacagaaccagagaggttgttgttttacttgttcctgcagactagacaggaaatcataaaattatgaaagcagaatattgtgcttgtgtcatccactgtctcttatgtcattcagatcgtaaagatagactctgttctatttccaaccctttcctatgagaatggctgtgggaatagaacattaggactgctgctctttccccaaacccaataatagttttttgctaatagtttgttgcgatagtaagttgatgcatgaagccgtgtgtgtctcagccgtatcatgacagataaattgggccagcatcattatctgaaccagatttttgtatagtgctgcatggtatggtgcttaggattcctaagagtaaccttgaggagctatgctaatgacagtacttttcatctctggcttttcctgttaaaatacagagtcatgctcttggctgccaaaatcagtagcatgtggtggtaggcgtatactgcaggtgggagtaaagcagccttttgaatcggatagccttttctctagtcttcgctctgccatgatatgcagattatgtcacttctcagaacctcagtgtcctcatctgtaaaacgggataataatacatatttaggagggttttggcaaggacatcacaattgtaaaatgcctggagatgttagatactttgtaaatggcactaaatattatcatggaatatatgctttggtaaataaaaaacaatggtttccatttgtttggatgatgataatgttttaaatccttgatttatgtaattgtggtatcactttcctcctcaaaacaaatgaattgctctgcactgcatataagataagatcaacctccctgtttgtctcctgtaacacatgtacacacagacatctgtaaaatccataattcagccaccgttcactctggactattatcctgaaccatggactttatgttatgtcagtcatttagaataccaattccttctttctctacatgtagaaccattttatcagcctgttgagccccatctgacctcccccgctttggagcctttcataagccccctgattcaacttggggttcctcagacctccagataacctttcatcatacctccatcctaggactctgcacaagcagcttgtagtaaagggatcttgaagctgtctttctgccccatgagaatgtgagaatcaactggaaatgggaattgtggcatattcagctctgtattcctcctcgttgtggaccaaataaataagtaaacgctggtttgtgcagaagtttggtgtttatgctactcctgtcactgctctgtattttctgcttgtttatctgtgatttgcgtgccttgtcattatttttatgctccttggcggccacttactttacaactatctgtccttttatattgtttctagactccttgtggtctcatgtaaagcatttggagaccaggggagttgttgttgttgttgttgttgttgttgttgttttactgaaatgtctccctcaccagttttcatgtggatgaccccttaaataaccagaattaacatcgggaaacaaactatgagtttgcaatgcagagtttctgccactgctattgcatgggaggaaagaaagatctaatacattaggattggatatgcttgagacattttaatcaagcatgtcagtccttctgcaaatagaaagcactggcagcaaagagacaggattgtccaggggacaggtcgggaatgctagaaacattagaaagttcactttcctaataccctcttcagcttaaggcttgcacatttgcgcggggcacaggtgcatgcctgctcagagctgaaagagccttactgtttgctccttcagccccccattgacagataaggtaattgagtccaaaggtgaatcagccagttcagatcctgttggcaattagggaggaaagcaaagaccatgacaaaagtcttcaggctccaagtcccccactctttcctcctctataccttgtggccactttctgtacactgattacttgtgtagttcaaattttgacattttaagaattcatttaaggaattaattgcaactttcatcattacctctttttactttgaggtagcaccagatttcaacgttattaaactctgcagctccatgaatgttgaagagacgagccagcacctaattgccttcatgcattacctaccagcagaaagctggcctggatgaacatctgtgtgtagcttttcattttctttatggttcaggcactgtgctcctcaagaaactggttctgtctttgtttctttgcatttctttcctttcttgctggagttagggtggaaggggatctcaaatgctttttgagttttttgcacctaggtcgactatactatattttgcatttagcatcattgaagttgagatgggtcttatagtcaatggtgtgtgatagtttaattctcaactttatttcttaaaaggatggtgcatattacaatcttgctattgtgagttttaaaggtctattatagttcacattttacaaagtgcttttctgtatagtaataagaaccaacatatatcaaatgctcattgtggaccaggcactgtgggcttggtgggagacagtaactattttacctcttcctcataactcttcaagctggcgttatcctccattttatagataagaaaaccaaagtaaagtaattttgccagtgtaacaaagcagaaagacacagagccataggcacacccggggtgatttaaatccaaaactggtgctctttccacctctcttcctatcaggttttgcactcaaccttccccagaaccaaatggatggtaagaggggcagcatcagagcactgactctggagttacctggagccagttactcaatctccctgtgcctccattttctcctctgtgaaattggggtaaaaagagcataaggtagttgcgaggtttaagcgagctgagctggataaagcactgggacccagacccaacacacaccaaatgctaaggaaagatgaatgatcacattattccctggtttgcttaatcccctgtggacaccacagtaagctttgaatatgctccagttccttctgttaggtcataagccacgtggccagaagcctttagagtgccttgtaccatataccctcttctaggagagagaaaggggaaccaagacttgatgcctctgccttccagggaccctccacagtcctggcatgatgacttgtgcagaactcaccttcctcagatgctgctttcattaggaagtgactcctcggccatctcatctcttcatccaagttcccagactaaaggggagctacccacaaaactagtccctgaaaactactcatgccactagtaatagagtcaagagattgagtgcctgctgttaacttacaaattgcatggacatgcatttcactcttccctggagaaatatttcccagccacaactctgccattgcttcccaatgcctagacctaatcctaggtctcctgtatgaccaaagactgcctgacctcactgaacattaacaatgtccagcaggggtgaagctgctgccacccctgccctgtgaacctattgacttggcctcagtttctcaccagggaccactcattggccagagtaatctcgtgaggaaggtggagaaagaaaaccgtagagcaagccaactggctgatcattccctgagaatcttggcgagatgaaggtgcctctcatccgtggccaagtgtaggaccagaaggtaaacatctgaagtgtatctgagagcaggtgcagagactgagtcataaagcatgcctgtataacaggtcaccaaggccagatgtattcattcgttttcacactgctataaaaaacttccctgagactgggtaatttataaaggaaagaggtttaattgactcacagttccacatggctggggaggccttaggaaacttacaatcatggcagaaggggaagcagacaccttcttcgcaaggcagcagaagagcaagcatgtgaaggaggaacagtcaaacacttataaaaccatcagatctcatgagaactcactattacaagaacagcatgggggaaaccgcccccatgatccattcacctccctcccgcgacacgtggagattacaatttgagatgagatttgggtggggacacagagccaagccatatcaccagggcatcctacagtggacagaaagagctaacgagtctgaagaactgaggaaccaagagcagaaagaagcacagattggagtaaatgcaccaagaggtgacctgggctaagtccaacatcatgggcaagtgcctctgttggggtttggggcattcccaatatgggcaggccatatctgcttaaaggaatcactgggacagacattctaattacccagaactccctgcacatggagcaaggcccctgaccagcacagggacagcagacaagctccaggccatgccccacagaccagcccttgtccagccttatgcagaacagcctgaggatcagggacaccgggtggcaatgccaaggctttcagcattagatcactgcagtatttaatcaccccactcctgattagcagtttctgtggggtttattatgcagttaaatatcatcattgggactttaaaaatattctctcttttattaaacaacaaatataatttattagcaaatatataataatatattagcattcagtttaatgtctctcagtggactcaagctctatttagctatccgcttgtctcctttcagtttttccaaggacatatgataaagcccccctatttctaaatagaatgcattttcatttaaataaaacagcttagacaaattagggtttctaaattaaacatttctaaagccatttttctcttaagaattaagagaatgggagagatctgaattatgtaagtagcatgatgtaggagtagtaaatttaaaaagtagtaataagtaatctgaacatgattaattgtttactttgtggcaaacattgtgctgagagactcaggtgccaaatgttacttaaccttgacaacaacactgtgagtggagttcttattctcattttaccatgtggtagaaatgatattggtaaagtttaataggttcctccaaacaatacagctcttaagaggcagacctagaatttacatctagatccttctgattccacagcccaagtgtttaactcagcataggacatttagattcagacctggatttaaatttcagctgtgtgactttgggaaaattactttacctctctgagtctgtaatctgaaggttcatcatgcctaccttaactgccatgatgactaaatttaacatataagcaagtgcctagtagtactataatagtactatatgtgacacatattaactactcaagaattattacccaaattcctaaatatttcagaaaattaatgggggcttttttgtctgcagtttctctggcaattgatcacctccacttatcattatagtgtggagaacacagacaagcccaatctcctcgcctctgactcggtgcagctgaaatctctttgaacggaactgggctgtggtcatgactgagtgtccatccaccctgatactgtcttgcaaacaaatgaatgttgcaagtgacaaaccgggtgcttctgccctgattctaacactggccctggaaggtttaaaggctgcatgatgctggctgggtcctgggtggaaggtgttgcctttgtatttcttctacttaattgtatgacccaaaggagaagagcagcagattttttttaagccctttcaactagaagtctttattatgtgtggacttctggctaacagccacatagagagcttttcctaatttctttcaaaatatgaggatttaagatggaactaaaagtggggaaggaaagtttagcaaaatctgaagttcagtgaaatctaaaccttttaactaaaacaagttaagtgtttggctcaaatttcccaatgtttgaagcaggagaaagtaattcatgaggaaacatggccaaagagactagggattttatctgacaacagatggttcagattagttcaacaaatatttatcaaggaccatgtatttgcccatcactagacaaagggtgatatgtggataagtggatacaacccttgacttccagaagcttcaaatctgttcaggaaaagaccctaaaataagttgcttcaatacagaattttaaaaatagtaaaattatatcataaatttaaaataacaataaaatatttctcattcacctgctacatgccttccaaatgctttacatgtattaattaatttcatcctcaaaacaacccgtgaggtacatatttcttttattcccacttatgggtgaggaaactgaggcaagatggcacagcttgagaatggcagagctgaggtttgaatgcaggtttggctggctctgtttgtgccttctttctcctctgtacccatgtcctcatccaggagcagggccgctgtgttgaacaacttcaggggccaccgtttgcatcgtaggttacaggctgtggagttgagtactatctagcctatgaagcttgtccagcctagaagatattaagatgggcattaatgtactcatttcatagggttaggtgatacctccaaagtcacatagctaataagtgacagtgctgaggcttggaactgggtctgccacccccatgcatcttggtctttctagactccatgctaggcagctttgctcctcagaagctactatgtgagcacagggataatttagtatggcagcgcggtctgcagaaatggtcagggcaggcactgggaagaaggggcagcttgccctttaaactgtgaattcccaaaggatctccataacctgccctctcagaggctgcagctgtccctgcactcccatgaattcactcttctgcacaaataagctgcttcattcctgtcatcactgcaaagattctatgggaagaaaccagacaaaaagtcagctgaatccaggtttgccaacttcactcacttgctcaacacatgcaccaagaacttactaagtgttgggcgctgttctaagagctgaggatacagtggtgtgcaaggcccttgctttcatgaggcttctatttcagtgcaatatctgctgcctatgtgcccttccacatgtaactcaaacgcttgcctgtcggtcctcccatccgtgaaatggagacagtagtacctgcctcataaagttatggggaggctgaagtgagagaatgaatgtaatgtgcttagcagagacctcacctattacagagacctcaccccttgcaagtggtcaagaaatctcattctgttctccacccacttgccactctacaaaatgcttgcagacagacctgcctttgctgctggctttcctctaggtggcgagtgtacttgtttgctgctttgtaagttcggtggattattccaagaccatttgactagcatgggttaaagcagtaaactggatctccgtgttcctctactttatatacattatgattctgtatatgaaaccataaaactcaggacagatttatacatatgccatgctgcatattttcatagaaatgcttttccaggcacctgtaatacactgatatatgtgagcagtttgctaaagtttatttctcatagatctctcttaaactgcatgtaaagtgacattttatggtttaacttttgttttcatgacacagccccaatttgcatctctgccatagcattcaggacttccctgcttacagcatgtgtatttccctgtccttgaagcatgtcttcgggaagctagttctaaagaccccagtttggcatctttcctgaagaagccaatccttctgtgactgtcttgtggaaatggacttgaattattcacatcccatattcaacttgcttatggggtattcatgcaaagaaagagagtggtctcattcttggtgtggtcacagccctcggcatgacagcggctgtgatatctcattgcccatttcccgagtggtttttgcctggggttaactcagcctttctgacctgtacttccttccatcaagttctgaaacaaaatagaaaagaaagaaatgcacatccaccaagtttcttctatgaggcagactctttatgaagcactttgcagatctataatctcactaaagacctgcacatttggtagtattgaccttattaaaggaaatagttgcagaaagattaaatacattgaccaaggtcgtcacagctaatgaatggtgaagccaggtttcaagttcagatctactgatcacagatctttccgttgcaccaagccctccagcatccaaggcactcaaaggggttctaggtgggcatagtgtaaccttgtcatctccatcttacttataggaagccatttatttgaatggtcattcaacaaacattttattaagtgtatcttatgtgctaggcactgtggtaggtgatgcatgtgagctagctacaactacatatatttaaaaggactccaaaaaacttagttttatatatatatatatatatatatatatatatacacacacatatatgtatatatatatatacatatatgtatatatatatatacatatatgtatatatatatacatatatgtatatatataaaaaactaagtttttatatttatatatatacacacacatatatatacataaatatacacatatatacataaatacatataaagagagacagagatagacagtcagtcagtctcattctgtcacccaggctggaatgcagtggtacaaacacagctcactgcatcctcggcctcctgggctcaagaagtccccctgcttcagtgtcctgagtagctgagaccacaggcatgcaccaccatgtctagctatttgtattattattttagaaacagggtctcgcgattttgccctggctggtcaagaactcctggactcaagtgattctcctgccttgccctcccaaagtactgggattgcaggcatgagccaccatgccctgcccacagcaattttttagtttcaaaaggatttctcacgactgcctccggccactataaatgttttgtaaggaaacactgactcacatagtgactattttcttcctgtgactccagttgtcccaggctcatattgggcacactcagaggaggtgcttgctgaacattttggagtgaatcaatgaatagatgcattcacgacagccctaaagaatatatggcacatgtttgtttgcttatgtgcattctccacaggccagtgctgtgtatctccattgcctgccacagcacctggaacagattggaggcttgctgaatgagtatatgagtcaacagatagttaatatcagaccaatttaggcacaattagaaacaatcatcagatgcatcagaaatatcaccagagtcatgagtgtgagaggagtgaggcacaagcctcaggtgcaaaatttaaggggacaccaaaaaaacttagtaatcaagataaatagcattttaatgcaatatttgaagtattcaagacagaatctgaatggactaagaccaggataagtcaatgagatgcatcaaccaaatgaagagctggatcctgtctctgtttaaaatttttattttttcatcctttcttgcattgattttggcttttaaaaatattgcatgaaaatattacttatctcaatcactgagattttggcacctcttaaattttgtgcccaaggtgaatgcctcaattgccttaacctagccctggctctgtaaagccaatagcagtaactgaaattccttgatgtcagattatatgaaaggtactttgtgcacataaagttgcagaaggtccccaaaaggtctcgtctggaaagtgctgttctgatctctgtttcacagatagggtggctcagacttgaggagacaagtctcaggacacactcctgagttgttacagatgaatcacagaggcacctgagagattgagcttctcagtccccaaggggtgctgtctagaagctttggttacagagacccatggaaggctgcctccaaccagatgaagcctaatgcatttaccccagcatgctgcacaaataccatatcccactgattcctgccattataagaagcaggatgattttatgtaccatgttcctgctgccaagatgacagcaattgtaaggtgctcacaattgtaagatatatcccaacttaagagattttatcatgcaaagaagtgcattttggaattagatgatatgcgttattatcatatcccaagtgaccatgatattgaaaaaagttggggagactgtactcaagggtacactgcaataacagacataacaggattttggcattctccaaatatccagaagtccattcaccacccccaggctgtcaaaagctgctgtgattcctgcaatgagacaaactttaacagaaaagcagaggatgcttaaaaaggagactacttcatttgccttctggagcgatttccctgcaagagggaagattgcagtattagttgtctggttatattattattgggtgggttcagaattttatctacttacaaaattatttggaaccacagattaaggaaagagggctgatgcagtgcagctgatgtgagactcagaatctcttttagttaccagcctctatttaaagaaaatctatgttgagctccagagattccctagctgtcatccagggcgtcataggatggttttgggtttattatataacactaaactgtccatattattccacatcatactgatctgcctacctcatcaggcaactatcagcacacctaattaatttcatcccaaaatattacattaacatttatttagacttgttcacagtgctacattgatccctgtcagccactggcttcctaaccattttagggcatgatcgcaaaacagctgagcctgcctcccatcatgtacttttctaaaacatatctacccagcacagacacaaatcagcccacagcggtagagcaagcgcgacagcattagacttgcatgatttgcttaaaaggcttgaaattctgcctcatgtcatttttatcaaaattccaaatcagatgtagtaaagagtaaaacatcctttttgctggcattcaaaagactatggagagattaatatggaggggcatggcctgaagccagactgcccagctttaaactcagctttgcctcttactatgcctcagtgtcttcacttgtgaaatgaggataataacagttgctacctgttaagattgttatgaggatttccagggctaatacctgtaaagcacttagatcattgtgcaacaaggggcacataagattggctggcatttctgaccataggcagccccagctcagggtttccacactcagacagtcatcagagcttgtctattcacccaaggggtgtgatcctgcagttctgaggctgctgtataaatggatttgcttctcctctcctgctctgacctttccttcttcaacattggatggatgcagttgtcacctggaaggtggttcctgattgataatgatgggcctttaacttattgtgcccagtgcatggcaggcacttgataagtttgggtaaaatcaggcaaaaggccaatgcctcctttgcagacctgtggtatgtctgtaagtgcttccattttctctgctccatggtgaggtatcctctcccttcctcactggaaaaattgttaaagcagcaagctgccctcactgggctctcgagggatcagggagaccagagaccagctgttcacatagatatgtgaattcccttgaatgtcctctaaagcttactgggtagaatgccaatgttagcattcatgtccatgagcatttctcaagggaatatgagaaacttcagatcacgtttgaaatatctaaggtaataaaactaataaaactcattcacagaagccagtcgccctttatttagaatcttcacatatcagagatgatgggcctatatgacagagcgttctgtgcaagaaagaagcccactttttatcctgtcaggaaaagaggtggacaaggagtggaaataaagttataaaaagttatcagagccttaggagaagaaggatctgttcaatgctgagtgcattttgagtatacttttgagttggggaaattggatctgagggaacaaaggggactgtactagttgtttattgatgcataaaaattacgtcaatgctcagtggtttaaaacaatatttagtttcacacagtttctgtggatcaggaatttggaagcagcttcactggggttctggctcaaggttccacaaaagtaaggtctactttcaagatggctcactcacatggccatggcagaaggctcagttcctcaccatggggcctctctgcaggctgctagaatatcttcacgacttgacagccaacttccactggagtgagagatccaagagagagtgagcacagagaaagccgcagtgcctttatatcacagtctttgaagtgatctcctgtgctgatgttctagggctgccatagcaaagtgacacaaactggtggcttaaaacaataaaaaagtattccctgtcacatctggaggtgaaacattcaaaatcaagatgtcagcagagctgtgctccctctgaaggttctaggggaggaatccttccttgcatcttcctcattcctggtggccaccatcaatccttggcattccttggcttgtaaatgcatcattccaatatctgcctccatcttcacatggctgtcttctgtcggtgtatctctttgtctgagagcaccagtcattggattagggccagccataatgacctcatcttaactaattatatctgcaaagaccctatttcttaataaggtcacattctgaggttctgatggacatcaaatttgtgcggtgggtgtgggtgtttctatgcaatccactctacccaccatcatttctgttttgttttattaattagcactaagtcgtaagtccaggccacactcaagaagaggggaattaggctctgcctcttttgtggacatattttgaaactacctcaagcacagtgttacacttccattccagaaacctgttatgctgggactttctagtctcatgtgaggttgtatggctcagtgaaaagagataagaatatttacagacattccatgttatttaatgacaatggatacctagaaaacgctattttaagtgagttatcttaaaatgaaaaccaaaattcatttaaagatgagtgaaaatattttgacttggattttacattgaaaatttatttaaaaattagtatattttacttaaatttgaaaaatatttcaggtaataaatataactattcactaattcttgaaggataaattgtcatgtttcaacttttgttacaatttttctaataaaaattacatgatttcacaacatattctttacttaattttgactttctcaacatcacaaaaagggttattttacaaatttcaagtattttatcaatattccctaattctattgggattcatggcattctcttctggaagcctaaactatcattatccttaaaaatttcctcttcttcaaataagatctagtaatgtttctgtcacatcatcatatcaataattctgcgtgtgattccagcagttcttcaacatcacttttttaaacttcatgaatctcccatttctgggggaaatttaaaaatttaccttataatcaatttacagagcatttttataagactattttataaaaattggtgagagatcagttatgatgttgactaagattccagtggtaagtcgagactgattttgaatggggactgattttttaaggggtcaattcagtgatgactattttcatgctattgtgaatttacttttctgtaaaactttgcaactgtggagactctaatcatgaaaaccaggtaataagaactccctgaatttttctcttctttctacagctacgcttctatcctcctaaagatagcattaaaatctttctatcttctttaatgcaataccaaaaaaagtaataatattagaattactttgaagggaagtatattgctgtagggaaaggttggcatatataattagacactattactaggatctatttgagtcatgaacttcttcactgaagatgagcacacatcatttcagataaccaagagaagatctggtaccttgattccaagggagacttcacgtgggggaaaaaaaatcaaccagcaactggatgattccattttaacctgccctgtagcagaggtctaaaatttgttcttcaaaagtcccatgaagtcttaaaccagtgtgcaaggcaaaaaccagtgtaacaaaaataaatgacaggatgtcttttcttataaatgtcacggtttattcaaaggctgtgtaattagagagttgtcaacttagtaagttttctgagcctaacattagaggcccagccgtgagaagctgtctacctttctttagagaatggctccttcccacagcaacccactccagtccgactttacccattcagaatgtgctagatgcctggagttcctcgctgtcttcaaaaacagattgcttccactgctggagatgtctccacagtttgtttcttctgcagctgtttttctttaaccttcactttagcttgtttctgggtgaattttggctatcacttcagtatctccatcaatcccaacttcaacacattcacaatgaatttttagcaatggagatggtcactgtacttatcatttgcacataacttaataagcctgcatatgtgcattccccttgttcaacttctggaattaacccattctgcatagttcccattctgcacatttttctgcaccagaaatgaatttttagttgtctctcagaagttcatttatgaaaactgaaagccagctgaagatatggggtcaggttgtgttgttccataccatatactgttaactttctcagactaaatgttgccattttcattgatatgactcttactaaaagcaaaaaaaaaaggtttaatatgaaagaaaaataaatgatcagttatacatatttctctgtgtaagtgtatatgtgaaagagagtttcatgccaacgatgccttatcttttacaaggatatgtttccaacaagtaaacctagtgaccgtgacttttcaaaactgcgcatgatgtaacatataatgactgctcactctaaaactgcacacattctgatagtgaacacagagttatctgacatggtgcagtgctcaactcaatctcggtagtgtttaatggataaacaggatatatttttacatttctgcagctgttgctcacaggcagccagttctttagatcttcagattttctctataattgtgtcacgccatccataagcagagttccttgtcccagaatcagtgtatcttcttgagcctgatcctattctaacagcatcctttgtgattgtttttgttttttctctttaaaaaaaataagtgttatatgtagatagtaactgtagctgaccctgttggctatatacttaaaatctgaccttctcttcttcattgatgaagtactgattttgttcaggtaggccctctcagaaaacatgaccctatccctcttgggggacaaattccaaatagtctcagactatcacaggaatcccatactgcttataagtgactgggtttagagctatgcacacagaccttgttcagaccagtgaaatgagaaagtgtcagagcatttatgggaaatagttccttggtcttaaaaagaggcagaaggaaaagacagccccttctcttcctcttgtcattggcatgcctggatatgatgcatggaactgctgatgaagcaaaacttggaaaggaagacagggtcacagtgaagtggagtcagggtcctaatataccctccctggagctttcctgacctgtggacaccttgctctgggagacaataaatcataaatttaagctggttaagtccaggttttctgctctttttgccaaagcggtttgaaaaagtagccaaaataataaatcaacccatactgtgtgctttgcttggagggagtttctgcccatgtttacttggtgattttgaagactaaccaaggtttctttgaagtgaaatgaactctagtccaatttctcttgaaaccttgtacatacatcctgctatttatcctatttattggagtttatttgcaggtttgtcttcccacacttaccttggaaattcccctgtggaggagccagatgtgcaccagaaacactgccatgagcaccagtcagtaaaatgtcactagcaaagaagatgcactcttttgcacactggtttactggggaagatgctgccagagttagagacaatactagtgtcatagctgtgtgtggaggccatgaaaccaggaaaggggactatgaaaattaactatcagtatgtatctacacacagtcacataagatggcaactgtgaatgacatgcggactgaagatggcaactatgaatgaaggcttaagggtggtgtgggagggtgaggtctggacatactgctgtaggaaagggaatggaaggaaccaaaagagctagtctttcttatgggtaaacaaaagggacttggcatataagaaactggttctctccaggaaagcaggatcctgattacctggttgataaaactgaaggccgttaccatctctccctactcccatcacttagccttccagaatattacttcagctctgcttctgagcaagcacatgggtctcatgaaagggactcagctctggtttgctttctgtttcttaaatgataaactgtgagtttgttctccctgaagtctgcctctgttactgctttggtttcaatgctggtctgttttgtttaagatatctgtagccacagccacactttttttcactgtggttttgatatcgtattttcatactcaaaacttcttggccttccgctcatagtcagtttcctagagatgatagcttctccatttgtactttcctctgtacttgtatgatccatgggaatctcagactcaatatattcaaaactgaaatcatcatccttcccatcctcaagctaagacctactctccagagtcaaaaacacaggaaagagtcttaatttctccctccctctatctatcacctaccaactctgtgttattatagatataagaaactatagtacgtgtgtgtgtgtgtgtgtgtgtgtgtgtgtgtgtgtgtattaaaggttgggattgagttcagagttcaagtacattacaaaaatctattgttgggacagaaatgccctaatataatgcaatcagaagtactgcattctgcctttttgtccacatcagatatctaatgaatgcatgtcaattatccagtttgcccagaaaggcaacaaactcagtaaaaacagcatgagctctgtggtaaagcctgagtgtgaaaccctatcttgatccttgctagcagtgtgctctcaaactaaagaaatagcacttagtggggtccgtattaaatacttcacctgcctcaccagtgaggtgggcactatcattatccactttcccaggtgaaaatcctgaggcgtaacatgattagttcaaggtcacacagttaagttatggacccaatattcaaatctagttatgctagactccaaaacaggtatacttaaacactatactctatttactttatgcacatgagcccgagtttttatctgtaaaaggagttgagtatttactttctagcgtaagtgtaaggaataaatgatacaatagaaggaagaaacttgcaacaatgtctgacaccgagtaacactttatctaaatgttagagacccattgctcattgactagcagtgtgttgctgattcctggaattgattttcatgtggattcctctgccagagctatatttgcatctcttccaaagttttctaattttatatttcagtcttctttccatttaggattttggtttattttagttagtcgattataggccaatctctctaccaagctataagcccctccagggtcccctgtcattactttatatgtctagttatcagttcatacctggagcagaatgagtacttacctaatatctgaggaatcaatcaatgaattttttacttcatttctgtttttaactgcctcttctacaaagtagttcctttttttttttttttttttttttttttttgagaaggagtcttgctctgttgctctgtcacccaggctggagtgcagtggtgcgatctgggctcactgcaagctccgcctcccaggttcatgccattctcctgcctcagcctccccagcagctgggactacaggctcatgccaccacgcccggctaatttttttgtattttaagtagagacggggtttcaccgtgttagccaggaaggtctcgatctcctgacctcgtgatccgcccaccttggactcccaaagtgctgggattacaggcatgagccaccgtgcccggccaaggtagtgccttcttaatcacaacattctgcacatggtagggaagcactggatatgttcaaagcctgttgcttcttttgcttaacaatgaacatgcaattgactaaggatggaaaccatgattttatgcatttgtgtctcttccagcaaacattttgtgtagtgcctgccttgtgctaggtactgtgttagacatcaagactacaaatgaaaataaaacaaaatcaatctctgactttggtggtaagcacacgattttgtaggaaagaaaataaaaaatgaaaacaaaatagctttattattcatagagtctataaagggcacaatgatggtagatgagtaggagtgattcaatctttgataggagaagtggagatgagaagggcaggagcagggtcatgggaggtgctggagaactaatctgcaggctcccttgagcataactgtgtgttttccaacgatcttctttgtgtttgagaagtacagggtatgtatatagagatatttgctatgtaaaggggaagggctcttgctttactatgcagtgtctcattgaatttctatggaagttttgataatgcatgaagtcgttccataaaataattgtcagtcttcaaagaaaccaagaaacaaggctcttttcctctgagtgttaactgcattcagcgcctcatggcaattaaagcagtcccatcccctgtagttgagttagtgcacaagccacttcatacatttatttctcaggattgctgaagctacagcagtcctaagaaccacattttcatggaggtggggggttggaggcaaatgtgtgttgatttagaagctactggttccatcaggatcttttctacaatagaaatatgaaatatgccagaacattaagatatcaaggatagatatacaaaagacataggttaatgctgagactcaggcaagatggtttagtagaaatgccctaaattcagaacgcagagccaggaatcttgatttcagtctgtcatttgcttcttctgttgacttagaggtaaatcagctatctccctggggcttagattttttaaatctgttaatgtatatttgtaaaatgaatgaattagtggaagaatgtaagatgaggatcataatacctgcaccacctacttcataagagttttaaacaaggtaattaattacacgttggaaagataaaaggcttcaagacacttgccctccaatttttaaatcagtggtgataaatatcactgtaaggatttcagagtctgagaatgtacaaatgctttcatcatccaaatttgcccttgaccaggagaaatgttaacttgaagagcagatgttatattgcatttttattaggtaattaactgatttgaaactccaaatatctagcctcccatggacctgactcaaaaataaaatttaaaagttaaaaataatggaaagctttcagtagcactgaaataatgacaaataactataataatccctcatataggtatacttggcatatataaaatattttacattttcacatttgatcatgcacaaacaaaaggcactctctgatgaagcagtggttccagctaatgctttcagggaaacattgcatagtgggaaagacaaatgctttggaataaaggaggcctggtttccaatcctgacttgtaccaccaatgtcatttcagataattatttcgtaactctaagccataatttccagacatcagtgaaatgggtctagcctttcatacccaatatcgtaatgtggtcatgagaatcacatgaaattttatgtacttaatccatccatctaatttgccaaaaggtagaccttcagaaatgtcagccctcacgtcatccccactgtaattggtagaagaaggtcctacttttataacaggtaccaggataatgctaaaagaggaggttcatattttctggacaccggacttgcaaaggaaagctgtgcaaaggcccgctaactcagttttgccttcaggatctcttccttggaggatcttcctgaaggcttggagcttacatagcactaacctcaatcttttcactgaccttcccaagttgtgtgtatgtgtgtgcatgtgtgtttgtgtgtgtgtgtgtgtgtgtgtgttgtctgaactcaaatcaatgtatacatattgtttcttatggcattataaatgctcatacaatatttcactcccacatccttctttctccccagccttacaccccctttccctccttcattactccttatgccctgccaagtaaaaccttccaatggaaagaggtaagtatatacactaagaattaaaacgcataacaagctcctttctctctcttatactcaagtatattcctctttggggagtatttactgtacccacaccctccctatcaaacccctccccatcaattgcctccctcctttgtgccatcacagttttataacattcaacatgttatatgcggttatttttttacaagtctcttttcctcatacactgagagatccttaacaaaggtgtccaaatcacttggcctcggcacttcacaaatgttaagcatttgcgaatgcatgaacccatgtctttttcttctctcagagcctttactacctggtggggaagggtgggggctccccacaggcgagtgggggaaagacctgggttacccaagtgccccgtgcctgtgctgtggtacctctgcccttagacagcttggccatggctgcctccatcctgtgagctcactgcaaaggagaaacctgacttctttaccagactgcctttgcctccacgttgggtcctgctacctttctcaaagtgcttttacatagagcacctcaccaaatttacaaaggattcatggggtctttggaagaaagatcacaagaggagtaatgacagtttttcttaagagtgtgtttacctaaaatggcagtgagaaatggagaaccaacctttagcctatagacaggatgccttgctttttggccaagtcaacaaagactgttgtagtcctatttgtgtttgcttctcagtcccttcccagtccatgaatgaaaagtgtgtatggaaacataaacctgcactgacaggtatattgatgatggctgagagtataaatctgttacatcctatttaatttttttttctgttcctccttctctttcctctccttgcccttgggtcttaatcaccatcatcatcaacaccattatcatggctttattccatctcatgcctttattcatgttcttccttccattcctcttctatgtggctaattcttacccttctagctcaaatgtcatcttctctgaccttccttgcaacccttctctgctgcagtagcattttgtctattacactcttatggcactgagcactagcactgcctattaggttggttaagtagctgacttcccacttaaatcaaaggcaggtgttatatgttatttttttataaaacacataaagtacttagagcactgcctggaggcagacaaactcaataactgttaggaattattgttgctggtattaaaccccctcccattgctccatttcttggcaccaaggaggtacaatgtgaatgtttattttgttgaatcgaaagataacaacgcctttcttagaaacctaatttcattttgccttctgctagtttgctttcagtgcctatactgaactcaccatgtagcagaggaggaaagcctgattgctgaatggcagtggcaagccatagatagctgggatgtttaagaagtacagctgtgttgtcagcaggccacagttccaccgctgaagtgccacaaagtaaatcttgactcacaaaatatatgggtcaagggaaagtggtctctcttctcaaccgtatactccaaggcatagcctctactaaaatgccaaccttgctgcctgctgctgaaagcatctgccccaccttgtgtacccagcatgtatcgctctctgtggttaactcttaactcttccagtgggaggggcttagactacctgcaaatgggggctgacatcagtctaggaataaatacctccctgagaagctgatgtccagttgcaagatgtttatctacaacaccattgagcagccggggcacaaggtcagattgcttttgctgcttttttgagaattctctcatattcttcctatatacagctagagtagcagggaagggttggtcccattcccagagcacaacctcacactatatctggccaactcagctcctgggaaccgttgtctgtcagaggaccgaatagaattgtcatactgatcctctgcccataaatttgcccaataaagtctgcttttgcatgacactaggatggttgccattacctctagtccccactaatgagtatctttaattccctcgacaaccatataaagtaagtttaattggcaccttttagcagttgaggaatctggagctcaactaatttcaacaacgtgctcaaggactcacagtaagtggagaagtatgggttcaaagtcacatttgtgtgacactaaagccttattactttgtcacctgcctcatgtggaagcttctgctcctcatggggaagggagatcatgtgctacatgatcctcacagctccttgccagcccaggagcatggagtctgctggcatctctgaacctgcagttaaagagaaagtggaacattagtggctcgattttattatgatcatttggacaacaagcgacttccctttcttctaagtaattgccattgtacagatgatgtctttcaggggcatgaacagagaatctgaggaaggaggcaggtccatgaagagtgtccattcttttcctgttttcccatgaaatcccaaaaagtgctacatgcagttactttatgaattgaagtctgggaaaaatctctaaatcattctcatgcatgcatcatatgttgcttttcaaagggaaaggatatgcattaaagatttgttcagtcttaaacctgcttttgagcatccaagatcaatttgaaggctgattaagttgtgctctatagatttctatagtcaagttcatcaaggcatccattcctcttcccctaatgatgctgaaccccaagttcttctctgaagtgctttaattttcacttggccattgcaaaaagacagtgacttaataaactgtaaataggaaaagaaagttacataaatcatcttcgcatccttttccatggtcgtaccatgactattctttcctcattacagtgcctccagtggcttctccgtacttggcagtggaaattaaattataaaccatattttcagcaatgtgatacaccaataaaaagataaaatcatcaggataaataacaaagatgaatttatgtcaacacagcacaatattattttaccctgtgttaccataattttctcccagctgattctttagatcttttggaagatggttgctttctaatatatatatacatatttcagaactactgtctatcaatgaaaattttacaaaactgacttccaggaaaagactactacacagtacccttttcttatactctgacagacagtcctgcctttcaaaatgataagataatgagtttgtggtttgaacacagctctgtgttttaaaggtagcattgaaaattaaagtgaagtattaattaaagattaatcaaaagtgctagacctctagtaagttcagtgctttttgcttaattctgaatggcccactttgaaagagtatttcaattgagctagaattttaatcagctggctagaagttgggagaacaagaggaataatcctgagggtaaatgtttaaaaatgcatcaaaggctgttggaaaataagctcttaatctgtgtcatgttggagggaaagaatgttgacaagaggacaggatgcattggtttatcctggcctccagggtggtgacattcctgagatccatcagtgagaatggccagccggctcccctttcagaacaagctactctcactaatgctcaagggagaagcctggatacctggaggacttcatcgtcattctcccagcagaggcactaagggaagagcagaggaatctacacctgtgtttggttccagagggcctctttaaattcagcacccctctcagctggaagggcctctccatccattccagaaactcctgtgtggctggtgctgacctgcctgtagctctcatagaattttggatcttagaactgaaaagaacctcagaagcctccacccatacttccctgcctccatttgaagcatggatcacctctataggtgatgtgctgcttgattacctccagtgataggaaactcacttctccccaaggccactcatttcactgttgcgtagcttataccccatgtcctttcttgtgttgttcaaaatttatctccagtaatgtgatccttatcttcaatctctggagactaaacatatatgtgaaattgctgcttcacaagccagtgctgctgatacttaaagaaaatcaccttaaagctcctggtttttctccagataaatcctcgatggtcatcaggcaatctgctactgacattcctgttcagtttccaggtactgaggttgaatgcaaagagcccaggtataactggatgagtgattctgcccaacacttaccagattcttccttcagatccatcatgagcatctttaagcctttgagtcatcacctgtataaaggtgttatgtgagattaaataagctgatgcacataacattgttttgcaacacacctgtaagcacatgtctgaggaaaccctcaccttacacatggtatcaactacctctattctaaaattaccgggttatatacatgtgttgtcagtcaccctccctagaaggactatgtatcagaatactccacactagtcctcctcctcctccttctaaaatagttattgcttatcatgttcaggaattgagtgttactatagcattcagtcttcacaacaatccatgaggcagggctattgctatccccacattacagatgaagaaagagaagtgaggaaacccttgcccaggtggcactgggggtgtggaagagccagattcaaacccaggtctctctgacaatgggttcaactgaaggccctgaagcacctagaagttggcctggggaaaacaggaatgggaatcttctaggaaatctccctcttctaggagcggagtcccattgccagatcttgtcaacgagggagcaagcttggagtgggattttggtaggcatcagttgcctatctagcaaccccttccctcccttctttcttaatagtagaatctgaatgtctttgccccctgtaataaagcatggttggtctaagctaaccatgactatcacattcttccttgtcagatccttttgcaactagcggtgaccttataaccctgtccagtcagtgaaaaataaggtggaaggaaggtctttttctgctgctgctgctgctgctgctgctgctgctgctgctgctgctgctgctgctgctgctgctgctttttcttttctccttggaacaatccattttgaagatgccttcctcttttttgttttccttttcttcttggaaaaataaattgaaaagatgtgctacttggagccattgatagtcttattggtcattgacagtgacctttagacaaccaactttaagataaaaagtaaactcacaaaacatgggaagatagaggctgaatccttactgatactttgagccaccacagcaaccctgaaatcacctattcctgccccatacttcttgtcacatgacaagaatctgaattgcaaacaacagcatccactgtagtcaggaatctgaactgcaaacagcttccactgtggctagttcaaattttaaaaaacaataatttaaaaggatgttaggggacttgcagactctccatgagggccagagagagccaagctttaaaactacagagacaagaacaatgtccaaccatgccatgggaactgtttcaatgcaagcattaccatcagagctattgctctcagctccagttctgcacgtgctggaatgctggaagctctgcttggctccttggaagaagtagcagcctcttccgtgatgaatctcagaatagtgagtgcccacacatggccaccccctcacattgctcactcatgaatccaagtcttacatgggtatattcgattgatataggttggtgcaaaagtaactgcagtttttgccattactttcaatggcaaaaatagaacccaagttcaggcctgtggtctagctgtgaaggagtctgaaaataccagttttctagtctcctgtttttgagcagggaggacttgtaatatgagatttaactaaaatatggggaagatatggagcagccacaaatggcaaatatctactagatgacacaaacacatcatcattccttaagccagtgtcagtcaagtattctgtttcgtgtctctctctcccctctgtcaggtgttaagtaagcagagaggctgcatgttggcctctttgctgaagcagaaatgccagctttctatccctggaacacttgggccctgaccctgcaagctcagggttgtgacagagccatttaatgaggtgaattcctaaagtcattcaagagttgcaactttctggcatcaactgatcataaactcttcatgaataaaaacaatagaaactacaaaacatggaagcatagaattgtaaggctggaatggatctcagaaattgtttgttttttttttaagtccaatactttttctaaatcaggtacatctgagagagagagaaaaagagattgagagagagaacaaaaaggcatccctggtctactgtgcaggaatcttatccattcctacattcagagacttttctgggatcccagtgcactcttcatgctcagtcacctatgtgtaaatactctcttgacttttttcttttttttctttttctttttttttttttttttttttgagatggagtcttgctctgttgccagcctggagtacagtggcgcaatctcagctcactgcaacctctgcctcccgggttcaagcgattctcctgcatcagcctcccaagtagctgggatgacaggcatgcgccaacacacccggctaatttttgtatttttagtagagatggggtttcaccatattggccagaatggtctcgatctcttaacctcgtgatctgcctacctcagtctcccatagtgctaggattacaggcgtgagccaccgcgcccggccttttgagctatttatgtctatattgacccctttctttctgtgggttgggctacttctaaacttcataacaaagtttgaaacaccttatgttctaggaaagaacaagggcttataaatcagcctagcctggactccaatcctgtttgaatgagtccttgattgagcaaacaacttgctcaaaccagtttccttgtttgaaaaactggggtgataattataagcacctcactggactgtatgagaattaaaatgctgctatgctaaagaaggcatctagcacatgcctggcatatactaggtacctaagtaaatgctactttcccttctctttccctttgtggtctttctgcttagagggctgtactgattgtcaattgcatacgtccctcatgactccttttcctaagtattagcatgaagcttttcaacgtagctcctcatggctgccttcatttgcatggcactgtctttgcaagatgtcacaggggtaatcttttgaacccccatggaacacagcctcagcacctcactgttcagtttctgtaacagcttggacaatccatacgtataatgaatctttacagccaccaaagctacggacttggtaaagatttcaaacattttaaaaattaaaggaggaaactgcagggaagctgcaatgggctgcttagaggattccagacacatccatgggggcagtctttgagctgttacccttaggcaaggattggcaaacgtttttctgtaaacaaccaaacagtacatattttaggcatgctctttttttgctctcctttgtttttttgttttatcccttaaaaatatgacaaccattctcagcttgcagggccatacaaacacaggctatgagctggaactgaccttggggggtggtttactgacttaagtaacaaccagacatcttaataaaatcacggaatgaaactcttcacctgtgatgtaatgaaaatagctaacatttagtgagccctggctatgtgccatgcactattttaacataactcttcatatcaatgaggtatttttattattcacatattattaatgagaaaaagacaaaaaagatgaagcaactcaacataaatgtttaccagtaaatctttgaaagatttattccatgaacaaaatgcatttagctatgacagcaccctactggaaagtttgagcataaaaattgttttgttttccatgtttgttgttcttgaagctttgattcctcttggagtgtcttgagttagtttttatatttgtttcaatggtggaatttactgggaggtagtctaaatatgtgggaaagtaaaagtttgggatgccttattttggctataataagtcctaggaattcgttcattcagtaaattttttttttagtatctacccaatgccaagccccacataaaacattaagagtagggacaataatacattaaggtctctgaccccatgaaactcatggtcagaggaggaagatcaacatgtatgcagagaaatgaaagcaatttaacaaatgcttgcatacagttatgtgcacaggagcaggaagaatgggcaagagaatatccagactagctaggacatgtgggagacttcagagagaagactgggtgcagatagatgttctgagtttgaagaggccaaggctgtatataacctccacgaaaaccactgtctgcagtgcccagccataggccacccccttagacctcctaactccctagtcacaagaggctgtgttagtttgtacaacaccagacacagtaacagatgaattctacaatctcagtgactttgtacagtagaaatttatttcttgctcactctaagtccaaacagtggcaatgggaagaggggtgtagtggaagttcatgtattcagagatggaggctgaagaagtggctgccatcttcaatgcaaggtttccaagtttgtcctgggtgttgacatcctgccagcatatgagagaagagaacaaaaaggggagagttttatgggccaggcttgaaggtggtccacattatttctgactacattctgttagccagaactcccatggccaaacctaagtttaaggaaagctgggagatgcagttcattttgtgtacaggaggaaacagaaccaggcttggtaaagagctagccagtctgtgccacagagcctcctcaaccaccaagtactcacagagcccataggatgtgttaactctatgtctaaagatgggactagtaacgattacctgccagcaagagattaatcatctatagctactttaatgcaatcatgaaataaatatatagacactgtgtatgctgttagctagtaaaaggtgtaagagtttgccaaaatatgtccctaaagctctagttctgtgagattttctttccaaaaagtgttcctcaagtaagaaagcttgtaatgtctacatgttatcatattccatcaattctaagaccaacattttttcacattttaacatctttagtgatacattttataataggcttcttacagtttaattgtgtgtgtgtgtatgtgtgtgtgtatgtgtgtgtgtgtgtgtgtgtgcgtgtttctctcctagtggtgcatagtatgcacaaaagcaaatgaaatgctctgagaagtcctgcagattgaaaataaaagggggtggtagtgatatagtctgtttaactttgtgtctcccaaaggtattggaaaataatttttatgtcactactatccattagattgaatgttccatggtattcactttgccaaaactggtaaaaacggtgagagctttgagttcagtgccaggtggagtagctgtctgctgggtccaggtttgctaggaaggcctcataaagaaagtaaaaccttgaggagatgaatcatgagggtcccagtaggaaatgatagcacttattaggagaacttgaggcgagtttggtagagggactgtttgcaaacgtgtgtgcagggtgtagagaaaccacagggagaatgcagtgtccagcactggctgtcactgcctttagctatttgaatgagagggctaggtagagagggctgccttgagggcagcagtgacctcagttgagggacatagccagaccaatgagaccctgagtagggagaggacaatagaataaataccctggcttcttattccttcctcactccagtctcctgccagggcccctcattggccaaacccaactagcagcctgagagtaagggagccactgctgaccctaaaggccggcctcccagaggagaaacaggtgggaaagagtggaggcaggagctaggggtaactctgaatgtccacacaagcagggctctgaaggatgcatggaaaatgaattaagcatgattaaatccacccagggaaaatctggtcaccttccaactgcctcattgcttcatagcttatgaagtcctttcatatcatctttcatttgctgtcacaacagcccgtgaggtacacagagcaggagtaattatccatattttacacaagaagaagctgctttcctcacgttggagctggaaaggtcacgttggaacctgaaggcagaatttcccggaaccaacctggtgcaatttccaccatgtcaatgatgaactttgctgacggtgtcccagaagggtcatctccatgaaaggacgttgtcattagtcacttgctgcttcactttccagtagatagtacacttcagttcttccacgtgtatatagcactttataatttccatccgcagtataaaaaggtcatagaaaatccacagaaacctcaggcctcccaggagctgaaaggccattctactgggcaggccccattcctctgtacccacttcagcaagtagttattaccattgctattttgcacaatgcaaagatgaaatacacacaatgtattaagacagattataagtgcgtagagtgaaagaacaataaagtacgctgagaaaattgagaaattaagtgctatgggcatatgggcatgctaagattgatacagaagtcctatcttggagtatcagggaaggcaactggttcagtctgtccgagccaccgtctatactgcctgttgtgcaacgttcgaatcattttgttgtgtttcctttatcatggaagaggtagcttttatctgagccttagaaaaggcaaaggttaggatgagcaaaaatgggagagagtcataggcaagacactatgtttgtatgtaatgagtatgcaattgaaaacagaaacgtgcaaaagtgaaatatgtgaagtccagttgatgtacatgttgtgtaacaggtttggtgttcctggttcaaaagatggaattctgaagtcagactaactgggttaagtccgtgctctgatgctcactagctgtgtgaccttgggcaagttacttaacctctctgtgcctgctttttcatctataataggcagcacatataaaacagacaaggttcacaccccatagggttcttatgggattacataagttaattcatgagcagtgctgagaagagggcctggtaaagagtatattctacattaataattttaataatgttacaaagatggtcccagcagagttaaaaaaaaaagaaggaaaaaagcatcaaagcctaatttaacttcagcttttgacacagttttcgataatataccttcagcagttttatgcattctttaatcctcttcttttcttacacatgtggacacacagtcaacaggaaaatgcagcgaggctctgattgagctgagaaagcattgttttgacatggctaatgatttccatttttgttcctattagattagattggcagacttacgcttcctcttgctagattcagctctttcatttttgttttccactcatgatcactaaataataaagaaaatgcaacaaaatgatccgaaagttaaacagcaggcagtatagacagtggtactaacaaaccgaaccagcggctagccagcaccgctgccaaggccacgcctgcaaatggccattgcttagtaaagtgaggaagtcagaatttatgaagcaacagtgagagatgtcacacagtggtatatgatcagtccaccatagtttaagaatatagataaaacacacaaacgtgcacatatttcaagaggccgatatcccaaagtctaggagcagttgcccaaaggcctggagggaggaaatgcccaaagaataaaagattcaacgcataactatgattagagtgcagggctggggtcagggtgttatcgttttaaacaaggatgagatcagtgctggtctgagccatattgaagtctgaggcaaaagggaaaaatcaataagactgatcttgcctttatttaaagttttaaagttttgttcatcctagggtttttggcattaaaacttctgaatttttaagtacattacaagttattttaagcacgttgcaagttatttattttaagtacattacaatgttatttattttgattattgaatgttggtgccttttgaaattgtgcagggagatgggtgcctctcttccccacaccagccaatccctggccctgctagagtgtaaactacctgaagggatgtattaaatgagatctttgaactcatctggcacaagcttaaatcctggctcagatctgatcccagccacatcctgaatacgttaccatgggtaatttatctcctttttaaacgtttggtttatttctcagtaaaagagccatgaaacctaactcatatgttcattcatctaccaacaaatatttattgagcacctattatgttattgaggcataggcaatataagttaacaaaacaaaacatctctattgttatgatgttttcatcttagtttgagagagcaatgatcagtaaaaataatatgaaatatcatgtagcctagttatggtaaatgcttagaagaaaaataaaccagggtggagtgacagtgatggcagcagagaggggtaagaaagaaggacaagctttgagaaaggttataaagaggaataagtgagacagttatgtctaatgtgtcacaatgcctaacatagcctaattacttaataaatgatttatgttgctctagctagaaaaagaaaagtttggaatgacaggttgggacccacagacatggctatgctgctacctatgaagctgaaactccagaactctgggcagttctaacaattctaccactaagagcactaactgcacagacacagtgttcaagtcttaagagttgtcatcatccactggttcagctgtgggagcatgaaggtctctggctctgagacctggaaaatggagtaatcagaaaagttccaccctgttctccctctacagtgagcacaactaggcttcatcctgttccttcccgagagaacagaggagaacccagatatgcagaagagagtaaaaatgatgggcagaactggaaagcagccccttggcagttggtatccaaagtgaacatgattcctttccaaagcagcgtccaaccacgagtagaggacaccagcaaagccgtcgcccttggctggaactggagggctgctccttactctgaactgcagtgacttgagtgcatacacccaccgtggcttcctggagtctgctgatctgtcctggcccagccatgtggccctttgctgaggttctgatgtgaccgcctgggcatttcgctaactcctttcctggctgttggctttcagcacagcaacatgtaaagaaaggaaagatccctcttcttcatctggactttcgatgtctgttaaaaatcagagaaaacacaaaaaggaaaacaaaagtaaaataagtaaataaataaagcgctgcccaggttagaaaaggcagggcttggggaaatgtttaaaatctctctgttgataaaacctctagtggattattaagcagcaaaagtgggtgggggagggcagttgagtaaggctgtgtctcctccttaggccattgtagaaggattctggctgtcattccatctagaagcaccaaaaatttcacaaatgaatcatgacctttcattcgtttgagtcttctcacatgatatttggaccccccatcaaataccttcttccctccttttctgcctgcctaacacctttcaattcttcaaaacctagagcagatttccaagagggacccatgaccaagtccagttagatgcccccttttatgtgtctctagtgcaccatgctacacattcttcctacttacatttattgagtacctactatgtgccagacactgttacagttactagaaatactgaaccaaaccagattccattctaatggagtgaaggacagtaaacacctaaacaatttatatatgtccagaaaaattaagcaggagagtagtaataatgggagaatgcaggtagtaataatgagtgagtgtggtcaaggatggtttttttgttttttgtttgtttttttgtttttgtttttgtttttgttttgtttttttgagacaaagtcttgctctgtcacccaggctggagtgcagtggtggatcctggctcatgcaacctctccctcccagttcgagctattctcgtgtctcagcctcctgagtagctgggattacaggcacacgccaccacacccagctaatttttgtattattagtagagacagagttttcaatgttggccaggctagttgtggtgacctcaggtgatctgcctgcctcagcctcccaaactgcttggattacaggtgtgagccaccacacctggccaaggatggggtttttaatatgagatatgagcaaaggcctaaagaaagtgagggatgatctatgtgtatatctgtagaaaggatagtctaggccaggattggtgtcaaagtctctgtaaaaactctcaggtgagtgtgtgctggaagtcatcagggccaagcaaggaggctgatgtgtgtgggctgggctggaaaggggtgaccacaggtcatactagtatgcccattttacaaatgagaaaattgaagctcaagaatctagagccaattgccaaaggtcacagccaatagataacagaatcgggagtcaaacttaggtcttctgactctaagctctgtgcttttctgccctattaaagtagcttggtattaagtagtcttcaggtataagtggaaggtagagagcagagagtatccaggaccagattatccagaaccttgtgaggacttcagattttacactgagtgaaatgagaagccactgaggagctctgagcagaggagtgacatgttctgacttcagtttttacaagttcttcctgacccctggatgtagactagactggatgggagtgaatgtaaaagcaggaaagccaattaggaggctattcaaattagttctggggagagctggtaatcatttggaccaagggagcagctgcggggagacgacaaatgatcagattcatgatgtatttgagagtaaagctggcatgatttgcagatagatggactgcaagatataagagaaactgaggagtcagtgatgattccaaggtttagtggatggtcgttcaatattgactttccctctttccacctgtccatggcacttggcctacttcaaggtggttagggattcacctgtctctatttcctttttaactgtgggctcccatgaagggaaggagctttttcatttggtttcatctacccagcatctagcacctgaatatccagcacttagcatctagtacctggcattgcacaataaatattgggagggagggagggagggaagggaggaaggaaaggaaggaaggaaggaagggagggagggagggaggaaggaagggagagagggagggagggagggagggagggagggagggagggaggaattaagggagggagggagcatggatctttgaagaaattaatcagctacagctcttctactaaggagttccacctggggtaacaatcctcaagatttctactggatttgctatccaaaataaatcactgctcagttattctaccaaaaagaaacacttctgcatccagtttgtggtaagaataataactgatgtacaagttagatgcaatgtattatctaacataaccctcacactaattctgggacgtgctctaaatgagtagatactagtatgcccattttacaaatgagaaaattgaagctcaagaatctagagccaattgccaaaggtcacagccaatagataacagaatcgggagtcaaacttaggtcttctgactctaagctctgtgcttttctgccctattaaagtagcttggtattaagtagtcttcaggtataagtggaaattttcaaatatgattcagaatacaggaaatgggtttgtgcgtcagagatttcatctagacatgagaaagaactttctcaataaaaagactatctgatagaaagagagaacaggttcaaactaggagcttaactttgtacaggaaaatcggcgggcgggggggggggggtaggggaatccccaggtttataaaacaagttcattgccttcagaagattataccccatgagtcatccgacaaacattgactgaatacccactgtgtgtcagttggggaggttcactgtacatgcacaagaaaagaacgcattggagtgggaaattgtgtaggtgcaaacaacattctaagaactcacagttgaagggggtattacctgggggggggggggcggcgctcaggttcatgttctggagtcagacttcttgggttcaaattctggcaacttgcaagctgtggaacttgggacaagtcatttaacctctctgtgcctcatctacattacaggaacaatggcagtaacagcctcatcaggttcttataatgattaagtgagaaaatgtatatgggaactcagcacagagtaaaccctcaaacaaggacagacagagacagagacaaagggagagacagagagggggataaacaaagaggaacaggcagacagagacagagaaatcgagaaacagagggagagaaagacagagacagagagcatacatttcccagtagggagcaggatttgagtagagctctggaggctgagtctggaggcaacaggaagagaggggagagttattcactggactggaagcccctccgtgttctaggctctggcccagctggaaagagaatcccacctgcactacttcctcttagaagaaatatgagcacaggctttggggccttgggaaactgctggaaagttactttatttttaggctgcaaatctgctaggtgacttcagaaggtgaccacatttcagttccattagctcatcagcagtttcttaatgaggctaattagccccaaacagctcccatccctgcagggctctgccaagagcttggttttgtgtaagccagcgagcctgtgacctctgtcagtggctaagaggcctgtttcctgggcataatttcatcaaagcttaatgcttcaagacatctcatagtaagggtttgtggtgccatggatctcgggagccaccaaggtgaggatcagctctgtggccaggaaggaggctgccccaagtgcagattaaatcaagtggccaataccaacgcttgaccagaaagaaggcatccacaagagatctaactcaggaagtttaaagtgtatatggatggtttcctcagtacccacacttgctgacaccagcacacaaaataaatacatatttaaattcacatttagtaattccaagcaagagacctaaactagcagtgattttctaagatgctgtttttctcaattataaaactgggcagatagccatggttgcttatgacttgtttttttagcatcctttttatggacctcaggatgatacatcacagcctctttcctgccccatgagtaaattgtacaaaggaggcttttgatgtgggagccttatgttgggcagctaaaacagtaactatgataacagctgcatttatagtgttactacatgccagggacttcattacatgctttatccacatcatcttacttaacctcttgacacccgtgaggtaagggctattattattcttgttttacacatggagaagctaagaatctgcaggagggaaataaaagagcccaatatcccatggtttgtcagtggcagaggcaccatggaaacccaggtctttctgaagccaaagctggtgaatttaatgttgcacatctaccctgaaagaaaaggaacacattaggtgtgacttctgcactcagagaaccatcatcacgaaagcgatccctccttcaggagtcagtgaagtagtgtggagaacacagggccctaggaaccaaggatcagagttctagtctcagctcatacttcctaggaggcacaaagcaaatccttttgcctccctagatgcttgtttcttcaacagctaaaagaagggttggtttagaaagatgtaatgccagcgttggaagggcatttaggacatcattctacgatgtgctgcggtaatacaagcaaataagatatacttaaataaaaagagtcagatgctaattttggcagctgtcagttttgtgaatattgcaaagaaaaataactttcttttagtgcagacttaaaaaagaaagatttactcagctaacttatttcctttcttatttaaatgagttcccaattacaaagtgaggtaagataaggattacaattctgtcgtgacagttgaatggagtgaggctcagagaggttaagtgacttacttaggatcacacagcaattcaacagcagagataaacaagggttgacttgtatcacttgaaagaccattctggcagcagccttgtcacagctatacttggcaaacacatacactacacaaaggcagtcagatgatgatactaacagcagtgaaaatgatggagaaagcaatgttgggttgtatagactgctggacatggaatcaagctaggttacaattccagctctgccacttactaattacaccacggtgggcaaattctttgactatgcttgtctttatatggtagtttccttcctatattcccttaacccctctgtgactcagtttccttatctgtagactgggcgtgagcatatcttctgcactgctacctaccgatatgaagggatgtaccactgcaaagatatgggacaaaccagctttggtcttctgccccatgcatgccttctagatctgaggatgtcggcctacctcatcaaaggaaacaaacccatgtatgcatcgatacagttaactagttcaagcaagtgacaaaggggctacaggttctggctttaaattcagttggcccagtgttcgtaggtggcaggcatgctgtgtgttcccttgtgcccagcttcaggcatcccactgagcctgaggagggtagcatcctcccaggctttttatctgcataaagagtctgccatgcatccctccccaccatcacttacaggagaaaagtaaggcctagggcagaggttggcaaactttctcttaaagagacaaatattttagacttgcagatcataggatctctgtctcaactactcaactctgctatgaaagcaggcacagacaatatgtaaaccaatgggtgtggctgcattccagtgaaactttatttacaaaaacatgtggatggtagtttgttgacctctggcttggggaaaaagcagccccacttgatgatccataaaaaacccttcatctgttgtgcatttccataccagttctcccatttactcctcccagccatcctgtgtggataagattctttctaagagcaagtttggaagccaaagctcagaacaattaaagggtttggcaaggttaattacagccagtcaggatgggctaatggctttaacaaacatctccaatatctcagtagataacacaagaaaggcttattccttgcttatactatagcccaatgtgggatgacaggactttggtggaagggaggactctgctccatgcagtcatccaggaaccaagctccttccaccaagagcagcaactcaatatttttgtgccgtggtcctctttgacagtctggtgtggctatggacccttctctgaataatgtttgtaattgaataaaatatacaacaaatttgtaatatggtaatatgtgtgcttctgtatcaatgcattataaaacaagatctttcagctgctccaataactgctataattacaaagtagtgatgagtaaaaataatattttgagatagttgatgtaataagtatttctgatttgtattagaaaattagttgtggataccaataacactacaatagttggtgcttacattcataatgaaaaaaatgctttcaattagaggttagtgacaataaagaggccatttttcatggaaagcagtttggaggttcctccaaaaaactaaaaacagagctaccatatgatccagcaatcccactgctgggtatatacccaaaagaaaggaagtcagtatattgaagaaatatctggactcccatatctattgcagcactgttcacaatagctaagatttggagcaacctaagtgtccatcagcagatgactggataaagaaaatgtggcacacatacatagtgtagtactattcagccatgaaaaataatgcagtcctgtcaattgcaccaacatggatggaatggaagatcattatgtgaggtgaaataagtcaggcacagacaaacattgcatgtcctcacttatttgtgtgatctaaaagtcaaaacaattaaactcagagagtaaaagagtgattaccagaagctggaaagggtagcagggggccggggggaggtggagatggttaatgggtacaaaaaaattagaaagaatgaacaagatctactatttgatagcacaacagggtaactttggtcaataaaaatttaattgtatacattaaaataactacaagagtgtagttgggttgtttgtaacacaaaggataaatgtttgaggaggtggatacgccattctccatgatgtgcttatttcacattgcaagcctgtatcaaaacatctcgtgtatcccattatatttatatatttttatacacacacacacacacacactgtgtacctgcaaaacttaaaaataaatttttaaagaggacattttttctctctcaaattccagtatccactgacctcttggggatctagggacttaagtttaagaactcctgattcattatctcagtcagatttcagaattctcccctggattttaccggcagatggtaaaaaggagcatggatggaaggtctcatggatggcttaggggcctgatcatttcacctgcagctcactgccaggcactaagtgacaggactctaccaatccatggtaagaggcagggaggagttcactgtatgaattttatctgtaccaggaattagaggagaactatgtggcagtgagccccagaagtctttctcactctggtgaagcagggcttgaacactgactctcaggcaacggaacaatgctgtcttcagtaatccaagctgcctcaataattggacacgcaacccaaaccatctcacttcctttagtccagggtttcttcacatcagcacttttgataattgtgcaggataattctttgttgtagaaggctttcccttgtaccatagggcattcatcatcatccctggcctctgcttactagatgccagtagcacccacctggggtgacagccaaaaatgtccccagatactttcaaacgtccccaggcaggaggcgggggtggagctgcttctagatgagcactgctgttttagtctctttacctaattgttggtgtttagtactgtctctggaatgttcaacgcaactcagaaagaaaagccaacaagacaccagaaatttcactacacctttccctgaactcccacccctgtacctttggccggatgtttaagagagacaagagagaatctgggccagctacacagtgatgtgaaatttgctcagtacaggtaacttagcatttcattggcaacaagtggaatttaatgggggttggagtggttgcccagctccactgagcaaaaacagctaggaaactgaacaaaaaaggttgttaaatttgttatggacagagggctgtaaaatgtttcacattgactcagaaacagaagaactggttttgccaggcacatgaccttgatcaaattgcttagtcttgattatactaagggttccatggaacaggagcaccagaaaacctagttttatgaaatattaataggtgttcagagaaagcagtttctctttcatggttatatgtttcagcaaacatatttaaacaaaattaagcaggtttccttaccgcaggacttacaacagcctttaatttgccttgcccttttttctaagtaggcaacatagcatttcccactcgtacatttcttcatagagtatcttgagggactaatattttcccaaaacacattttatataaaatgcctctggagcctctaggcctcaatttcttcacactcccactggagtagtaacatttgccttagcgaccttccagagctgttggaagaagagattaagaagacacttgagaaagtgctttgtaaactctgaagagttataaaagtttaagaggtcattattaatgcatatttattaataatttaatactaataaaattttgcccaccttacttcaatgttgagttaatgaatgtgacaattgaagtaactgaggccccaagaggttaaggtcttgccgaagatcatgcagctagaaatgaagtcacagaccagattaattaaaatgacaaataccaaagcactctgagctctggaaaagcactctctgcaatgtcagtgggttctgtccttggcatggttatgattttgactgtagcaggaaacaaggcagtagaaaattaaacagtggcataagccacctgagagcttggaaacattgaagaaagagtgctagatttagggtcagagctaggcttgagccctctgcatttgacttgaccttttgagcctttattctcctatctacaaagtaggaattttttttataatacctgcttcccatgagtggttggaaaagccggtatatcctatgggacattaggattctagtgtgggagtggagccattcggaggggaaagctttcaccctcactgtgtaattgcacacagctttatcgagaatccactaaagctccagctctctctcatgggcaggtcccttcacagaaggcaagagaagcaggtggaatgatcctagaccttcaggtgaaacatgcaaacaaccatggaaaataacactgaccttagggtcacctgagagtgagttactggagttctgaacaggtcctgatcatctgaaagtgctccatgggggaggaggggcatgtgctgaccacttcttatttcacatgtaagcacaggcgtggccccttacagcagcctgggtgaatggggcaggccagcgcctgatggaagccaacggatttatgccaagactgcagcaatttaaaaacctgcaccgtaggtgtgcagtactgaagctccacgttctgatataatggcacaattatgtctcagcattgatgcagtgctttatgcttttgaagtgttttacaaccattaattacctggactattaatgtgccagataccatcactagaggaagctgcttccttcagagcacagtgcttttgttcctctcctggtggtataatttttaatctgttatctatgaccctcttttctattcaccttgtgctttttctgttcactctgtgcttcttctattatccgatttagtccaagtgaaattttaatgccaattgaactttttaaagtaaataaataacctgatcatgtgtatttctaaacagaccctgacataaaaggaaggctcacctattgtgactgttctcttagttgaaaatggggagctatttgggagatggttaagcaggtcccctcatcctgatggctctcatcagtactccaagagtgctgtcagcaatcctcccctgagctatttcttgcctttccttgtactcaagccatagacaggcaatcagcctgagagcaggtgggactcaggacagcattacaaaaggatatctcagtgcccaaagataggactccttagacaaagaaaatctgatgcttatactttttataccagagggcaggagaagagtttagataattaatttccttctccatcaattaccttatcacctaaacatttcttgaatccatccagagatctccagctttgctctcaatatcttcttcaaggcctcaacatccatggattagtgtagccagtggggtgctagtaaatgtttaccaatcaactggagaaagcacagcagaagccttggtttgtagtgtttgccaatttcagtggtgtaaatattttcactatggtgaatttcacagcaacatgatgacactaaacatgggattggaaacagatgcacagtaggacaccattttatgctatctctaccatatagatgcaaccaatgctaatgtactccagaaaaaaacgtaaaattatgaaaagaattagtaaacgtattaccgttgtttttaatatctttaaatgtcttcaattataagtttatataacttaatttgtagtagtgctaggtttaatacttggcttgcaaaattcctaaaaatttggcaatcagcatgagctggtacaggtgggcttccgcatattagtgactgcagcaaccttttagcggtgccattgccttccagacaaaggcaggaacacatctgctgttgaacaggttgagtgtattgctgtttctatgagggacaatgcatagtgtgagatatcatgaggcatatcagcaagaggtgctaggagggacttacaggattcagatttagatactttggaggacagttcaaggaagcagggcttcactctggactgtgtgctgtcaggaaatggggctagttctaagattgcatatcctagtaaatcttatctacacagctggaagaatgcagcagggttaaaactgtaattagtaaaccattactaataaatcatagtaaatcatgctactataaagacacatgcacacatatgtttattgcggcactattcacaatagcaaagacttggaaccaacccaaatgtccatcaatgatagactggattaagaaaatgtggcacatatacaccatggaatactatgcagccatacaaaaggatgagttcatgtccttttcagggacatgaatgaagctggaaaccatcattctcagcaagctatcacaaggacagagaactaaacaccacatgttctcactcataggtggaaactgaacaatgagattacttggacacagggtggggaacatcacacactggggcctgtcgggagggggctggagtagggatagcattaggagaaatacctaatgtaaatgatgagttgatgggtacagcaaaccaacatgacacatgtatacctatgtatcaaacctgcacgttgtgcacatgtaccctagaacttaaagtataataaaaaaatcagccactcatattagccaagaaaggggactgtttggtcatttttatagtgtggatgatgttcatgctttttgtttgcattcagaattttttttttttttttttcgagatggagtctgtcatccaggctggagtgcagtggcacaaccttggctcactgcaacctctccctcctgggttccagcgattctccgacctcagcctcccgactagctgggattacaggcacccaccaccatgcccggctaatttttgtattttcagtacagacgtggtttcgccatgttggccaggctggtctcaaactcctgacctcaggtaatctgccatgctgggattacaggcgtaagccactgtgcccaacctgtgttcagaaattattatagggtgatcttgttttttgacttgacccattggaattgcagtggccttgtctggtgtggttggagaaaatatttattttgatcaagcaagcatcaagtcctggctgatagtcccagcccagctcctggagggtaaggggccactttttctcaacagggaacctcatccccaatcttgtgtcaccctaatgtgtctttccatactgctgaatttttttaaatgctgatttgatcatgtcatatctccacttacaaactctccaattgatctcctttgtccttcaaataaaatggaagcttccggggcttcttcttgagctgcatctttaggcaagtcctgcctgacacttcccagctcctctgcatagcacgtttcaccaccattgtctgcctgtgccttggaatgcccttcctctcttccctcagccctctcgctcttgccctgattccatacagaacttgctcatactttaaggcccatctcactgccaccttctgcaggaagccttctctgacatccatgccccattcctgtccaggctagaaacccttcttggtgctccaaaaaaatcacttaattaactcaataaatatttagtgaatgttttctttttcaagctttgtttgaggatctaagaattcagctagaaatcagacagacatggttcctgctttcttggattttatattctaatgaaaagagataagcaatcacttttgtttaaaagtgacaaactgagaaacataaccaatgttgatcaatattctgtatagatttaagattggggtctatgggaaatgactggatgactactacagaccgggtctttctgcagaggtgacaatttgaggctgaaagctaaatgacagcattctgtcccatgttttggcctcatgatctgattatggacccatttcccttccaagatggatgatggcttatatgtatcacttcattccttgcccccaaccaaatatagatgtttaatgaatatctgaggaatcaaaggccagctctttgtcattccttattgcagcccctgcattatatttgacataattcactggactcagttgtgattcactgaaggaaaatcacccccaacctcaacccagcacatccttcccttctgcaccccagcaccatgatcatggggtcattctcacctgcctgctgttaatatcttccccgatatgtccacatatctaaatcttacccactataaagcccagtgaggtcctccattgttcaggaaagctttgccagctactgaggagtttgtcagtcctgcagcatccgtcgtctgtatcatatgatggtcctcgataccaggatgttgcagagaagctgctggatgtgctacaaagagcatgttagtaaagcccaagagatcttaatttaaatcctggctctagcactgtccttctgtgggacagagacaagtcatttaacctttctgaatctgttttttgcatctcttctgtgggcaagcttccttgagataaagggctatacttttcttaggtataataattttggtataaatgacatatagccacaatgttggtatgttacttatctttgtaaccccagcattgaacacagtgcctgacacataataggtgtttagaaatgtctgtggaataaatgaatgggaatgatcacatctaccttcatcagggagtgtttatgagaaaactgatttcaagggtctaataagcaataggtcaaaataaactgttttcattcttacattagcctctattttttccctatcacttttgttccttttatttgcatcattgtattttttttttttatttaggtctcatagtgctatgagaagatctagatgccaagtcagggcttaataaacttcagtttactgatttaaagctataaagttattagtaatatgagaaactcaatagctttgaaaaacagaatacatttagaaaggaagccttaaagatattgaaaatgaattttgtttgtcttcaaagatgtcatttttgaaattataaatatagtgcatattctttaaagtaaatttgggaaatacagaaaagtaggaaaataacaatatactctagttctcctacctaaacgtaatcattgttgacatttagtatactttacttttagacatgtgtaattttgcttagttgagacatgctatatggacaattttgctcgctttttccacttacaatattataggcactttccaagctattgttgtattttaatggctgcattatattccatctagcagatgcattatagttcacttgagcctttcctgtcattggtcatttatttgctttctattagcttctattgtaaataatagcagtaagcttttctagggacaaggagtcttgccctaaaacaaaacaaaatcaaaagttcaagaaacagagatgcagatgtacatttgaaattgcctgtagaacttttggatgggtaaacaagaaaaaggaaaaaaagctatacgtactgctaaaaggaaaataaaatttcttagatccaaactctattggtataggttgaaaagtcagagaaagaggatttcagaagttaattaggaaataacaagcaaattgagtaaattgcctaatttaaacccattagataaacatttattgcaatacaaaatcttgatgactgtaattaacacatttataaactctctaagaaactttaaaacctttcttcaattgactgaaaaccagcagctttttcaagcagagcttatggctaggctgacatgttccctgggctgtgagattggtcagcaaattccctaagcctaatattcttaaacctggtcttacctctcagatctgtagtgagaacaatgggatatgacagtggaaactttatttttcattcattacatctattgaggtataacttgcatttagaaatgcacacagatcttaagaggatatattggcagatttttatccatgttgatacccctatgttacctccaccagatccagacacagaacattcccagcaccctgcaaggttccactaatgttccccatcagccatagccgctggcactattaagacctcaatcactattttgcctgttcttgaatttcacataagtgaaatcatgtagtctggactctttttttgtctgacttcttttgcacatcattgtatctgttaagatttacccatgtttgttttgtgaagcagtagttcattctttttcactgctgtgtaatattccatgttgtcaccataccgcaatgtaagcactcattctaccacttaggaaggtttttgttatttctattttgcgctattattaaaaaaggtggcatgaacatttttatgtcttttggtggacaacagatataagcatttaagtgttctacaaattagtggtgagaaaacagatctaagagctagaggacctaagttcttgttggagttctgccatttcctagttgtgtgattttagacaaatcatttcatgtcactggttctaaatttccttaacaataaaatgaataagggcttttcactctgagaatgcatggccttctgactaaatacctgtgtaacctgaaagaaagtcctttcatttctgtgggcctcagtttcattatctataaaataaagcagcgaaagcaaatgctctccagggtctcctccagctgcaaattccatgcttcagaagcgttcaccatggtgtgcctcctagagacaaccattgctttctacagggaaatgcccaagtgtcccagacgtggcatttctttccaagagccactagccaacaaaagaacttggaagcagaaggcacaggtttgcatctcaactaataccttagacatgcactttaatctgccttggttttctcatctgtaaaatggggataatgaaatttgactttcttcccttcaagcctgttacatgatcccctgctccttagcttccttcaacaagaccacagtcactctcaagggaactcttactatcttgttaaaccaggtactagccagcaccacataacataatgcctgttatcttataggtgctcagcaacaatttccccaatgaaggaaagtgctttgaatactatacattattatcacacattatattccttgtgctgatggaattcagtctcaaggtagattcatgtatgcaacatgaaattatgcattgcctattttgtacattaaattatgcttcttgttgtggggattcaaaacataaagcatggtcttgatccttgaagagatgcatcattcaattcaacaaacatttatttcctgaacacctgttactgtaccaggcatagtgccaagtgctagaaatagaaggaaaaacaacatataattcttttttctttctcatttttatttgtttattgtatttcccattaatttacttgttcagtgagatgtttttccccatgcaatccaccaaacgagttgatagcctatgatagacatgtaaacagattattaacgattgcatataattgttggtttaatgaaagtgtaaattgagctctatggaagcaaaagtaggaacactgagaaagcctcccaaaatgggtcacatttaatcaggccttaaagaatgaactgaattcagccacatagaactagtcttctaactgaccttcctgcttccctctttctcctccctctaatatagtctctacaaaactgctcaattctttaaatgaggattgaggtatgtcacactgctatgtaaaaccccttagtgatctcccaatgctcctgggagaaaactcaagctcctcaccataccacaaagctctgaaggttctggaccctgactcttgctctactctcacccttgctcattaagtgcagcggcctcctttctgctcctgggccaagctctttccttcctccaagccctagcctttgctatgccctctgccagagggctcttctacacactgtttgcacagctggtttgttctcatccttcagatctaacttcaccactgtcttcctcatttgctcagtcataaaggtcctcaatccagactacaccaaaaactccctggggaatgaattgtctagaaaaggcaaatctatagaaagaagatcagtggttgcccaggggtgggagtggggagttactgtaaatgggtgggaggaagctttttgggtgatggaaatgttctaaaactgaactatggagatggttgcacaattctgcaatttactaaaaactgtcgaattgtacacttacagtgggtgaattttatggtatgtaaattattcttcaataaaactgtttttaaaaatgttcttggggagtttttaaaatactagaacttggacctcattcccagaaattctgatttgattgatctgagaatggggcccaggcacccataagtttggaagttctccaaaggattctgatgtatagccacagctgagaaccactgccttatcttgtcaccctggttattgccttcacagcactgtaattgtcttcgttactcaattgtttactcagtatttgtccttctcaggaattataataaaatctcccttaagggagagacttttactcaatcacctttgaatccccaatcgctagcacacagtagctgcataatatgtttattaagttaatgaatagaatagtggaagatggaaggaaagccctcactaaggcacagaaacatgaaagaacatggcatgttaacatggcatgcttgccaaacaactgcccagagtggcaaacgtagctggaactaagatgtttctgtgaaaatcatgcagacagtgctgaaagggaccgctgagaccaggcgtcccagcaagacagtcacataaccctgcaaggcaatgtggaaagacctcagactcaggaaatgcaggtgccccacagaggagcccagcaatatggaatggaaagttcaggaaaagtactgtctctcccttccctagttctccaccctcaaagtgggaaaatttgcaattaaggaacttaagaccttctggcaaaaagagggttaaagaaagtgctataaatctatgctttaaaacccttatggttgattttgcattctctaaggtaataaaacaaagacaagttactaaataataaaatataaatagcatcacatacgtatttaattagtaaaaatgagctagaaagttttcaggccccctcctccattttcagtgggatgtgtgtaactttatttctcctggaaaagcacattcatttgttctctttggtgctctattcaagctgcaagagtgaaaatggaaactaaggcagagtcttagtgaagactgggagtctatattaatagaaacagagacttatttcaataaggggaaaacaaaatgtctgacctgaagtcaaaagttgaccatgaatgagatacagggagcagtttcaaaagagaagacccaataaataaaaggagagtctagtctgagaggatcttgtggggagagcaaggtaagcaagatgggatggaacttgctcagagctcagtaagcgagcagcattctgtgaagaggatgaaagagaagcattggaaacaaatgcggacagtgataggtcaaaatttatgaatgattggctaattttgtgtggcaggtgttatcaatgactttcttttcttgttctcttttttcctccagattaatttatagaaatttgtattttttaataggcttgacattgaaggagataagtttagaaagcacaaagattgttaaaaatcatcatagataggactaatttaccatttaaatatgtgccaggcaccattctataaactgtataataaataatttattatgcacagtgactctatgagatggacactaattaatatgaagaaactgggggatagagaggtttagcaacttggtcaagatcacacggccagtgagtatccaagtcataccatgaaccaaatagctcagctcctgggcctatgcacttaactactacacaattcatacgaaatacaacgtagaagaaagactctttgattatcattgctttgcctgctttttcttctctgacaaaaggaaagatgctcgattccttgcagctcagtaacttacaggttcactgcggtgaaagtgaaaaccattgaaaagtaaatttaattagttcgctggtaattattgtctgactaaattatactttaaaatttaatattccaatcaccacttaattagcaaactgagtcgtagaggatagccttatgctcctaaactgactaaagctggaacttaaaaatcagcattgtacacatttctccttttcctaaaatgtagtgtttctttgcttattccttcacaccacccaaaaaaggtagaaataaaccaacagttttccatgatttcaaaataggcagacatttttttggtggctatattagattgcaagtctaggagagagactgagaagccgggatttggagagaagagggagtaaggagaaagtgtagtctccagctgaggcctggaatgtaggaatgcaggagcgggagatgctgtgggcagagctgtccagtcctgctgctactttgggacagtaaaggctcaggaaaaggaggccccatcgcaggaggatggaaggtagggccacttctgctacagtaatcgctaggcagaaaaccccatccttatcagcttctcaaggcagaaaccccaaacccatctccttgaacagccttcctgcaagatgatcctagttgcgcacaaatcagagagttgaaaactatccattttctgggagatctcaagtgatgtcagggaaaataaggaagaaactggtttgctctgtgttagcctaatccccccatttaaacccggagtagcatgttaattctgtagccagaagagtgtcttgtcataactggcagggtcctgagattttggaatatgagtcttgctgtctgctactccgcacttaatgtcaacgagatgactgttttattacttctgggaaagaaatggggcacttaaatacaggcagattcagcagagcctggaagcagatagagcttgactccttggaagtaggtacaggttgcagagctgttggctgttagatatcatggcttaatgagtatggcatggacatggcaaggcccttcctcaccacagctgtcagtgtcatctgcacatgaagtggaggtggggacactctggggacatccctagccatctgcccctcaggctgaatccagactcagcaaccttcctcccaacttcaggattaattcccagatgtcctttttctcaaatgtagggagtgcttctggttgtttttttttttttttttttttttcagacatcaggcacaaatgatccaagcagagcctgcagagtacattagactcggtctgaaggcactagcctgaggggaaagaatttccccatgtgaaaagtgtctttcttctacagattccaggtattgactctgccaggcatttatgaagatcacatgagttagacaaagcctttttggagagtgcatggcagagtgagctctttcccacttggcaaatgagaaaatggaagttcagggagattacataaattgctccactatcatgtgatgaaaaacagaaccaggatggaaaccaggtgtgcctgattccaaatcattccctgctaggatactgtctccctgagaggaaattaatgagacatagtgtaacaggcagaactcaactctaccccaagccctagctaaatccatagataggcatgatcagtaatagttggctttccacctgaagttctaaagcagcctcagaatcattcacagggtatgccaagcagtcactttccaccacttggaacccagatgaagaataatgctatttgccgtctctcagtcatgatacccaactgtaggcatctagaccacaccctgcacctccttcccaggaagcttcttcagttggggtctatcagtaattgttctctgagcagtgtcttcggtaatgaaattgagacttcaaaaagaaaatcttacatgtgtcaaatacaagaaccactatgggaattacacaacttacgcaccatgatcaaagacttcctggtgtcactgggttagatccctatcataaaacatgggttgtctggcactagaatgccttcttcttactgcactataattttcatgaagttctgctctacacctggaatcatccagaacaaaatgccagcggaagagaactgtagtgatgtagacacagcatctaccacactgcttactcttctttctagatttcgtttctgaggaaggtatctgatcacacttttttttttcattgtctgtccccacagaacaattctacagcccatataagattcacgtatatggaagacaaaactgaagagcctgtttttttttaatttttttcctctagtgtgaaaattagaaagcacactcacgctgttaagaaagcccatgacagcctgccaacaatgaagctactgtcttatctttcctagatgatacttgtaaattgcaagagggagaaaataattctccccagtccccaagggcgactggagatttactgacgaccacaagttggatgggtggacctttcatgcatcctattgtccgttagtcaacagctctgactactcctcacccaaacgaaagtgaacatgtgtgtggttttacactctcttctctgtggaagctgccactggggaccagatgtctcttgccacgacaaagcactttccttgtttatcctcatcacatcccatcataggagagagagaagatgcttgaagggtttgggaggcagaagtgacctccagtccctgagggaaaggcaggtccattccacactcagagatccatgcctacaaaaacacaagagattctcaggcagaccaggcactcctaggatagagctgtaaggggaatgacagagcaccaggtaggaccagagagggcaagtacttcttctgggcccacctgccgaatttgatgaaggctgggagtcaaaggtggatacccccaaaatccattaatctaggaaagatatctgagcctaaaaatggaatctgaagacagaaagatctactcagttgaatagatttaacttcagatgctatttcttcaacacatgccataattcattgattctaatatacattttccatattttaacatcttcaaaattaagatatgtcttataattgatgatctgtcatagttaacttggtaatgtttttcttgttgtatattaaataatggtgtctcttacaatctatagcatcatagattttatgaagtatggttaacttagccaaggttgtaaggtactgtgctgagtaactttaaaggaattatctcatttggttcttgtttttttatagaaggtttattgagacaccataaaattcttccatttcaggtgtataatttaatgttttttttgtacatccacagagttgtgcaaccaccaccatgatcaattttcaaacattttaatcactccattaagaaatgcattagaagtcacccccatttccctctgacccacccagacttagacaaccactaatctactttctagctctatagattgcctattatagacattttacataaatggaatcatacgtagccgtttgtgtctgttttcctgcatttaacgtaatgttttcaaggttcattcatgttgtagcatgtaccggtacttcattcctttctgtgtctgaataatatttcattatatgagtctactacattttattttctactaatcagttgatgaacatccaggttgttttcaccctttggctattatgactaatgatgttatgaacatttgtgtggacatacatttttatttctcttgggcatatacctaggagtggaagtgttgtatcaaaaggtaactctatgcttaactttttgaggaacttccaaactgttttctaaagtggctgcaccaacatacatttctccaagcagtctatgaggcttccagtttctccgcatcctcatcaacacttgtcatcatctgacttttttatttcaaccaccctagtgggaatgaaatggcatctcactgtgggtttaacttgctttaccctgatcattattaatgtgaccattctttttatgtgcctatgagacatttgtatatcttctttggataatatactcagtttttgcaacaaacttttattgagcctttaccctagtctagtcatgtaagagacttatttcatcaaaggccctaattatttactgtattctattttcatactctttgccacataatttggtagcactctctccttttgaccctgaacttagccacatgacttgctgtggccaaggaaatgttaggatattgtacccaggggagtctgttggaggatgagattcatggtggagagccaagttgccccatcatcccaacaaagaccatgctagatcagccaacagccagtaaatccccagatagatgagcaaacaaagtgagtttagcagagctgcctagatgacttacagataaccacagaaacatgagcaaatccagctaaaatcaccagaacctcaaagacttataaactaaataaattgttatctgccactgggggtttatggttatttattttgcagcattgttaaggaactaaataactgatataagacagtgtcttaaatactgaggataaaaagatgaaagaagtgattcatgccttccaagaaccatattgaattggggaaagcagaaaagtaccagcaagtggtactttgctgtgttgcaaaagacatttggacactcctttgaccaagtagctatgactgcccatttttcagaagaaagctttcagagtttgtgggacaaaacttcctagctactccccactgtttccccaccctgtgcatttgactggctccccttgatgttcactgcaatgtatcctgtacccacatcatgttcttcctggagccattaaaaatgtttggtgatgcgcagagttggcataaaattttaattatgaatcttggttgcccaaattagtgtactagcataactttaattaaaacttactgctttatattcctctcaagtcctgccctgataaaatgttttattatccctccaagtctgcgtcttcagccttctctgacttctcttgccttttccttgaggccttttgggttggccatacttgtgcttcccactagtgacaatgcaactttaaaccaatttaaaaaaattctcaagctgcattagcttttatgatcgtgttttctatcttgacattttatcaatcattttcactatgcctggcacagttagatgtgccaaaaaggagtaacttaagctgcatctctcaagtaaaattatttttgtattttttttgtgtgtgttctaaaccatctccttcaaaccagtagcctcttattagggatattgtaaaccagaagttttagccattttagggatgtagataaatgccattgggcatgtatgaaagttacagaatttcttgcctgaaacagacacagatgcacatgcacaacagtattcatacattttcagaggctgatctctaaagctttagggtcttcctagcgccttgaggtgcccacctaaataacgtagaaggaacctgagcttctataaggaaggaggattacatatttttgatcaataaatgtgcttgcccagccaaatgtccatgtgttgtattatgaatatagaaaaataggaaggaagctgtggccatcattaagggacagggcatgtgcattgtgcgaaggagcaaaacaaaagaggtgaaggcatttatttctagtctcgtagtcccatttctgtcagggctttgcttaaggcaagtcacttcctctcccagagccactgtgtcctcttcaataaaaactacagggaggggtggatatttgaactgtgatcagtagcccctagatgctagtcgtggatgtgtggtagattagctactcttgtcaaatatagatttcgttctttttttttttttttttttttttttgagatggagccttgctctgtcacccaggcaggtgtgcagtggcgcaatctccgctcactgcaacctctgcctcctaggttcaagtaattctcctgcctcagcctgagtagctgggattacaggcgcatgccaccatgcccggctaatttttgtatttttaatagagatggggtttcaccatgttggtcaggctggtctcgaaatcctgacctcgtgatccgcctgcctcagcttcccaaagtgctgggattacaggtgtgagccactgcgcctggcctcttcctttctttttaagggagtggaggggtttacctcttgataattctgattcagtatgccaggggtggtggggcctgggagtctgtgatttctaaatgcccccaagatggtcagtaggcatagtcaagtttaagaacgactggattcaatgatcctcaggtcaggtcacctcatgagttagtggagggcggggtgtgcgtgtgtgcgtgcacgcgtgcgtgcgcgcgcatgcgcctgcgtgctatgatttagaacaagatagagtttgaagcctgaccgtgggaagtccacagaaacagcagcacactgtactgtgtggacaactggatatcctttttcatgctgctttaatgccctcagtgcctatttcatgtccaagttggctgtgtcatccaccaaccgctggagctacccatgacaaggctgcctgcctctctgatgctggagatgcactctggagctgtgcaaaggctctcttggtccatcttccttctgatgggcagctgttctggcagaaacagctggcagatggtctgtggctagaaatctaagtgtgtatgagatgcttctggcagtaaaaaggaggcctttaaagatgagaataatgactgaataattgttagggaggtcaccctaacaattatcctcatctttaaagacacctattctatagtttatagaagaaaatgccaatgtctctaattgctgtgggagctggctttgctgtgacctctccaggccttgtgggtggtctgtgtgaaagtagagggctccttgcatggatgcaagcgggcttagcaatggacaagactacagggagttggagaggaagaggatgaaatgacagatgttacattaaagttaggagaatgacttccctcatttgaagagttccagacaccctaactataggtagagaagcccagagcaatacaattttgtgactattgttgtggacttacatttaacccaaagttaaagtgctctaggattcatgagttttactcaaattacctaaaaaagtactaagactagggagtaataggtctactaatctgttttgttgactcaatctcttccctatctcccccaccccatagaatatagatttctctgcacaatggcctagaatggcctcaggacagtgcagacaggacacttgaacttgcaatccctgggggtgaggggagcacactggccttctttgaagtctttgcacactgcagtagaaatggcactgggtctatgatagggcaggtgatctaggtcaggctttctcattaacttccatgagatcgcagacaaggcacttccccttttctgggcctcagtggtcgcctctaaaaaaaaagaacaggattggaacacagactctgtacaatgctttccatcggtaacatctaactccatgttaggggtcctcgggtggcgttaggaaagaaggtgaaggaccaggtcatcacagagatgtcagcaaaaacactggatgaaaaatcagcacccccaggttccagtctcactgctgctatttactagaaacctctgtctcattccagactgcaagccccgttctataaaataaagctcctgatcaatagctctgctttctgtgccttttttatgccatgattttcttgtgctttgaattctctctcacttcaatctacccacaaaatctatttttggaaagcagggagatttgacacatttggaagcattagtatgtggacactcacacctattccttcctacaactgcccaggacactgatgccctgtgaccaccacgagtgaggatgaaggccatgcagaggtcaccttgtgcctccctggggtcagccctgagctctgtcagcactggacagatctgtgagaaattatttttagtaaaggcacttgggtcctttacctcctggaggaagtgatgccaagaaacacagacctgcaccaaaggcacctttgttctgttaatataaaacaaaacctcagtcacccacaattcttgtagccactgtattctgagtcattaaatcttctggttgactatgtggcaaatactttttccttttctctggccaaaagcccttccaaaaatgtgtttccttttctctggctaaaaagcccttccaaaaatgtgtttccttttctctggctaaaaagctcttccaaaatgtgtaactccattgctcctctttggtaatcagaacacattagtgagaacagaattgtgtttagatggctacagttcctggggccttgctgccatcatttcgaatgttggtcctcactgttttatcttatggtgtagatggcaccagagacagctttgagtatggatcaagcccaggaaggtcctcaggaagtgcatttttagaaatgagatctaagaaaataagcatttactaagcaggggctgtatgtcagactctgggccgggtactttacacacattttatcctcccacccacacaatgaagcttcacattggcctttttcagtaaatgaaactgagccatagagaagttaaaacttctggaaaatctggaagtgaacccagcctctttcctgatgccatcctgcattctttgtggtctctttctcccaaagcagaactagcaaaaacagttctgatcaactgagagtcccagataattccctctagttaactaagattttacaataaaccctatttaaagtgaggatttcacatgtttgaaaatcctcaagtatcttgccttacagacatggaaatgcctttggttaaactgcaattactacatttcctgggttgtactctttagtttttaatttctcaactttttcaccccactgtagatttattatatttacctttgaaactctgacaatctctattccagtgctttgcacacaggcccaaaataaatatttgttgaaagaataaggaaattgatgatgttgaatgttatatgtagtgtatatatagatatataacacatgatacttatatggttttatgtctttggtgttatttagtaaatatcatatgattaaattttaaataaaaatagaaccctagttgactaggaggaggagtcttacagcccaatacagagaaattaaaattaatacaatatagtggggtgacacctgccaacccaggggtaaaatgacgtagtctccgcatccacctcaaccacaattagctatatgaccttcaaccaagcatgtagcctctctgacctcagttttctactggtagaatgaagaaggggcacttccagcagctttctttccagttcttacacccctgtctatacatgggagcatgcaggcagcataatgccctgttaacaggctcatttttgttgttcacaatggaaccagaaaccaactaaaaacacacctttccctcttgtgatattcaagaaattcaaggtgactggtgtaattaacttctctccatgggcctttcgagacccaacgaaaaccctggcaggaaagcagttgttttaatttgcaaatatctgtcctgcctagttcaattcagcttttttccgaacacctacctggcatctgttgactttgcagaggtgggtcccacagtcaccatttgccatttgatgtgttgtgtacaaagagaaaaggactctgaaaagcaaatcctcatcagactgcattggatgtccagaatctgagcatgctcaggcattggaaggcagatggaggcacagcaggtaggtaaatgataaccccacactgaatgcacagttgacaaagaaaggtcagaaatgagatggtaaggaaagaaagcacaaggaacaccaaacatctgtctgaaagacacaagggaaaagaaattgtctctcctctacagataccatgtgggtctctatactaatttaccaatcaacagctgttcagcgattctactgtccattgtgcaggagacaagtttattaccaagctacagcaaatgtctctgcactcaacctctaaccaaacaaactttttgttttatccctccatctgagccaacagtttcaacacaggacaaaacctggtttctgtggggtatccagcctcttgggtgataatgtaataagtttttagcaaattaaagattgtcagggattatcattccagtcttgattcagtttgttgcagtctgtggtccttcctccttttcaacatgtggctaactgataggggcaagcaaataaccctaaacccacccccatcatgtgaaactgcaaccacatggtttccataacatattattttttgtttccttgattttttcccccaatggccattcatacaaaggaagttgtcaggacattcaggcagtgcaagaagttcatagcccagcattctccccattcccctccaccccaagtttatgttaaaccataaagcgaaattttccatttcttgaattcacatgtgaggcatcctgggtcctctgcattggccatagagagagaagaaagatggaacagcatagacagggataatgtgactggagtaatcaacttttctccatggacctcaccacaaccatcaaaattcttagaagaaaagcagttccttaacggtctgcatttctcttctttgctcttgcattaaatatggccaaccttgggcaagttgcttacacccttgaacctctgcttcctctccagtgaaatgcaggcaataatatataccgtatagtcttttggagaatacaaatttatgcgaatttgagataatgttaagatgacaaagagctgtataaacaatattgctctattgctatatagttgtcataagagttaaacaagatattgatcgtctctaaagtttactcacacatgatttatgactcctcactgtataatgcagaccagcctctctactggttgtgttgatcttggtgcttattttcctttcttttctttttcagatgtatgaaagcgtaattaatagctaccggttcatttattttttaaaacaattaacagcatgctaggatgattgttttgcacaaatctagcaactaaggctaggcttctacatgaagcttaattcattaattttgtctttgctttctatctaactgaattgccttttcataatgtaggtattcagacaaacatatgctgccaccaatcttctattgctcaagtactttgaagctgttaaatgatttgattatgcttagctatgatcacatacctcctatttgcaagtgagtttatcaggtcttgtttcaatgcttactgagcctctgtcttgtgcaaaacattgagatggagatggagaagcaacagggattttgaaactaaacagaattggtctctatttctagctccaccatttgctgtcttcattgcttggaggaagttgcttagcctctgtatgcctgttttctctttggtaaaaccgagaaagtaatatccttctcttctatgagaattacctgtgatagctataaagcatctggcataatacctgaacttggagtagacacaatatagcatctctttatttatttctctctcacttgttgtctccttccttcccagccccacccatcatgcatgtttctctgtgcaaagattatataagtgtctattgtcaagagcttaacatctaatagaacagaaatacgcataaagaattttaatacaaatcagaattacataggttctaaaataaaggttcaagcaaagttccatggaaacacagtggaagtggattaatcccaaaaatttgaaaagatttacagggtcttcaaaagctattaaaagaaagaattctatgaatagtaagtgggaaaaatagaacattcacttaggtagttaactcaaaacagctgattccaccacagtaccatgagaaattcatttgtgtctggtcatctgagttggtggcgccacagtgaacatgatgccccagacatggggattcatctccttatggaccacagatgagtttccttagggtcttcgtcattgacagtttccctaaagtgggccagaaagaatggaattgattcaggcaatccaaaaaaattatgttgatattctcctgttataatcagttaccaagtctagcacttgcaaggggagaattcacagggaattttatttaacaaacattagttgaacacccactgtgcaccaggcactctgcattccaatcaaaatgaatatacagatggaatattaattttaactttgtaaatgaagatagaaatatgagcattccttgttatattatcatttgattgcatgaattggttttgaatagaaatttaaaatggggaactgttctattaggtaatattaaactggtacaatagatgagtcatgaaatttggaatgcctagaccttagtctagctcttctatttactaggaggtatgtggcaagagtaccattaccattaccatgcacagagaacaaactatattctgggtacttacataaactcacttatctttccaaaagtgctttgaggtatgtatcttcgttctcattttacaaatgcagaaactaaggctaaatcaagtcaagtaacttgtcccaaatcacatgtcatgtagctggggaagcctggaattaaacctcagtctgtctcacttcaaagtgcatcctcttaagcagtatactgtgctgcttccatgcaagttggctcctgaataagtttccatgcccccaaaacagagataatattgaaggtggtgatgtactgcaaaacactatacagatgttggtcattactttaaagtggcatttagttcattgttaacaaatgttaatatgaatgagatgcacagatggtagaacctttaaaattgatccacctactcatcttaccttgtcatggtaacagaatgaatttgagactaagtttatctggacacacacttaaggccaccaatatattttttattccattgtttttcccagtgtaaagatgagtagacggaatctctgccctcaaggtactcacagctgcttgcatttgcaggcaaataaattgcagttcatttttggtgaattcatgaaaagaaatgtgttcaaggtagacaaatagcagagagaaaagaatgctcactagaactgggaaagtgacaggtcaggagggtgaatcattatggatttgccaaatgcaagaggtataatcccaaccacgtatccattcagccagagatttattaactgcaactcagaggacagttgctacaacaggcatgtcatcctgtttcacgcaggagccaggttccagcagcaggcacattagatctgctgagttcccttctcttcgcatcattgaggcaagttatcatgggcccagctgaacaagggaaatcagaggctcgggctccagcaaagcagcacattaaaccagggtccctggctctggaaactctagtttttgcagatttagaaagctaccactcagagtgagtcctggctccccacttggttagtccaagcatctgatgcacgatggctcctcccatttccagcaaccaaggaggccactaagttagacactgacccagcttcacccagcagagcaaggctggagctggctgctgctggcacaacctgtggactcccgggagggcccttagggtaatgggatgtaagataatgtgactcatacagagaagaggtctagggacatcaccgatcttcatcccttagtgagccatctccacaatatctcctaaggctaagaaccagagtcatttgctgggtttcacaggccccttacaagggtaaaggtgaggtggacctactatcctatgcatggaaaatggaaaatgagtttctaagtgtgagtgtcatgagcacctgtgtatgagcacttggcatgtgaaacaggcttagggaaccattacaggatgaggtcagagaaggcttccccaaggaagggaggatatgttagtcaggtggagtggaggcaagagtgggcagagaaacaggcttcaaaactgagggagtatcatgagcacacactcagaggcagcaggtggtgagctcagggagctgtaaaccatgcagcatgtgctagagtgttgcatgcaaaggaggtggccttggagaagctgctacttgccaggatttgttgatggaacatagaagaaactcatgatgaaatactaagctttcatctataagctgcagctataatctgttagtacacaataaattacaaataaatatagcatcaaagcattaccatgatgtaaatgtctcttattagaaaactgtaattgggccgggcacggtggctcacgcctgtaatcccagcactgtgggaggccagcgtgggtggatctcctgaggtcataagttcgagaccagcctgaccaacgtggtgaaaccccctctctactaaaagtacaaaaattagccaggtgtggtggcgcacgcttgtagttcccagctactcaggaggctgaggcaggagaattgcttgaacccaggaggcagaggctgcagtgatccaagctgagatcgcgccactgcactccagcctgggtgattgagagagactctatctcaaaaaaagaaagaaagaaaactgtaattgaaaattaaattgtatgacaaacactatacatgccattgaatgttagaggaaaggaagaaagaaagagtggatttatttagttattctgtaggtgtacattctatctagaggtattgaggtaggtttttatcccaatctttcaggggaggaaactgaggcttgtgggaggcagaagagtaaattactttgcccagaatcacagataattctgtgtagaatcaggactttaatctgtgtctattcacttccaaagctgctgcttttgccttctaagaaccattgaagtgttcaagggaaatcatcctaaaggaggagatatgggactctgtggaaatgctctacagtaggtttgtttgttttttaaagattatttttgctgatacataataattgcacgtatttatggagtgtatgtgatattttgatacatgcatccaatgtgtaatgatcgaatcagggtaattaggatatccaccccctcaaacatttagatggaggtcatcatgttaaatgaaataagctaggcacagaaagacaaatatggtagatatttacagaacatttcacccagtggctgcagaatacacatttgtttcctcagcacttggaccattgtcaatggtagaccatatgttatgacacaaaacaagtcttaaaacattcaaaaaacttgaaatactatcaagcatcttctctggtcataatagaataaaactagaaatcaacaacaagaggaatttcagaaactaaacaaatacatggaaattaaacaatctgcttctgaatgaccagaggatcaataaagaaattcagaaggaaattgaaaaaaatattggagcaaatgataatggaaacacaacatacccaaaagcagcaaaaggagtactaacagggaagtttatggctccaagtgcctgcatcaaaaaagaagaaaaatttcaaataagcaacctaaccatgtatcttaaagaactagaaaagcaagagcaaaccaaccctaaaattagtagaagaaaagaaataataaataacagagcagaaataaatgaaattgaaatgaaaacaatacaaaatatcaatgaaacaaaaagttggatttttgaaaagttaaacaaaatagacaaacttctaggcagactaagaaaaaaagaaaatccgaataaaatcagaaatgaaaaaggagacgttaaaactgataccactgaggccagggggagtggcttacgcctgtaatcctagcactttggaaggcagaggtggatcacttgaggtcaggagttcgagaccagcctgaccaacatggtgaaaccccatctctactaaaaatacacacacacaaatatagccaggcatggtggtgtgcacctgtagtccaatctactcgggaggctgaggcaggagaatcacttgagcctgggaagtggaggttgcagtgagctgagattgtaccactgcactcaagcctgggtgacagagaggagggtgtctcaaaaaaaaaaaggaaaaaaaagaaaaatagaaaaaaccatgatatcagtgaaattcaaaggattattactagctactatgagcaactatatgctaataagttggataatctaggagaaatggaaaaatccctaaacacatacaacctaccaacattgaatcatgaagaaattcaaaggctgaaaagacaaataacaagtaataagataaaagccatagttgaaagtctcccagtaaaagcctggaacctgattggcttcactgctgaatcctactcaaataattccaaaaaatggagaagggaatacttccaagttcattctatgaggccagtattaccctgataccaaaaccagacaaagacacatcaaagaaagacaactgcaggccgatatccctaatgaatattgatgcaaaaatcctcaacaaaatattagcaaaccaaattcaacagtatattagaaagatcatacatcatggccaagtgagattatccctgggatgcaaagatggttcaacctaccaaatcaatcagtataatacatcatgtcaacagaatgaaggacaaaaacaatatgattatttccaaaaatgctgaaaaaacattttataaaattcaacattccttcatgataaaaatcctcaaaaaactaggtatagaaagaacgtacctcaccataataaaagctatatatgacagacccacatctagtatcatactgaatggggaaaatctgaaagcccttcctccaagaactggaacataacaagaatgcccacttttcagtaatatgttgagtaatatgttagtactcaatgtttttactcaacatattactggaattcctagcaagagcaatcaggcaagagaaagatataaagggcatccaaattggaaaggaagaagtcaaattatccttgtttgcagatgatatgatctttggtttgttggttgttttgagacagagtctcactctgtcacgcaggctgcagtgcagtggcacaatctcagctcactaaaacctctgcctcccggactcaagtgattcttgtacttcagcctcccaaatagctgggattaaagtcaaacatcaccatgcctgtctaatttttgtatttttcatagagacagtgtttcactgtgttgcctaggctggccttgaactcctaagctcaagtgatctgcctgcctcagcctcccaaagtgctgggattacagccacgagccaatgcgtcctccctgaccttatatttggaaaagcctaaagaccacacacacacacacacacacacacagacacacaaagatgttagaacgcattaaaaaatcagtaaagtagaaggatacaaaatcaacatacaaaaatcagtagcatttctatatgccaacaatgaacaatctgaaaaagaaatcaaaaaagtaatcttatttacaatagccacaaataaaattaaatacctaggaatttaaataccaaataagtgaaagatctctataacgaaaacaataaaacactgatgaaagaaactgaagaggacaccaaaaaaatggaaagtggaaagatattccatgttcatggattggaagactccatattgttacaatgtccatactgcccaaggcaatctacagattcaatgtgatccctattaaaataccaatggcattctttacagaaatagaaaaaataatccttaaatttatatggaaccataaaagacccaaaatagccaaatctctcctgagcaaaaagaagaaaactggaggaatcacaatacctaacatcaaattatactactgagctctagtaaccaaaacagcatggtactggcataaaaacagacacataggccagttgaacagaacaaagggtactctatttttggtttttattgaggaacctccaaactgttctccatagtagttgtactaatttacattcccaacagtgtaccagggttcccttttctctacatcttcactggcgtttgttattgcctgtattttggatataagcaatttttaactggggtgagatgatatctcactgtagttttgatttgcatttctctgatgatcagtgatgttgagcaactctttatatttctatttactatttgtatgtcttcttttgagaaatgtctattcaaatattttgctcatttttaagttggattacattttttcctatagagttatttgaactctttatatattctgacaagggattaataaccacgaaatcagtatatcgaagagacatctacactctcatgtttgtaacagctctgttcacaatagccaagatttggaagcaacctaagtgtccatcagcagatgaatggataaaaaatgtggtacatatacacaatggagtgctattcagccataaaaaaagaatgagatcatgtcactggcaacaacacaggtggaactggagatcattatgttaagtgaaataagccaggcatggaaagacaaacattgcatgttctcacttatttgtgggatctaaaaatcaaaacaattgaattcatggagatagagaatagaaggatcattttccaaagctgggaagcatagtgggggacttcggggtggtccagatggttaagggatacaaaaaaactagaatgaaagaataagacctagtatttgatagcacaacagggtgaccatagtcaataataattgaagtatacatttttaaataaagagtataattggatcatttgtaacacaaaagataagtgcttgaggggatggatactccgttctccatgatgtgattgttatgcattgcatgcctgtaacaaaacatctcttgtactgcataaatacatacacctactgtgtacccacaaaacctaaaaataaaaaattatattaaaagacaaatatggcatgttctcactaatgtgtgggagctagaaaaagttgttctcatggaggttgagtgtctaatggtaattaccagaggctgggaaggggcggaagacagagataaacagaggtcggttagtggataaaaaatccattcagacagaataagtcctagtgttccatagtaggttttgatgagagctgttttaaactgacatattttaaattaaacctccctaatttccaaaaccaggcataactgccttccatgtttccctcacacctttcagaggctaatgagaatcacagtgctgcagggttctcctgggctctgggcagcagctggatggcgtgctccttcctggctgagaagataaatgtcacctccacatacatgggtttgccagctccatggggtccagccagctcctctgagaactcccagagttcacaatgggcacttggccttgggtaactgaagctgtctggtttgcttccctgcctgaagaatgggaataataatatttaacccctagacaaggagaggtagagaaggggggtcaggtaccatatacacagtgctgcctgctaggtgaagcagttccctccctgtaccatccccgctgcactccacttccctggcaggcccctcctctttcaaggagcccagtaggcagattctaaagatggagagcaggccagctctccagccttgctcctacacagctgtgtatgggaactgctgtgctgtctgctcagcggccccctcacacctgctctctctgggccaggatgaacctcagaacctcagcctcctggtcccactgcagaacctcagcacctaacagagcccaccctcttctgccatttgtatctgagaaagaactgactctggaaattctcatttatccaaggaaaaggacccccctttaaaccaaccagaccttcacctcacctcactgccttttcttttcttgtctccttttcttttctctatttctttcttttcagttctttttttccttcttctttcttattctccttgcctgcctcagtatagggaatagaaaaagcctggattggagttaggtggtccttactgagaattccaactccaacattaatcagcaataatgggaaagcgacttgaccttgctggggtttggtttctttatgtgtataatgtagacagtggttgctagtttgtatatttgttgtgaagactaaatgtgaaaatctgagtttttatttagccattaataagtaccatgtaattaattcattaatcagagtacccagggtgtgtgaaacactgttctacattttgagaatagagcaatgagtaaaagcaacatgagctttcatacttctctaatgggccattcaataagtattcattttcaatgtagttcctgctttgggggcattaccctgcttatcattgtccctgaaatatgggaaggaaagaaaaaaaaatcatttctcttcagccagtaaaacaactccagggaaaagagatgactatttagacaacagtcagctgggtgattgtagataaaaagtctacttcccatattatgtcactcagcattcatggttgcaagcaacagaaatcaactctggctgtcttatgcaaaatggagatttttctggaaggagattggtgggaaattagaagagcagacttggagcaagggaagtcaagcatcagagacaaccacatgctggtcaggaggctgtcagtgacactgatacgtcactgctaccatcactgctctaccactgctgggtcaagctgatgtctgccaagccaccatttgctatcacatactcaggatgcaacatcctgcctccctgctgaaccaggaatattggaaggatctaagctccaagtttccagagtggaggacaggcattgagaattgctttcctgccaagatcatacacactggaggagagacagcatccctcttggtcaagggggttggacgctggacaatcagaaaatggacacacatctatcatacttttctttctgttttcctggctccatggagaatgaagagatgaaagaagcaagcttggccttttcttatcagaaagaaatgaaccaatgctggataccatctgccattgttaaaaggaagattctagtccagtgggccttcatttcattttgatggagaaaatgttttctccatgaagatccctagtatcaaacctgttctgcaaagagacctcactgatgagctggtttgtcatctgtgattacagcatccaggtgcttgtgtgatggatgggaagcctagattttcaggcagctgttataatgctgcttagcatataaacagataaaaatattttcatttttcccatatgacaaaagattggtgattcccaaaggtgagaacaagttagtagtacattctttggagtattcagatgaccacggggcaaaagtcttttcaaattaagtctctgagtatttaataaatgtctgcttttccacattaggttgggtactgaaagaaataaaatattcagcaaacagtctgattggggaaagagactaatgtacatggaatgaattagaacatcggaagacagtgcacaaactcaggcttgagagtcagataagtcaaatcccagtcctgccacttactggctgttaagatttggagcaaatcttctgagccctgtttcctcatctacaaaataggaataataacaatacctatctcaatgttatctaatacctacctcattatataagacataaaatggtatacatatattgttaaggattatgcctagcacatagtaagaattcaaaaactgttacatgtcatgattgttctaacagcaaagtctatatggcatagggataaaggtgggacttaaaggggaaaagaaaagggaggtgtcacatgcagacagagaaacagatacaaagacatctttattagccattcattgagtcctattgtgtttctggttctgtagatgacaaatgaattggtccactttcaaggaactcaaagtccagtggaggaaatgaacaagtagattttcatcattattaatgcaagtgagttcagataataagaggccatttgatctagagcctccattgaagacttcccctctggactcatggccaaatagcatctcttttccttatttaacctgctggaaaaaacaaaacaccttgcttctagagcctatttccgaactcatgacaatcccacatctccatcttcaaatgcatcccaattatggagaaagtgccatgaatagcagccaacattttacaacactcagtaaatgtcaagaactgtgctggatttatctcagatattataataatatccacaacagtccttctcaggaattatttttattcccattttacagatgagaaaggtaaggctcagagatgataaatgacttgtccaagcatgtctttaccattggagtcccttcttgatctcgtccttactaagctgatcagattcatcttgtcacgccttccctcccagttcttcctccccaagctctatgctccaaccatcctgaactacttatgatagacacatatttagaagagagtgtcaacaaactgcagcccactggccaaatatggctctctgcctccttttgtaaatagttttattagcccactgccatgcccatttacttacatgttgtcatgctaccacaacagagttgaagccatatgaccacaaatcctaagatctttgcttccttgctcttcacggaaaatgtttgctgacacttgctttagaattcgaaacctccaggctcttgctcacactgttctttctgccaggtgtgccatttctttcaccaggacataataagatttgacttttgactcaataccctctgagaagacgtccctaatttttcgaggagttagtcactttctctcttgagttgccactgctccgtgtgtacttctactcttgcatttgtcatattttattgcagttgttcatttaggtgtccatgtgaccttgcatccttacccctcatcatgccactcaattccttgaatatattgggctctcacttaatatgtatggaaagaaaatgaagtccttgctgatttccctgcttcttagcatactgtggtcaaataatgaggggatctcagaaacagtgtggtggccagaaagaggcactgggagctggaagccaagactcggaaaatgtgctgtctcatctttagttctctcatcttacctcccaagtagcactgagcaagtctctccaccttgatgagcctgcatgccttcctctgcaccatgaaaggattgaactagattatctcaaatgtccctccctgccctaaaaattctatgagactctgatgtctatgactgaagtttagcactctaaaatacagtcaggaagacatctaagtcacaaactctcttttgttgtcaaaggaggttttgctagaaagaagcccaagaatgttctagaagtccaggttgaatgtctatgattacactctagaatctatttaaagttttttttctgttaaaaagtattaattgccaaatcgtgatgttccttcctgttttatgtgtgttagatcagaacactactcactcagcatccacagggagagatatagcctctggatactacatatggcaaagccaagccagaaaggggtggctgatgtcgctgaggtgcccaccatcatccaaccgcaggcagcacttcccagccccaagtttccagccttctcctgaggcacattccctaacttgtctatgacaagaggcacatgaattactttccaaggtacagattttcaggttcctcacctaaatccatgaatttgaatcacctagattggggccaaggaagctgtgtgtttcacaaacagctgcagtggttcaacaggaaagcttgggaatcccgacatagaagtctgactccaaatgtgaagttccactggatcctaagccacagaggtttggggtcactgtttggttgaaatggcaagtccatttgtcacccaaacaaagggtaattccaggaaagcatttgctggaggggatgcatttttcaagacctgctgcagcaccttcagattaggctcatttgcacacctgcatattttcccccaattttccagcgtaaccctgtgtgaatcattgcagttttgctaattgaatctgagagcacctgtttcttaatcaatattaatgcatcacatggacgcagaatttgtaatgagtcattctagggggaagaatgatgaaattcaaaaaaagtattcactattcatctgcaacctgataacttgtggccagaattccatctgggaagatgtagggcagagcaggggtaacaaacagggagccccgagacaccaggcccctccacagggctctcgaggcacttacctttctcccatttttggaaagggaaaacagtgcctataacctgccaactcccaaacacctgttctgttgcaccctggaagtccccttctctggttctgagggcttcagtattattatagttttctgtttcttcgcagtccccaggctctgtacttcctgccacagactctctcttgatcttgctgtagataaaatggtgctaattcagctggctgatggaggtcagcaccttccaggaggtagaagcctgagttcctgggtccaactctgacccaagaacacgaggctccagtgtttctatttcctcagcagtttccgctaagcagtttatttctccaggaaacacccctctcctccctgagcagcctgagctagaggccccatttctgggatcccctgcatttgttgtaccttctagcatactctcctctgattgtttcggaaacagaaagtgccctgctcatctctgagtcccatgcctcgcacaaggcctgggaaaatgtaggcactttaccagtttgagttgaacaaatgattgacactgaattatttcctctgcgtaaaggtgttagatgtgattttacagccatcaggactattaccatgtggtcaaggtgtgttttctgcaatcccatctaagttaatggaacaaaacctactagcaaagtgttaaatcctgtaagacctcatcatctggatcacctattcggtggccttatccttagaaagctatctgaagagtactcatatagcgatctatgcccctgagcaagcttacaggcaaggccagctgaccaagcttgacttccacagcatgctgggtctgaagggctgtgagctgtgcctctggtgcttctccagtccatcagttgagtctggggagagcttttcatgtgcccaatagcggctttgtcccatgaaacaggaccttcagagttgatgggtcccaaaaagactaacccaaggtaaacaaacacccagaagaagacagcataaatctgaaggctgctattatttagaatgagagtgcactttctgaagactatgtcctttacccaagacagctctctttactatcatttgtcaacaaaaggtacttggactcggagagcaaaggggaacatacattcctgaaggatcttttctatctaaactgaggggagtgctgtgagccaatcctgcctcacaacagatgaggctccatcaataaccacattatttgtatctatatataatatttatggacagtgagagacagggtcttgctctgttgcccaggctagagtgcagtggcacaattatggctcactacagcctcaacctcccaggctcaagcaatccttccacctcagcctccagagtagcagggaccacaggtacataccaccacgcctggctaaatatttttgctttttgtaaagacaagatcttgccatgttgcccaagctggtcttgagctcttaggctcaagcagtccacccgaagtgctgggattacaggcgtgaacccctgcgcctggcctataaatattaatatctgcaatttggccattgtttcatcttgtgcccagcctgggagctatgctataatatttaagatgactatacacatatctgatcattccctttatagttgtccctcagtatacacaggggattggttccaggacttctaagtctatccaaatctgctcatactcaagtcctgtagtgggctcagcagaactcttgtacaaaaaaatcggccctccatatatgtgggttttatatccctcaaatactgtatttttgatctgcatttggttaaagaaaatctgtgtacaagtgaaatacgttgtttttattagtcaagctctaaactgtcctgaaatatttcttgatctctcagctggcccatctcaaagccaactcaatatcaccacttggatctttcacaggaactctaaactcaaatgtccagaatcaaaccaatggccttatttccaaaccaaggcctcctcccatccttcctatcgcagtaaatgctactactattcacacaattgtaagccagaaacctacaaatcatatttgatttctctctcttttttcctctcattttgttcagtctataaactgtttccaacatgaattctcttgcagtggattcatcccttccctattccctttgggttttattttcatcagggttctatggctacctaactaccaactgcctctggcttcctctggctgtgagagtctgctctgcccaatcgcaggcaggcctggagtgccaggaacggttcttggcccttggtgtctgaaaaacctgactcccacgccccgctacacagatgagattctccaggactgaattgtccaatacgtgtaggtactagctacatgtgactactgaggtcttgaaatggggctagtgcaaacaactgacattttaactttacttaatgtggactaatttaaattgaaaaacagatactcagttcagttactggaaagctttcaaatttgttagtatgacctaagtgtatgaatatttttttcaactacaagttttatgaaatttaaacacagatcaagtactaataagaaaatctggtactcaagttgagatgtgctggattttggagactttgtattaaaaatgcatgtaaaatattaataatttttattttgactacctgttgaaatgatcatctttgggatagattgagctaaatggtctatattcttaaaactgattttacctgttttattcttttgttaatgtggctactataaaattttattttttatatttatttatcttttcttagagtctcacctcgttgctgaggctggggtgcagtggcgcattctcaacccactacaatctccatctcccaggttcaagcgattctcctgcctcagcctcccgagtagctggggctactcacaccaggtcaggctcatgcaccactatgcccagctaaatttttgtatttttagtagagacaggcttttgccacgttggtcaggctggtatcaaactcctgacctcaggtgatctgcctgcctcagctctaatccattctttacacaacagctagggtgacctttgtgaaagccaaatctcagtgtatctcactcttgctttaaggctttcaatggcttctcatttctaagatcttctctagaccttagaaaacacctagggtattctcaatctgacccacaagatcctgcacaattggcctaccttaccagctgcatcttgccatatgtcccattccccttctgtttctctgtttcagccacacctgcctcccttcaggttcccaagtaccacgtgaagagatcatccctcattcttccccacatacatactctgcttggcctcttcctgctaatccctgagtcctgtttaaatattacttgctcagagaaaacaaccttcaacttccagacaagactatgtcgtgctccctgttagacattctcccagcatcccacgcttctttgctttgtccttattgccatgtaattgtgcatttcattgttaaatgcctttctccaccactaaaatacatacttgatgaggactcttatttaaaacctgggccctgacacatagtagatacacaataaatatgtgtggaataaataaaagaacagctttgctatttacaatagattcttacttgtgttggagatggctatagtaaataacattccctacccaccccccttgtaccctgcatggcttaaattaagagaaagacccaggagtcaggtgaaagccaaaacgttagctttatggatgatgaaaactgtgtaggggatccagctaacatatgctgcaaagtgaatttgagagcattgtccacaccatcaccccaaattaaacttaccctaaaccatcaggctgacctcagtgaggacaggtctttaccactgaagtcccagcacagccaagagagtaaaccagactgtgccctctctgtgagcaggcctttcagagcagatagcatggcactgagcttcacaggcccagtcctttcactcaagtcaccagtctcagaagtatgcccctccccctttagaggagtgagaatggggcagagagtccagaagtgtttctctgggaacagtcccttgtcatgagtcaggaggtatggggaacaatggtctcccaaggcctgggaacctgcttacccatctgtaagaggaggggaataaatggcactgttgggagggtcaggtgaattggggtacttataagtgcttggagaaatggtgcgtaactataggatgtatgtattaaaaacctctgcatgtatcttggctggctggctggcatcctgctttctttcctcaactatcttttaataaaaataaaaattacttgaaaaaactggtttctggcccatggccttgaagcctagaagatgaccttgagtgggctgggcacagtagctcacgcctgtaatcccagtacttcaggaggccaaggcaggtggattccctgatctcaggagttcgagaccagcctaggcaacacggtgaaaccccgtctctactaaaaatacaaaaaaaaattagccggatgtggtggtgtgcgcctgtagtcccagctactagggaggctgaggcaggagaattgcttgaacctgggaagtggaggttgcagtgagctgagatcgcaccgctgcactccaccttgggcaacagagcgagactccacctcaaaaaaaaaaaagaccttaaatgaagcaaggtttccactcacccctcccaccaatctagcattatattgctaccccactcacagaatataatagccaaacagattgttttgcaggcttgcgggcagggggagaagctaattaaaaatgtgctaaagtcctttgaaaattcataagtaagtgctaaggttctagtttggtgcttacattctgacagcctgacagcttcatgggttgaactcttttgaaaaagtaactttaaaacttgcataaattgcaccttttgtattttaagtcacacaggcatgacaacgtgattattcatgactttggagaatgttcttgacaacaagaggacattaatatccccagccctataccaaattaataagaagccctgagaatcaaagagaacaaagaagcagaggcccttctccttagaaggagagaagagtctgtgctttgaaatgtgctgggacctggggtgccacttataataatacaggtgtgtgtttctggctagtagctgataaatatgctcaggcagaaaccaccgaagagacaggtctgtctaccagcaaccgagccaacttgatttgctttgtgttgcaagtagcaattggacttctgagagttctgaaagcaggaaggaaaaagtatacaagatgcctgaaacattcagatggaaagcacaaaagaatcaaatggaggcccaacattaaaatgatagctacagttcatcgaagttgtattatgcatccagcactgtgctgaagcacatgacatggcaccctgaggaaggtattctcatctttatttcacagaggggtaaactgaggcatgggctggttaaacagttttcccgtggtcacactgattataaggagcagaaccaagatttagacctgagcaatctggcttcaaaggcccagtgagatcctttccatgatgataatcctgcagaaatctagcaacttctccaccaggctctgagggtgtcttcctactgaatgtctacttcatccttctctctgcttctcagacaggagatgactagcccacaaagcctcagtttacatcccctgtctctaagagactaccccagatgtaatctccctagtcctagtcccaaataagaaagacaattatctgagcagctcagctgcagtaaaggatccatacttgagtcagtcctctataaccagggttgggaatgtatcactccaacctggcttccagaatgttctacacactgagcaacctttgattatgaaagcttttgcattctcctcagtcttttatatcatagaatctctcttctctactaggttactcaacagatacttaccatgtacaagtcaatatgttagtcaggtaggaaatagaaaagcaactaagatgctgactctgtcttgaaggagcttatggcctggtggtagggatcacttgctggtgtgcacataaagcaatgcatgctgtgtgtgagtgttgtgtgcatgaattacagagatgctaagtgctctaagagcccagagaagggagacatcaaaaggctgtctcccgaggtgctccccagaagcttctgttggtggtagagaggtagagaaagcatgggttttagagtaaaagtctgttaaaattccatttcattttgtgacttcaacaaggtacttgaacttgagtctcaatttccacatttgtaaaatgaggctaataccatgtatctcacatgacagttatgacaattaagttacataactgtgttagctggcctagttcaaaaaaaaaaaaatgcttctctcttttccctctccttgtcttctctgttcccatggcaattgtaggccttccctcattttaacctggtggctgtggtggctggcctgtctctgtgtctgtctttccatcattcccatttggaaattcctccaggatttagtcaatattttagttctcttcatggccttaattactgaaacatgaaatgttagggatatatatatatcaaaaacagccaagtttaggaaatcttattttatatcacttttttttgcttcgtatcattcagcactttcattgtaaaataataagcaagtgcatatactcatttgcatttatttgcatatatctttataattgttacttgtgtgtgcatcatagtatcagcagtaatggtaatactagtaattgttaatagtaactatgagtacctaatgtttgttaagtaattattatgtgttatgtactctttcaactatctttacatgtattaccttatttaatcttcacaacaaaacagtagccactattgttctccccatatacagatgaggaaagtgaggcacagagaggttcagctatgtatgagaatgaaatagaggaaagtaagtaggaggagacataggattccagcagcaatgcagagcactccacgaggcatcacagggatggtaattgaaccctgattctgcagagcacgtggccacagatgaggcacatacactctgtgagaggctttgtcctcacctgtgagatgggatgcctgctcctacttcagagattcctgtgtgggaaccataggagaatgagtgtgtgaacactctctgtaaaatggtaaagagccatattgatgttagccagcttggtattggtcaagcctcgcctcactggtctcctcccctcctgccccattctgccactcagaacctaggaaaccattgttccaagtacaagttcaatcagtgcttgctaagtcaacaggaaagagtcagggctggctaacattcactttctcagatttaggaagaagtggcaaggctgagacatagtgggacagccacccatgccaaaagggggaaaggcagaacttgagatttccaagtgtatgactactgagtttcatggaaaatcggagtctccagacccaacatagccattacagagagtaggcaatgctgggtgtggcatgggaaaactccattgtcttaattctgggaggtgatataatagggagaagtcttagcactgggcaagcctggcttggtgacctgattttatcaccatcttgctctgtgattttggacaggtcaatcatcctccattataaggagcaccttttcacatctataaaacaagtgtaacattagtgatatagtttggatatttgtcccagtccaaatctcacgttgaaatataatctccagtattggagatggagcctagtgggaggtgtttggatcataggggtggatccctcatgaatggcttggtgaagagtgagctctcactctgggttcacaggagatctggtcttttttttttttttttttttttttttgagacggagtcttactctgtcgccagactggagagcagtggtacgatctcagctcactgcaacctccgcttcctgggttcaagcgattctcctgcctcagcctcctgagtagctgggactacagacatgcaccaccacgccaggctaatttttgtatttttagtagagatggggtttcaccatgttggccaggatggtctcgatctcttgacctcgtgatctgcctgcctcagcctcccaaagtgctgtgaatacaggcgtgagccactgcgcccggctgagatctggtctttgtaaaagtgtgtggcacctcccccaccactatctctctcttgctcccacttggccatgtgagatgcctgctccctctttgccctccaccatgaataaaggccccctgaggcctccccagaatccaagctgatgacagtgctacacttcctctgcaagctgcagaaccatgagccaactaaacctcttttctttataaattacccagcctcaggtatttgtgtatagcaatgcaagaacagcctaatacaatcagtaccagctcacaggattactgtgatgactcagtgagatactgtgctcagcacagggtcttgcacataggaaacagaggaaacagttgagcaaatttgcacaatacagtttagcaaatattagtattaatggtggtattatttcgtgcccctccaagcctagggtctcgggggagggtttgtgtctccttagttttcattgtttaggggttctttgtttctccatagcatatggagaaaacataggatattatagccatatttggtaacttgctggtcaccacagataactatgatttagagaataacgtagaagtcatgcctggaaagctttttatttctgggcggggcggggagggtgtcaggaatgcattttacaatgtgcagctactgtgcattcttatgaattaaaaacagacaggcacacccaaatagctctagggaaaaaaaaaaaactacagaggctatttttaaaaggtttaacctcagtcctataaaagagcaacagagatatagaatcttagatttgggaggaagcctcctagatctccttcctgtctagcctttctacaccagatcctccagcaactggcctaaaaaagactcagagtagcaactttatggcctcagagtaacagaggatgcacccatttcttgagcataaatggacccccatatttacacactgccccacattgctatttgatcattgcctgtggctgaattgcggctgccctcccatcatcaaccacgttggcttctcttatatcccctctttacctggtctggggctgaacaatcaattcatgttgatcaaccgttttaggatgcactggtgagtgcccaggaagtagtgtttaactcactagctatattgaatacactttttctctggtctagttcaaacagaaggatgactggaaatatatctttgatgcactgtgctggtctcataggatttatgtgagcctgaatccacccccttttacatatagctgatgtctaccaattctgctagactgatgtcagggttttatttccttcccagaaatgtttctgagtaccctttaacccactccccatcacccccaaatacacacacacggtgtgagtcattaacttcctctacatatttcactacgtccctttgcaaacctctgtcttagcacttaccattttgtacagaattgtgtatttactcctcagtccccacaagagagatgagtctctcttttatctttgtattatatttctagttctagcacactgcctggcaccttgtgattgcttaagaaatgctgggtgagtgacccagtgtgcccagtagtggcaaaaactccaccttcagctctcccaccccaccagcttgccatggatcctggggtgtaatctcaagggaatctgtccatccattttaaaaactatgagcaggctaaatattagtcatccgaatgctgttttctcattgagttgccttaacaaatggcaagaacagatggcattcaagacatgttgtcattataaaagtataaaaatgttatttgtttttaaaattaaaaaaaatacatgcacatcattgcagacaatttcaagagcagccctggaaaaaccgtgtggagaagaaatactgtgtttttttcttctcagtcttgccatgtcatcagttttcatcattggccctttcctttctgaaaacgagatgaactctcaaaattgagttttgagacaagtttgattttcctttgtcctagctggaaagagagctttaacagagatcacatacccactatgtgccaagtactagcttacatgacttgcagtgtagcctcacagggtttgtgccacattgtttaataagcataagcaaagttttctataaagttaaagcagcagcaatggagagaaggtaactgtcatcactgtggacttgatatagtgccaggaactgaaatttaaagtcaggaaccctggcctcataaatgtctctccccatgtaagcagatgacatcctcattgcagaaaaagtaccagccagcaactcttgctggcttgccttattgaaagttgagcactaagatcaatagagcaatattttatgaaattcaatttatcagaagatttgatgtcttaaagatgatggaatgtcttatttattggcaatcgtagaaacttcaggaatgtttggcacactgaatggtaaagcccaaagttgatttgaaatttcctgtccttgaaagaagacagtgatggagagtcgcttttgaaagctgaatctcaatcccaaacctttgcagctattgtacaagcaggccaagatcccaggccaaaatgaaagtgtcgtgtgccatgagttttaagaactgctgctaccagaagcaaaataaaagataaacaagaaaaaaaaaaaaaaagcacatctttatgtggatccaggctacaaaaaatgttagcctttatccctaccccgaacttttcccgaaggaaattgtggcaaataatcaggttaaaactgagagtcactaaatgcaatgtagtatcccggcttggattctggaatagaaaccagacataagtgaaaaaactggtaagatccaaataaagtctgtagtttagttcagcgctccccaacccccaggccatggaccactccccaatgctcacattactgcctgagctctacctcctgtcagatcagtggcagcattagattctcttaagagcatgaaccctattattaactaagcatgtgagagatttgagttgtgtccaccttatgagaatctaatgactgatgatctgtcactgtctcccatcacccccagatgggaccatctagttgcaaaaaaaaaaagctcggggctcccactgcttttacattatgatgagttgtgtaattgtttcattatatgttacaatgtaataataatagaaataaagtgcacaataaatgtaatgtgcttcgatcatcccaaagctgtccccccacccctagatccctagaaaaatagtcttccacaaaaccagtccctgatgccaaaaaggtgggggatcactggtttagttgatagtggtgaaacaatattaccttattagttgtaacaaatgtacaatgattacataagatgtcaacattaggggaagctgggtgagggatatatggaaatctgtgtactatctttgcaacttttctgcagacctactgaaattattccaaaatatcaagtttgttttacaaatttaagaggctcaaagccagagtcactgaggatgagtactaaaaataatgtgagatatgaaatccacctaatgatgaatgaagtatgagtgtgaaactcccctcttcttctattagtagctaaccatgtgattaagctaaactccctgagcctcagttttctcatctctaaatacaggcataattaaatcctcctcatgcaattattataaagatcaaatgagagaacatttaaaatgaacttgcagttagtaaacactcagtgcacaatagttggatttagtcaatggccaagacaaggtaaaagtcaacagttagagattttttaaatagcaactgatctctaccaaggcacctcccaagacttctggacaatgagttttattgcaaggatggagcaagctaacgggcattgccagtcattgcctatcgaggacctctggcaggatgttgaacttagcacaatccacttctcaccttaagtaaacacttcctaattaacatattataattttgagctctctgattcatggaaaatttttcttttcacaattattttcccaagttacttgagttaacagcaaccttactttcctgactaaagtccattttagataagaattgcttcaagggaaagaatcctgattctgtttataacttattttttcttatctttggtgttggagaaataaaaataagcaaaaataagcaaactgacatattcatttatctccccacttccctgcaaatagatagattgcccagcaaattaaatgtcagctaaggaaaccacagctcagagaagttaagcaacctgcccaacaccatgaagctaagagcaaaggagccagaacttgaacctgaccccaggagctgtcctttctcctactatgttgcctgtccactccactggaatcaagttgaaaaatgctagtgaaaccagtatttcccacctggttctccctgccagatcagagccttccagcatggttagatagcatgctggagcttcatcagctctcacatggagacttgtggaattcattttcatccacttctaactttaaaaccaaataagtaccttattttggggtgcagattatagaatcaagcaattccagcaagcctgaacatggagtccttgctcttagagggtctaccttgagctggagccttttaaagagatatcattggctagggctgcctttggctccaccaccaagtgcctggttttttctcatacctcgtaggcaaccctgaattaggatgagtttacagcaccattgcttacttccgagcattcctgaacccttttgctgcccggcattcctgtttttgaattgcatctgtttgtttcaccttcaggaccacctgctttctcaggctggatttcacacttggcactgcttacctcgtagtgatctcagcttctctcttcagctgtaatttactcttggctctcagactacttacccctgactcttccagatatccatctgtctgtctggtcagagccatctcagccctccagactctccctggtaccttctagttcttgacatttctgctggattgtctatacccaaccccccctaaacacatgcatgcacacacacatacacacacacacacacacacacacacacacacagggagctgcctgccttgcaagctctcattagcattaaatgccaagtttcaggaataaccagccttcttggttacaactaaaatggagatcgctgcattaatgcagtaatggaaatataatgaaggaatttattgtccctgaaagacaatatctgccacacaaaccccatgggatatctccagacagtaagtacagctccacgcctctaattctctggcccataattatcttgggaagacggtgaccctgcagttctctctattaagagtatatttccttacaaaatgaactgtgctgtattgaattgcatcattttgatcactagaaattgacatattgggctcattagccaggaagttggatagttaatttatgaggtttctcggagcctgtcccagaccactcattgagggagctaaacagcccacgatgagatagaagaaagttactccagcagagtggctttatttttctctcattacagagataatgaacagaaaacttctctggtacagatattgcttcccaccccttctccccccaaccccaaaatgattttgctttattgcaaccagataccatttgatgggtgaacagtcttattctgctcattagcaccatttttcatttaaaatcttcaactgctgagataaaaagatgatctaagtctttgcctttatctttaatatttaaaactgttcacacaaccttttaaaaatcaaatattgatgctgctacctgttgttcttcaaagtggagcagttatattgcaggcccttcacagtaagcctgcctttattagaaatgagaatggggatgttaaggagacgtttatttccctctctgtggcctctgcccccatccctataggtggagagctaggaagagcatttggttcttaatcaagaaatgtgctgaggcagccacttgaaagcacctagtgggcaggctggcaagaaatacggagatgctaggagcatcctcagggtcgattctgcagaatggtactgggcccttggagtcatgtagcctcctaggctctcagccataggccagcttcctacaacctctgcaacctagattcttggggaaccgcagttgtgggcaatgggatggttccacactgccctctagtgactaggttcagaagctacatgtatcacacagtccattgcattcagcaattcaaggaggacctgccctgtcctgtgtcagggactggggatatggaggtgaaggagacacatagccttttctccaaggatttctcatagtgggacatgggggcagataattacaaagctatgtttatgtgttattacgcttaagttaaggaagtcataggaactcagggaagcatcatcaccaagcctgtggggtttcaaaggactttgaggaggtggtcttgacaaatgagaaggggctttgcaagcctaggaaaaggagatgcagctcagagcctgattgtgaagggcctgttgtgccactacaagattgttggcatgagcagtcaggagacaatgataagagtttcatagagatactgtgtatcatccatttaagatgcacatttttttcatgtttcaacatctctttaggaggcctcctacaaacaatggcatattttattttattttattttatttgtagagtttttttttttttactttcatggtggttcataaaatcaggatatatttcacaacctatggcatatttcaggaaatatggtaaaataagggcttaagttgggccatgtctgggggacagagaggaggggtcagaataagatgagggatagaataagatacattagcagagacagagagaatgggcagattacagagggtttttaggaggtggaatttctttaaattgttgaatgagtgtatgtcagaggtgaagaaggagaagaaggaaaggttactctgctaagtgtgtgtgtgtatataagcaactgaaaggaactcatgaaaataagttttgctgtgagcatttaagttcattgacagtaaaagaggtagggggattgcatagcagaaatgcaccatgaaatcacctcatcgagtggaaatctgagaggcttttcagtggactagaatggtgaatgtgggacggaaagggtgttaaaatgggtcagatgatttcatttggaccctctgggtttatgattgtcttctgtgtatagaaaacaggagcacagaattgcatttaattgtctctaattcatctggtgaacatgctttcctgatattagctggatcaattgtacaaataacttcagaaccactcaatacttttgtcatggatgagatggaaggttccatttgctttcccgtgctggataaccagagagctgattttagggtcattagatggcaataaagactccccacccccacagcacatgctccaccgacttccctcagtaggcatttcactatattaaagacgcaaactggctgatgtaaccattgctttgaagccatgaaatggaatgtcagttgcagaaagtgagccacatatttctgagatattgattattgcaatataaatcttctcacccctaaggtaaaatcctagctggtgctgtgagctacttgataatcatgacattgggcttttcttgggttttgatttttatgttttattcctattaggcaaagaccaggcaagagggagaagaccattgaaagaggtgcggtgggagtggaggtggggatgcacatcacagaggaggcaccaagagtgggggcttgcctcgatatagaaatgtagcaactctggagaattggtgtcacagggcagagcataaaagcaggacattatttcctcggaaaagtgtctttttaaaacatgatttgtttcattttgcagtggaaagggttggacagatgtgcattcaaattctccctccttttcttgctagtgtatgacctgagcaagttatttaacccctcagagtctggtgttccttatttgtgactcagagatagtaatacttcctaccatacagattttggtggaaagtaaataatagaactatgtgaagccctagcaaagaatctgtcacacagtgggtgtttggcacctactgtcaccgatcttctgtgcaaacccctccccgcagctgctcctgttccaatcactctgggaacactggactcatgacaattgccactccctttgtgtgccttatatttgcccattcccaagtcttcactgattttattccctattctaggcatctccagatgcctacatcctacccgtgctcaaagacacatttcaaatgcccactcctctgggaaatgcctgttgtacccctggacacaaatcatctctcctccttagagccaataacccatgctccaacacccatttcaaatgcctactcctccaggaaatgccccagtacccatggacaaaaatcatctctcctccttacagccaatacagcagctcaccaggcatgggctctttcacatgtattatctattacacttacagatctgtggcctatttaccctcactgagcctcagtttcttcatcaaatggtgataataaaaatatccacttcatgaggtagtggcaaggatcaagttgctaatgcatgcatagttgcagccatatagagctctgtagatggtagtgatattgatggattattattattagtatatctagatatgatctctagttagaaaatgcagtctccttggttgcttgcttctagaaaggatgcatgcagtttctagaaactggtgtctttttctatggtcacacctcacttgttaagggcttcagttgtaaatagcatcagtggtaaatccaataataagtgcctgaagggtagagacctgtttggattttggttgtggatgatgtctatatatcagtttaggaccctacgccttgcttccacggcacagcaaatgttcattacacttgcagagccactgagaaatgcaaatacttgaaaactggacagcaatgtgaaataccaaatgcatagtcattaactgacaaaactaggagctttgatgaatagaataaatgattgaccttcaagatgggagcaaggattaggtaatcttgggaggaggaagaagcagtgaaatgaaagcccctgggaattcttccatcatctcccaacaaatatacctgtgaacaaaaggtttcccacttttatgtcatttatcttttcagtttttttaaatgattttcagattcaaccaaattcttaggagagatattaagaggtttataatttagataatgggacacattatgtattcctagtaaatagcactaagctatgcactactgagtttcaacatcaatagattctaactgccaacccaggcaactgtcacttggctgctcccagggtggttggcccataaaacttgcaatatgaatcacacactcaaaaagaaaaaaacctcaacagatagagggctatctgtctgttttgggggtaggaaacaaatataagttactggcattagatgcctaatttattcatggagtgtttaagcctcctcagagcctggtatcctcagcagctgcccagccggccactccttaatatagctgtgttcgcataagggagggcagcttgggaaggaagactgacccgaccaggctgcacttccagtatggcagccactagccacatgccgcgattgaaatgtggtgagttcgaattgtaatgtgttttgagtataaaatacatattaaatttccaagatttatgaaaaatgaatataaaacacctcattcataattattatatcgattacatgttgaaataatattttggatatattgggttacatgaaataaactcctaatgttaatctcactgttttgtttcattaatgtggctactagaaaatttaaaaattacagatgtagcttgccttctgtttcttttggatagctgctgtattggacaggactcttgtagcacacatcccaggttataccatcagatgtgattgtctacagagtctttcatttcattttaaaaatgattctgtttatttttaaaattcaaacaatatgaaagagcacaaaatgaaaagtaagtctcgcatcccatcccctccttttcctgcatttctctctgttcctcctccagaggccatctcccagtgtcctgaatactgccccaaagacatccaagagatgagagatgatgctcctccataccgccaccatctccaccgctccctgctgtcacacacctggcctgtctcactgatttaccctgtctgctgaccactgtggctgtcttcagtgtgtcctagagcacagcagtcatagtgagagagagcctataggggcaaggacaccatgggaaataaatgttacatacttaacttgcatacaatgaaatgacgaatgagcaaagacttactatctaattatcccccaaacatttgctatttctactttgaaaaactggcatcaaggattctgacatctgaccagtgatgaccacacggggaatgttaagaaggatctatggaccctgccagtgtcctgtgtgccactgtgttccacaggcaccccttaaaaggcattttcctctttggagataaaataactggagatcgggagttatttgcctgaagccctgtgaatcagggattgaattaaatgacattaaactagaaataagctttctaaggcaagttttagtatgttaattaaagcagcctaaccttgaattttcgtagtttagggaaaaacagtggcctgaagatgaatcaatgtataacccactacatatatttagaaagagctttagtgctatatctttataattatcaaagcaattccttaaggcacgaagggaggatggagaaaggataaaaaaaaagtcactctatattactgtaccccttccccactgcactgaagaactgtcagactcagctcaaatgaacatcaaaggaagctcaggagaggaagacatcagattcctgagtcccacctcagacctactgaggcagaatggggggtggagcttggaccaggtacccagatgatgctcaaagcaaaaccttatccattttcatccaacaaatggaaaccaaacattgttcaggtgctgagatatggcaggaatcaagactggtaaatagacatccaatcatgcctatattatccttaccaaaaaaaataaatatattaaatatagattattatatataataaaatattaaatattttatatattacatatttacatatattaaatatatttgatatattaaaatatattttaagcacacacacacacacacacacacacacacacagagcaaagaagtgtactcaacccaatcttgatttcggctggcatagatagccaaggtgagcccccaactcatgaaaggagcagcagcacaggcaattccattgggggcatactgctaatcaatcagctggtaccatcttggttccaataactttatccagttggcataagactccagccactcactaagaagtaagaaaaaaaaattgatccagacaaccaacaatgaggggcttgacaagaactctccaggctctccacatgctagtgggctaaggtttaaagccgaattttaacccaggtaaaggaattggagaactaaaccagaaacccacactgaactggggtcatacggattaggcctgcttgttgacacttaagagaagcacagtgaagcataaggagattgactttgaaatcggacagtcttgcattcacagtctggctcttgaacccactggccatatgagctgagcatgtggcaccaccctcttactggaaaatgggaagctcatgctgacctcgaaggttttgtgtcaggatttttaatgttcataaggcagctaagcagacacagaagacaaattaacaaatttaaattttgtttataatactaaattattaaaataacaatattaaactaataaaaccattggttggcagtggtggttcagtaggaaagaaatacatgggactcaccccccggaaacctacataccaggattgtgagggaaaaactcattccagataccactctctgaagtgtgccttcctggtcagaggctgggcagcctgaaataggtgaagggcttcagcgccaatgactacgtgtggcaagaacatgttcagcctaatgccagccatgagcccatggtatccttgggttggatggaggaaagggagcattctcttgatttagcccacgccttagtgaaccaagcaatatctttcacacctgttctctgtgtcttttgtcattaccaagatcaatcaagttgaagagatgcttcactgcaatggtgctacctagcatccctgcagagtgtgcaaataaatcatgtattatttgaagagtcaatattatcaaaaacagattcaatgcttttaataataatatgatttaatataataagcagtgcatgtgatcatttcatctagtttttcagtgtagatgccaaaatcctatcctttttacagaggaaacacaggctgactcagatggataggtaagagaaagatcagcgtaaacttagcattactaagggaaaaaaacccactattttccctgcagggttaagagtagtgggtgagatctcagaagtacatcaactctcctacccaatcccaccaatggtaactcgaagcagatcgctccagtctggttccattttcttatttacctacatctaagccactcttttcctaacagccccagcctacgagctccaaatatttcccttctgctttctttcaaagatgcattgcaaaagaaaaaaaaaaggcctactcctaaagctccacaccctctgccaccatgctcttatctagcctctaatcttttccatttctaatcaatactatgaaagctacatagcataaaacatctggacaaacagtgagaagagcccagtatctagatacatgtcatgtaaatggcaggtccagatgtcaacttgaattgtttctgtttttctataggctatggtagttgtgtatacacacacttattatagtactctagcatttctaactttgagtcagtattcttaggtaccctcagcataagataatttaaaggaaaagcaagagaataagaggagggggaagagtgctacataaagcaagaaacactcagtgggttgatttctaatcttgggtttgctacttgtttgcataatcctggacaactcactcaaccactctgtgtctcagtttcctggtttattgaataagagcttgatgatctctgaagtcctttagctttagaatccatacgcccctaagtttgctaatctgtgtgtctgctatgctgcactgaagccaatgatttgactccagtttttggtactaatttttttttcttgcgtcgatgcttccagagtgcccatgtgagcaggcagcacactggctttttgtattcactctttacaaatcagccctttgatctcttgagctactttgcagaaaactagactaagtggtgttcttaaatctcagactcactaattacattgcaaagaaagcctattacacacctcagcagagtggccagagacatataacaggaaacttcggttgcaaagaaaggtcacctaattcatgacacggccgttgaatcttcttcactgagtggcctcccaacattttgggctcagccacccagttgctcagccaacactaggagaggcaggtatgacccatctctcaactcccagcaagcggggactggaactgccctgccaccctgggtctagaccaggtctggatacattaaacccaacctggcatatccatgcagacatcatattttaattaagaattgatccctaaccccagaagctttttaaaaactacctcatctcatggctgggcacagtggctcacacctgtaatcccaacactttgggaggccaagacgggcggatcatgaggtcaggaaatcaagaccatcctggctaacacggtgaaaccccgtctctactaaaaaatacaaaaaaaaaaagttagccaggcatggtggcgggcgcctgtagtcccagctactccggaggctgaagcaggagaatggcgtgaacccgggaggcggagcttgcagcagtgagccgagatggcgccactgcactccatcctgggcgacagagcaaagactcaaaaaaaaaaaaaaaaacaactacctcatttccccagcactcagcactcttcctaccaacttctgacttcttctcttttaaagagctatagaatgtgcagtcaaataggcctgggctagaattctgggactgccaatttctaactgtggtgctttaagtaaaaatcctttaacccctttgagcttctgtctcctcatatgcagaatatggataatgccttcctcacctgggcagcataagggtgaaatgagatgatgatggaaagggactgagtacacagcccagagtacaccacagtcaagccgctgttgtggatgttgtggtctatcagctcccagcgtgtttatagttatgtatttttatagttatagtaaaagaaaatctgttgattcaagctcattcttgttggttaaaaaaaaaaaaaatctgctgaagaagactgtatcccaaatctcaaaggcaagaatgccggctcttctatgttaccagtgaacagggcccaggtgccaattccatatagaatagtaaataaataaaaaggacattatgaaatttctgaaatgtacatggtcactgagaaatgggagtgcaccctctctacagtgactttgaagctactccttgagaccctgggaagagcatgagcttgggtcatgaagacttgaattctagtcccctcacttattccttttgtatctttgagtagaattcttagccgacctgtacctggttttctaatctaaaaagtggtacaacatctgacacatagtaaatcctccaattagtaggtgtcctccacccttcctttcctaactaactgggttaagaatgcaagtagctcctgtacacgtcagataggccatctcttccttctgcatgactgaaattctatttcctctcagctactccatttttagtgttatatttccatttaagctgtagagaattattttttactatattagaggagatctgagtcagactgccttgagagagaacatatcggaaacctcacataatctttgtgtcacatcaagcaagtagctacttattgaatcttttggaatttctgaaggtaagatttcctctagcttagctttctgcagtaaacatccaccctacaagcgctatctccattaaaccaaaagacctttgacatgtgtattttgtgaattggtctttataaaaagatatacctcttcctctttgttatctcaaaatatgagtttatacaacatctaagacccaaaacaataggggatttacatcaaaataatctccatggtcccatctatactcaaggataaacctgccttgttctttaacaagaaaagttaaattatttctttataattgttctatcattcagatgtacatcttttcaaactggttctccttctatgtgactgacatttggaaaacagtctttgtgtagctgacttttaaaattatgtgatgtaggaaatatatagataaaatgcatatgtgtttgtatcatatataatatacatatgtgtatatataatatatacagatatagataatgtagctatataatatatgcatgtatatatacacacacgcatatttgtattatatatataaccctttatgtgtggtatcagaacaactatttggttaagagctatttgaactgatgtaataaagaaggcaaatagaatttgaaaataagtgtagtggttaattgatgtgttaacttggctgggccatggcactcaaatatttggtcaaacattaattgggatatttctgtgagaatgtctatggatgagataaacatttaaatcagtggaatttgagtaaagcagattgccctgcataaggttgatgggcctcatccaatcagtggaaggcctcaagagatcaaaaagactgacctccctgaatgaaaaggaattctgcagggtaccttcagaggtaaactacagcatcagctcttgcctccagcctgcaggcttttggacttgccaatgtccataattagatgagacaatttcttaaaatctctttattttacgtgatatatatatatatatatatatatatatatatatatatatatatatatcacacacacacagtagtatgtatgtgtgtgtgcgcatgtgttgtctctttattttacccgtctttatacatatatatgtacacacacacacacacacacacacacacacacacactattctgtttctctagagaaccctgagtaaacagtaagtaatcctaaacatcctgagctccaaactactgtgaggctcctacactctcaacccacctcttgaagaaaatgctgtaatattacattgttaaataaccagctgtggctgggagtggtgactcatgcctgtaatcccagcactttgggaggccgaggcaggtggatcacctgaggtcaggagttcgagaccagcctggccaacatggtgaaaccccgtctctactaaaaatataaaaattagctgggcgtgatggcaggtacctgtaatcccagctacttgggaggctgtggagggagaatcacttgaacccgggaggtggaggttgcagtgagccaagatcacgccactgcactccagcctgggcgacagagtgagactccgtatcaaaaaacagaaacaaaaactgcacaacctaataatttccagtggttaaaagcacaggctttagagccaaagatagctgaggtcaagttctggcccccgactgatggcagtttgcttctatggaaagtgccatagaaaccaggtaagacaggtatgccctgtgggaggccttccctccacatatgggtttagcctaatatcttcccactgagaataagcaaatggtgctgggtttggtgagggagaaattgtgatgattaacagagaaaattcaggttcagaatttaccgccaccccctgtggcacccagtaaagttctaaccaagatgccatctttatgaacaggattgtggctgaatttcaaagaatgaaaatttttcctaccttaaaaatgcattgaccaaatttatttccctctaaacatgatagtgtcaccagaatgaaaaaagatgaccccatttattagaggccccaaatcactgactgctgcaaagcactgtgtttgctatgcaaagacatctaattttgcaaaataaatacaccaggcatacaatttttgctttgcaaaagaacatagtgcttctagatggtctcaagttatcaagataatattgattgacatacaacctggacaggcacatctgtggagcacctattacctgcttccctcaatatacgtagctccaaccagtctcaaaccagtatgaattccgcaggtgaggaaattgagggacttccttgaccttcaggtttctcgaagcctcctcctgggatgaacttcagcaggctagcatccaattatagtcctctcttttcctgaaaaagatcccactttttctggaactgcctaagatctgcaaatagagactggagaagaaatgaaaatccccaacatattttttatttacttgttttttattttatttatttatttatttatttttgagatgcagtctcactctgtcacccaggctgcagtgcagtggcgcgatctcagccactgcaacctctgcctcctgggttcaagtgattctcctgcctcagccttccgagtagctgcaggtgcctgctaccacaccccgctaattgtatttttagtagagacggggtttcgccatgttggccaggctggtctcaagcccctgacctcaggtgatccgcctgcctcgacctcccaaaatgttaggattacaggcatgagccaaagtacctggccccccaaagtatttttttttaatctgaaatgagcaaggacacttgcatttgcttacatcgagatcattagtcttggaatcagaagacctgggtttgccacctgccactgtgtgattctggataagttactgaaccttcaccagcccccgcttacttcctttgctggtaaaatggacatcacacccatctcacaccttattttgcagtgaattaaggtaaaacaaaaagaactgtgaggcagccagaggcaacctggatatcccctgcagcttcaacttctccattctgttttgtttcctggtctgtataatataactttttccaacatgctgcgcacccaaatagttcattgaaaacacagtaattagcattcgagataaaatggcactgctgcaatgttaattactgcggtgcagatgtaccctcagatatcatacataacgttgtcaagcctttatttttaaattaaagtgcaacaaaccatgccctggctacacagctttttttgattaatacaaattaatgttatttcggtatctatgggaagagtggggaaaagggggtgttgcatctcgttgtaagaacacataggaaaatgatagcagttatggattgcccataactttgtgcccccattcaggtctctccataatggagtgtgagctccatgatggcagggagagggactggctttgttcaaagtcatactgtccccagctcctagcacactgttaggtgcattgaatgttttgttctgagtaaatggccaagcgaatgaatgaatgaagacagagccatgtatgcagaaggggtctggaagtgagatcgaagaactagaaggcacattggtgtattcctgcttctggtttggggtttgcttcatggccttcaatatgatcttgcattctcctcatgtctagcaccttaaaatccaaaatgagaggccagtgaatcatcacaaggcagaagttagctccagttcttcattatgacatttagcaagcaacattatattccaccaggctctgggaattggggaagacatggggaagaaagatcaacgagaatccttcaatatcacctaggcacccatgccataatagccaagagtaagggaaggaagagaatgaacacgtgtgaccatcacatatattagttaattatcacaacctcgtgagggcaatttttaccaactttttattgttgtaaaatacatatgacatacaatttaccatcttaaccattttaagtgtacaattcaatggtgttaagtacattcatattgttgtacaaccatcaccaccatctgtttccagaactctttttattttgcaaaactgaaactttatactcattaaatactaactctctcttcctccctccctcagtccctggcaatcacgattctactttctgtttctatgattttggctactttagatatagcatacaagtggaatccatttacatttaaagtaattactgataagaagggactttgtcattttgctatttgtttcaatatgccttatagcttttttgtctgccattttcatggaggaaattctgttacctctatggttaagaaaactgaagcttcaagaaattcagtaaactaccctaggtcgcaagaggcagactgagaatcttttgactccagggcccctgatttttccacctacttgtgccagtgtgtttcccaagtactgggaaaattcacacaagcataaaatgtagtcagtgccttgattcaatgggcaataattttcttgagaacattagacagacatagatgaaaggatttctagaagtgttaggaagcccaagatacttgcccaatggcacaaagcatgcatgtcataggaacttggagcaatgttttttgttgccttttataccacagaatgtcactagattgaatcccatggttctgtgcttaatgtcatttgaagggaattacagagatccagccctgctctgtgggatctactccccatagcagatggatgcagcaatacatagtaaatgctgtaataatgtgtacactatttgacctggaatttgcataatgaaatatctctggattcgtgaaaagatttatccatgaggatgtttattacagattttttttacaataatgaaaaagtgaaagggctgtaaagattcaacaatcagctaaacatttttacaaggaaatatgatgtagatatttcaaagtgatattgctaaagaatagttaatgacatggaaatatctatatgttagaataacataaaaagtcatatataatatacatatatgcaagtgaaaagtctatattatatatttataatgcacatatataaaatctcattaaattatgggtctataagtatgagtgtgaaaattatatatatgccaaaatattagtggtgattcctgtttaattgtgaaattgtggtcgatttgctgtcccatatctttcgaaccatataataatgcctatgtattatcttaataattagaaaaaataggttatatttagagatggaagtcacgtctaacacaaatctgtcttgagctattgtactgaaaaggaagttatgggaaatgaaaagttctgattatctcacactaactaaatatacatttatttgaggctggagaacaggagtgaagtcattggcatggatcatttggttgcaaggaatagataacttgaggtttaaaaatgtattggtaaggtgtagaatattagaaagtacagttcaggcctcttgaaggaactagaacgaagagacacaaagatatctgaagcgaagtagttattctccccattccctcccccgttccccagtgtgtggtctcctctgtcaatgttgggacatctgcctcagtcctctctctctgatctgactttctctgcttaacagtatggttggcactcaggcgaccttgcagttcaggaactcaacggagagtttctgttgatagttccagatttcacaggagaaagaagatgactgacttagtgtctatcagttcccttttgctgcataacaaaccaccccaaaatttagagacttaaataatcatttagctccaagcctatgggtcagtggacatttctgacctgggccaggctaagctgatctcagctgggccagtcagctagtggatcagccacagagtagcccgtctagacggcctctcctgggatggctctcctcactgtggccccatcctccagcaggctagcccaggctcatttgcatggtagtttcacggctccacgaagaagtgaagaaaacacgcatgccctcaaggtctactctcaggactagcatgttgtgtgcagcacatgctgttggccaaagtaagtgacaaggccagcccagactcgacgtagagaaatagcctcttatctagatgacagcagttacaaaattacattgttgggagtgtagttatagggaggggaagaattcctgtcatttttgtaaactgcacataatctctaggggcctaggctgacatgagctccatgcagtcgctgcaccacattgccatttccatataatgccattggtcgatgtaccagggaaaggtgagtctggggaatccactatttcaacctggaagtgacacttgtcatgacccctcccaacccatggcccctatcagtcacatgggctccattctacagtaaggtggcaggaaacaaaatgagtcactggaatatttggtgagcattatggtctctgccacagtgaacaactcaagagctaatcattcacaacaccagtgtcagaaaggtggaaaagaggcaggtaaaagatagtgctatagagcacatatatgaaaaccacatctaatgaaggtgtcagaaggtacaggaagcccttcaggaatcactagggctgaaggcttggcccaaagtcagagtaagcaggaagaaaatccaaatagttcagcctcctgtaacccagaaacactccttccagactcattcaaagtctccctaagctctagatcctactcccagagctaagtcaacccaagagagtaagaaagtagagtttcagatgggaatgagtgttctagaatcaattgttgttgaggtcacagtcaggaaaatgaagctgaacatcaagtcccagcaagaaaagaaggaaaaggaatgccaagcagtcatgttagcagtttgaaggggctggagcaagatggaatcaggaataaggagtaagtctaggaatctatgaaattggaagtttgagtgaatccctttagtttaccacttgaggcccacaagctatgaggattctgtgcaatgtctggttgcagggcaggacacaccagataggacgcttgagaattcagacctaggctttccatctcccatgagcgtctgcttctagtcactcattttctcttccctgtctcatttggccttcttaatatctcaccccttgctaactgctttctccaatttctcacagctgagatttagaactcttgcagtatctttccattccaaatccttatagtaagaaggacaaattcattttttataaaatacaatgcacaaaatattaatcacaaatgatgaaaagtctccttcaagttcttacctcaaattcctaagccatcatgtggtttatgcctcacagaaattaccatagatcccacatataccctctggggcagctgccacgccctactccacatgtggatttagcccatcttcccatcaagaggaagcaaaaggtgttgatccaagcaccatgctgggtttggggaggcatagaagaaggagggccttgcttgacctgttgctaattgccttgcaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtatgttagtctgtcaaagtactaaggttaaatgtcaacttataagattgggtgcctgtttgtgtccaagatgggataacataacaaagggattcgctctaatctatgaaatgagaaggcccatgccttctttctccatctgtcttttgcaaattgacatcgaagtcaataacaagcttctagtattttccagggaaggctacaatgaaactagctctttccttctgagacaatgttgcagctctcttgagactcatgtccagtgatatttctagagcattatttcaaccccaaatcctcaccttatatatataatacatctttacttacacctatctgggcgatcagcctctcacgtgtcacatatgatagcacagattccataacttttcttttgaatataatgagtcatatttgcataaaactataacatactgtgaaataagtgtcaggcaactcaatagttttcctgagtttctgcaaaatggaaacgtcactgtgtgccaccatcaacccagacagaactcaggccacagcagagagcccaaccacagtttcatttataggacaagagctacagtttaaacagttgtcatctgtggtgtgacacttcacaagtagggtgtaggtaatttgatctgttttacccccgttatactggagggtgtttatgaactagagatcaggggtccttacaggctaaatgccctgtgactaggtttctgcttaagagtcctcaataactgatgttaggaaggctttgaaattacaaaaatatgtattgcatgtggtgtttttatttttttaaagatcatgtataaatctggccttatttttagtgtgttaaggccaagcactaagaaacagacccacaatcttaatgagtccagcagccagattttaatgtgcatccaaaatgtgtcactaagagcctgcctaggcactcagctagttaccagggatacagagatttaaaaaaagggctcctaccacagaggagctcaaagagtgctacattcaagtcattaaagtataatgtcatgctgtaatggggatgtacaaaggccctggcaaactcaaaggaagaagtggtaaattttgcttgaaggggtcaggagaagcttcacagagaaggtgccccttgaactgggctgtaaagagaggcaatgatgaacaattttaagaccatcagctttggagtccagtgacctgagttttgtagtcttgctttgatacacactgtgtgatcttgggatgttacttgagccttctaaggcacagtttagacacctccattttaaaaattaagtgggattccagatgtaaaaacactgaaagtactcaatgattgataaacaacaatgacaaagcaggaaatgagggctagtgcgagcaaaagccccgaggcatgtcagggcagtgtgtgctagagaagctgcatgatttcatctagcattttatctgtgatctgttaatcatgactctataaacaatagggttgagctgtagtatgggtctccctcctggatctgtagggaaaaaaaatactaggattgattagggatgtctgccaaaggcattgtaatgccaggctcccaagttgcagattctgaactagagtacaacaagaaatgtaatgaaagcaggacagaaagtcacaatttgagcataactgggtactgccggtctgaattagagaatattcaaaattagatgaattcttcctcttaagttattttaaggtttgtaattattttatctgttgacttacttgctcatttttttgtttgctgttatttctttttctcccccatattctgtcatattccagcacctatcacaacactgcttcagagtagaaatatttgttaaatgaataattgataaaatgtagatgtttactaggctaaaatctttacattgtattattctttagtgacacttgtttcttcagtatatgataagggtgctttgtaacttatacgtgaaccacaattttagagtaaatgagtgcttccaaaatccttaagggaaacatatagtaatttgatctcttagtgtatgaattttcctagacctacaccagaccacaggtatcaggtgcaccaaagaatttgcattttaaaagttcccaggagagtctgacgattaggtttgtgaagcacttccacaatggtacattattatgtgttcccagtgaagaaagcaatgagtgaagaaagcatgtaagcagggttgcaaatcacaatgaactgggaagccttgtcaaaatattttcctctcagtccttcccaaaaccaactgaatcagtctcaggatataggatccaggtttgtacatttgtaaaactttccccaagagattttggttagcgaccactgtgacaattttaggtgaaactccgcctgaattatcccagttttctaaacaaaggggacttaatcaacaaaatcacactgctaaaaaggggggaaggcacacacattggtaattgtcccctggaaatggcaaggctgggatgctatctagactaatgagacttggagaacagcttcccaagtagggtggtcacacacacacatccactgctccaatgtaggcttgagcactggcctcagcataggtataatctaccttgccctgggtagatgcagtcatcgtatcacatttctttccaagcctctcaatgtcaggggtctatagacgaactggtatgggtttaggtgcaagagaccagaatttcagagtccccgaaacaatgctatatgcaaagtagtgcgataagcagttgacttttgagatcccatttacggatttcagcaagcaagaagagtttggcatcttctgtgtagcataagggaagacacctatggccaatgggtggtagctacaaaaagatggaattcagctgcatatgtgttctaacgatgaaaacgatacagtgatgaaatgagtttgcctctgaaaattgtgacttcatattactggaattattttatttatttatttatttatttagagagaaagggtcttactctgttacccaggctgaagtacagtggtagcaccatcacagttcactgtaacctctaactcctgggctcaatcaattcttttgtcttggcccccccacaaagtgctaggattataggtgtgatccactgcactcagccccattactggagttattaagcactgaacagaatttggtgactccataaaggtgactcacattcgaatgagcaggggaaactgtcagttttaatgtatcttctgatgctgaaattctatacaatccataattttttttttttttttgagatggagtctcgctgtgtcacccaggctgaagtgcagtgccatgatctcggttcactgcaacctccacctcctgggttcaagcgattctcctacctcagcctctctagtagctgggattacaggtgtgcaccaccacacctggctaatttttttcagtacaggtgaggtttcactatgttggccaggctggtcttgaattcctgacctcaagtgatctgcccacctcggcctcccgaagtgctgagattacaggcgtgagccactgcaccaatccatgattttcttatagaaatttccttcaattgtattctactgaggattagcctcagtaaaagtcaacatatctcaccctgaaggttaactttttaaaaaatgaatttcaacttttattatagattaaagtgtacacatgcaggtttgttatgtgggtagattgcgcgaatctggttaacttaatttttattttgtgctaccttcaaagccacctttggcctctatttttggctatcctttgagaggacccaagtagacacttctagcaagaaagcatgtgtttattttgttgacagtgaatgatcacattgccatctgccctatctatcactgctgatcgtgataagtcaattaatgccaggcattttccttggcacagtgcaacagtcgttatctgaagagctatagattaattgcagtcttgtctagtgaggttattgtaattgatggtaatcatttgctttgttttataaagctgcatggatgtatgacatagtcagcaactgcatttttataaaaattactcatgtcctacacagagaactcctggattccttgttggggattggtgataaatgagcacattcagggattcaaatgtctccatttctttaagaaggaaaaatgaactgtttttaataagtaagacccttagcttgctaatcatgtctaaatggttagattaatgtccagtataaagtaggatatttatgaaaagaagaaaatacattagccagggaaaaaataatatttgaaaagaaacatgccttagattccattgcagtagtgggggctggacaagaagaatcttcctgatttgggatacattagacaagttcatttaaaaatccttccttaagttcttcttttcaagggggcagaagggtacacggagaattgtaccagccacttcatgcaagatctatagccagttcctcctgttaatttcatccactcttcacatgctcttgtgcttctgccatgtggtgggctccgagctaggcatgggccagagtgcagcttctgcccacagatgtgtaaagtctattgagggatgtatattgataataccacataatgtggattatatttgaagcttattccagaaggggattatgaaatagctctcactagatagcattaagcaaagaatgggtgagcagctgtgcaacctgacccacttgctgctccctctgacagcaagatagaaacaccttgaccttgctagctctcagcctctggaatctctgatcctgctcaaaacacatctgagagagggaaaagtccatagctgttgctatggtgatatagataggatgtgtttcattaaaaggggagaattaaagtcatatgtaaaatatggggctttctctcttgctttctctctctctctcagtggctctgaatcagaaaagagaaaacaattatctcagaaccaacaactgaaacaaaacaacagaaaatgcaggccttgtcctcttccaggaatcaattatttgcatccttgagaggctggtttcactaaagcaacacaaatttgtaggaataagcaactaacatcaaattgtcctgaagtgtgctagggtatgaaaagtgctgaggagaacatccttgagagccagggccccattaggcaatgaatggcttgtgaggagtgctcaggcaatgtaattagcactttgctgctctgccacgacctcctggtagagatgctccattgacacaattggagattgagaggaaatgaggattgggatgtataaggacaggtacatggacaatacatatggaagtgctacttatatgccatggtgaagctgctccctctactctgaatgccagccccatctcccttcccccatccaccacagttccccatcatagcttcccaagcccctttctctcctcccagacaggaaggtgctgcctccttttgacttccagaggatcctgtgtattcatctattacaggggtttacaaaccataccctgtggaccaagtccagcctaggagctaagaatggtttacatttttaaaggatgctattaaaaagagagaaactgaccgaccacatgcagcttgcagaagccaaaatatttactacctggcctttttagctgaccccaatctattatgttgcccatcactgtgggttttgtaactgtttaatctcacttctattggaaccatagtcctttgttgatgggaattttatattgatcattgctgtgttcccaacacctcatacattgtctggacttgaggatagtcaataaatatttactgaatgagggaataaatgaccttggtaaacctcttaaggacaagacctattcatctttgcatgccatgcacctagcacagtgcctgacatacagtcagtgcttaagtggtgtttgtggaatgagtcattaaaccactgaatcaacaactcagtcaaccatttgtgtcccaggaacaaaaatcttataggcatttttttccctgaaattctaaagtatgttgcctccattcactatacagaaatatacagccccatttaacttgaagatggagtgtttatatgaaggctacccaaagcattaaattccattagaaactgtaaaagaggaagagtggttcagtttgcagttactactaagacatgttctggaatttctctgggaaagaaatatgctttcagaaattcaaaatgtatttagaaggcaccccacctagccctatcccaaatgtggtaaaggacacaaaaggattgaacaattaagcgctaccctggagggatttaagagccactggaaggacaaggcacagacttgagttagttactgtgcagcacaatctagagctcacccagtcatgcccataggtggctgcagaatctcactgccaacacttggccactgttcacatgctttgtggtttaccttcattcattcatccagttaacaaatattgattgtctattatgtgctacagtgaataaaacaaataaaaatgtctacctgtaaggtgcttatagtctagcggggggagacagataataaataataaacataataaatgagtaaatttacatgtaaatttagaatatgataaatgctatggagagagaactagagcaaaacaagagagatcagagaatgaggagtggaaggagtgagctacaagtttaaatagtgtggccagtataggcctcagtgagaagatgacatttgtgaggttgccagggagatgtctggggaaggacattccaggcagaggcaatcgccagtaccatgattttgaagtgggagggagctgtgagcatgcaaggaagagcggaagcagcatgagcacatgtgtgagtgatggggaaggaggtcggagaggtcagagcagggccagaggctgctgcagaccacgtgggtcctctctatgtgcactttgtatggactttggtttttactctgaataaattccaaagcacagagacagaaattctcccatttgatcataaacctcaaggcggttgctctcaatgttaccaccttcttggggaaacaaaggcccaagaccatccaggcaataaataaccaagattggacttagttcgggtcttctgattcataacactgcctaatatagcccacaatttatccataaacccaatacgaatgattacgcatctgctctgggccctagcttggtagggaaattcaaagactgataggccatagtgcctacctgtaaggagcctacagtatagtagaggatcctgtctttccaatcagactgttaactccctacagtcacagagtatgttgtagtttttaaatatctccccatacacataatgggcacagggtacgtattgctgagtagagattaaatgagtaaatgaagataatttaagaatgtagctttcaaagtacctagattatacccaatagatcatgaattaaattgtatagtcataatggcaaacctaataaagttgtcaatattaacagaggttctagaattttttatgttaaattattcacaaatacaaggtaagtaaattcggagtacctgggagaaataatggaacaattgagaacctgtgtaccagaaaaattcatttagattcctcatttcagccctggaattactcctaggatcagactaaggagctttgccaatgctagacatcaaatttctagattctaagagccagtcccaccagagtgagcaaactggccttcgagaagcaaagcagaggcagaagctcagatggtggtagggcacattacagcaataccagcaagcatatgatgactctgatctaaggagaggaagttctccctctggacatttttataattacttctgggaaagcacagcccaatcaagtcagcagttcctgaattgccagtattggatagtcactagtgcagcctaagagagagggcattgcattagaagacagcctcctgcggtcaactcattatcccattgactccagcctaatctgcatcataactctggcctggacccccaggatggcatatgacagccaccatcctcctccacttgactctgatctccctgctgatgcttcatcggaagaaaggaggaaggtgttacattacaaaagacaatattaaagacaggcattaactggaatttgatcagggttctgcctcagacctgtcaccatggagaccatggctattatcattttacaagtgttgaatgaggccttcgtttatttagtaaccagtgacactgcagttacaggcatgagtaccgctcacaacatttccgtgaactagctgtgttttttaactcatttccaacgctgcaggaataaaatcaatttgaaaaagaggtgttaaataagaatgacctatattcgttgggactctgatactatcagtggccaatgaaaatttgtagaggttccacgaaaggtcacatctctcacttccagacatagacctggacttggaaaggacaagtctactccaagtgtccatctaaagtgacagtgtcagaggaggaacttttgaggccatctcttccagcataccccctgtgtgtacaaaggaaaaatcaaatgccagaaagggcaagagacctgcccaaggtcacagagatttagcggcagaattaggaccagaacccaagtttcctgactcttaattggggatttttaactttttaaataaaatttagaattctgtcaaatcccaagattcaaaaaaccttcttaggtcacctggtttagtcacctcatagagcaaatagagcctgagaatcacatttcctgcatttgtgagcacagccccatcgcaagggcatctatagagtcagcctcaaaacagcaaagacattgggagattatttcacaaaacataagccatgatgagcatccacaaggaagtggatctagaaatcaccaaatcacccctgagaaaagaccaccaatgtgagagcgagccataatagtgcctgattgagataaatgtgagaattaaagattggaagactaaaatatagtgtcttaaatgttcttccttggtctcaatatgaaaaggcaatcatactattgcattaagaacctaagaacagaagcaatgcttttgtgcagtttaaatctcccccgcccacattcccccataaccctccagaacagttcagtaatattaaatataagtaatccagataatattgctaaattaaatcattcgatgtctagctgctccatggatgtgctgctctacaattcaaaataaggccatttaaaaccaccggatccatttgcactgacatatcgataaacttttgctgaaacaaagctaatcatttcaatggtgccaacttaattgctcgccagttgacagataataaacagacctgaggattaaaatatgaactaattactgtactcaattccatttacttgatttcatgttccattaattttttgcatcatttctggtggaagccttagatttatggttgccccaaatgaattatgccacttagttgcctgtgccatgctcatattcagaattggttggaaagggcagaattctgggcagtaaatatttagccgaagcagcctaggatatagtaagtgaaggtgattatccattcccaaataccagccacagtcagcctctataaatctatccccatctctgcagtaaaagggcaacagtagggttactgtcatgattattcattggatctgctggtgagaggcacactccaagagcaatggttggcttggcctggaaggggggctgtagggaagcagggacaaacacactaagggaaggacaatggcctaagagttggacacttgggccaccagacagaaggcaacattttgacttagaagatctgacttcagcactcctctctgccacttattggctgtgtgatcttggaaaaggcagaattcagtaaactgctttggctttttgagtctcttaaactgggagatggagctaattgtgctggttctatatatatattatagggtaattgtgcaatgcaaagaaaactcttctgtgatagggctttttaagccataaagtgctgtacaagtcagttagttattggctagccaataactaagttctaaggttcaccttagaactcatctagcccaaactgaagataagatacattagcataaccacggtgaactaaaatgacttctaccatcagctgtaatttattgagcatgtactgtgtctcaggcattgtgcttagggccttatcacacccagtcctcacaataagcttttgagctagcacttattagcaccattttatattcaaggaacagaaacctcgagaggttaaagaacctgctttcagttgcatggttggtccagggaagagaacccaggtctctgactccagctatgcactgagtgaccttagacagtcaccttacctctctggctctgccactaagtagctgcttgatcctgggtaagtccattcttctaatcataagtgcctgattgtgttacctgagatgatcttccagttcctctcaattctgcatcagccttaagaacagtctgcactgtttctagctgtaaagtgagacaggagcctatttctccaagtagtacagcagcggtgtgaaatatgacacagcatcattctgtgttcctgcggaggaccttcattccttcattcaccttctcctcccagatggacagctactgggaagttacagttcccagatggaagctactgtacatgcagatgtacagttacattttttctctcttctttataacaagcaaggcattttatgtgtgtaaatttgtgtataaacacatctgtttgcctctgcaaagcacaagaaaccatattccttagtctcagaggtagcttgggtgaattcgtcatcttgctttggatctatttgctgagctagaaatttctggactcagccttggaaatgaatcctgcaggagctatttggcaaaatgagcttagccaggaggttttaaatcacactcccagccaggaaaaaggggaaggcccaggggccaccagatatctgcatcaggacttagcatcctggcaccagtttttcaaatcaagtaattgtgtctgctttgggaaagactaattgtgtgtggactcaaatggtcatcccggaacagctgctgtttctgtaaagtcctctgtgggggtcaagcattttctacctgttgcagctgcctctctagggctaatgtgttcccatgacccaggttaagggccatgacctacttgcatgagcagctgttaattgtggaagtgaaaattgatggaattattcattcctgtgtttgaatcctggctctatcagctgtgaccctaggcaatttattcaacctccttgtgccccaatttcctcattaatgggacaaatatgagtgatgtccattctacagggtggtttcccccagttttgttgaggtatggtttgcatacaaaaaaaatttaagaatttaaactgtacaatatgatgctttttcacaaatacatagttgtgtaaccatgaccaaaatggtctagaacgcttccatcaacccaaaaagtttctgtgttcttctgtagtccttccctcctaccctagccccggcaatcactgatttgcaatcactagagttttgcctttcctggatttcaatccgtggacttatacagtatatagtctttttttttttactttgttttttaagttatacagtagaattaacttttttattttggcataaagttctctgaagtttaacaggtatatagatttggatgaccatcagcacaatcaggagacagaacagtttcactttgcagagtagttttatggattaaggggatcaatgtataaaaagtgctcagaatagttgtttgcacagaatgagtgctcaaaaatggttgtttttattagcaatgacatgcttcttcaagctgcatcatctgtggttcacatttttttccaaataatttcaacttttattttagattcggggtggggggtacatgttcgtgtttgttgcttgggtatatctcgcgatgctgaggtttgggatacagatgatcccatcacccaggtactgagcatagtacccatcagtcagttcttcaacgcttgcttccctctctccctgcccctccagtagtcctcagtgtctgtcggtgccattgagtacccaacgtttagctcccacttatgagtgagaacaggcagtatttgattttctgttcctacattaattcacttaggataatggcctccagctgcatccatgttactgcaaaagacatgattctgttcttttttatggctgtgtaatattccacattgcatatatacagggtcagcatttctatcctccatccatatctaacaagaatccagagtagcacccatgcagaaggtgaaattcttaaaaattacatgagcagttgtgagttggttcctgaaacccttattctaagaagatgggttaagggcccttctaatgctgttttcttatcagtgtcaaggcatcctgctgtaaggctgccaggagaaaaagcctcctccttctttcccttttgccttccgccatgggatgacacagcattcctcccctccagaggatgcagcctccaccagagaactgagcctgctggtgtgttgatcttggactccccatcctccagaacggtgaaaaataaatttctgctctttataaattaccccatctcagatattctgatgaatggactaagacattcactcaggcctgcagaagacagtcaagcccctactaaccacacttaattgtggagaaaacccatcagcctgaggtcctgcaaggaatcgccctcccattcctggcctccaggtggtgcccttccctgcccccagatggcagtttattattgcaaagaagacccgcaaatagaatattcctcattccttgtgagtttgaagcaaagccctgagctgtctaaataggatgatcacctgccctgccttgcccgaacagtccagtctgacaccagttaagtcctggtataactgtaatattatagtacatcctttcaccttcaaaagtcctccagtttgcacaatgaatcatatgctcaccctacgactaggtgacctttggcaagccacttaatctctctagatctcttttccttcatccagaaatgaaaggactagagtagctcttccagcaccaagaggcctatggaagtaaaatcttcttgcacaagtttgccatcacgtataaaccattgattaaggagtcatgatgctatcttgagagtcagaaacattgatgtgtaataaattatttgtgttacattggaaccccccccccccaaccaaagattgagtacacactttgtaaccatcctcatacctcctttaaggtaaaatcttgggaaattaagacatttgatgaaaaagtaaagctcagattgttctgctcacttggatctgcgaccttttcttgtcgcaatattgaacctcctgctcctgccactaccatactagtagctttcacacacacaaaccccatcacacctcagtcattttgcacctcccaggtaaaacgcccctgtgattaataaggtattttactagaaactctaggttccccttgaaccattttgctttgtagaattaattacaagttaaatgatttctttgcattgaacacccctaggaagcaaccccaggaatttatcagcatcatctacttaggttttgtttcaattctggtctttagagagccgaaacagtaagaagattctgtcacctccaactcctccgtgaatcctattggtgtcggcatttagcctcctttgccatcaaacaaaagagagaatgtttctgctccaaaaagcagttgcaagctttgcttttaaaacctcaggggcatccaaacactcaatcctacaaagctctagtgccgcttctggagtattcatttagcttgatttacattattttaattttcttaggggtgtctttactagctggagggtgatatttcccccttaattaaagaacaagttgattccaaagcactcaaaacaagcccctttcaaatcctgtctcgcttgtcactttctcctgctgttccctgtcttctgagtgcttttcagcttcccagcctccctgccttctcaaactggaaacgagacggaacaacagtgaggcgaagcgtggctttcaatggagccagccagcccttggctttaattcatctaattccctggagcgtgtggcaatttggggaggaccaggtagtgttattgctatctcatagaaaagctatattaagttagtaaaattcaacaaaaattcatataactaagccaggaactgtgctaccttagggctgcacccaagaacaaatcctgccactgtcctctgggggctctagttcctgacggcatcttaggtaaagtgctttggggggcaagtaacagaaacgcactcaaatggggttaaactaaaagggggatttactagaatacctttgggatatgtcatagaactcaagggtaactggacaaatgaaggaactggaagccaaaactgaaacaaggttataagccagggactcactcctactccattgcccatctctgcatgacggccttattctcaattctccccatgagctgtcttttttttattttttattttctgtgtatatagagggcagaaatggtcccacttcagctcccaagtttatgttcctttggcgcaagaccttcttgtactgactagctgtctggctctttatcccaattccacattctccaaagaagaaatttggttttccccgagaggatctgatgtcctctctgacccaatcagctatccatgtgggatgaggtagataaataggtcttggttacctgcctgtatggtggggagaacagttatctggtgaaggcagacactgtcggttatgcagacaccctaaaagatgtctgccacagtgggaagatagacagttctattcagatcagcctgacaaaattcacaagctcaagtgctgttgacacatccgactcaaattagggggatggagaaggctttctgacataagccggatcttgaaagagaagcatgaacataactgaaataggataaaagcatcccagacaaacaggagtgtcacccattaatagaaagaataactataagcaatccataatgtacactcaaagaatttagcatcttgtaattgagtgtcacaacagtcttcctcatcacagggactcagtggcacatcacagccatgtgactcatcttcctggctgctaacattgttctccctctccttcgtttctgccagtcaatgtaaaaatcacagggtgggctcagatgagttgctcaggcgttaacattagcttcaagcaagcacatttgaatgacagctctaccacctactgtgtgccttctgataagttatctaggctcttcctgagtgagaagaatggtaataataataataatgatgtcaacctcaaagggctgttgttgggataaaatgagttagtatgagataaccttagcactggatctggcacagagtgctagcactttgggaggctgaggcaggcaaatcacttgaggccaggagttcgagaccagcctggccaacatgttgaaaccctgtctctactaaaaatacaattagcccggtgtggtggtgggtgtctgtaatcccagctactcgggaggctgaggcacaagaattgcttgaatccaggaggtggaggttgtaacaagccaagatcttgccaccatactccagcctcggcaacagagtgagaccctgtctcaaaataaataaataaataaatcttttttttttttttttttttaccagcccctttcctctgtgtcttttccagtagtaggctgatgagatgtcatagattttaaaaatgcggactttaggtatgtggtctaacatagggacagaatagttaaaacaaggactccccccaccaccaaaggaagttttctaacataattgtccatcagatatgtccacatctcttgtctccctgtcagtttctagaactcagagcaaaaagaattgtttatattgttccagattactcattgaccagaatccatttccctttctttttttcttgagacggagtctcgtcctgtcgccaggctggagtgcagtggtacaatctcggctcactgcaacctccacctcccgggttcaagtgattctcctgcctcagcctccagagtagctgaaactacaggcacatgccaccatgcccagctaatttttgtatttttagtagagatggggtttcaccatgttggccacgatggtctccatctcttgacctcatgatctacccaccttggcctcccaaagtgctgggattacaggcataagccactgtgcctggccccatttccctttcttgatatggagcctgttaggtgtgcaccatcatgttcagccaatctttctagctccctgtcatccacacccagtcagggaccgtcttatccgggcaaaggagattggtctataacaactctatttagtatcggtcctttccaaggtactaaaacaacccaagcacttttttttttttttatccctgtgttgacttatctttttaacagtcccagatgtaggacactttccaaaaaccttttgaatatttaagtctgagatatccccactgggatagttttcccattattaatgttttgaaaaatgtcaacaggttagaaacacatagctttcttgcacagaggctaagcttcatcaacattgcaggttatattatttaatttttgtgctcattttaattaaaagtttagttacagtggacctttaatatggaagatgcatttttttcatactggcatgtatttgatttcttttctaaaggaaaaagaatgtttgcttgagttcagagctggggtcagggtttaatttacaaaaccactactttcttagctatagcatgactcgctttattgcaaacacatgttaattcctttaacctcccttaagtccctgttgattttctggccacatttacaaaacatttctatgaggaaataatgcccaaaaagtgtagaaaaggaatccaactaaggaaaatagattcctacattacagtctgaccagtgtctctgatgccttcctcatcaaagaaacagaagaatgactaatccaaaataatgaataatccaaaactctgtataatgaataatattaattcctcacagatacctatttgagttcctactgtgtgaattattttgccaatctctaggttcaattatgagtaattcataattcttgccctcagggagcttccattctagtaaggagatatttacagtctttctttgctgatgttgtgctaggagaaggcactgtctacaataggagtcctccacactggagccactgctagaggattgtgggtacatccagattgcttagacttgactcttggctctgctcctggtactagccttaggaaagttatttaccactccctgcctcagtttactcatctgtaaaatgagaattattgtggtactaacttaggcctcactgatgcattttctatgctgattcattggccatttaggagagattcctattcaagacttatttccctttatctgaccacatggattgacttgccttttattttctctgaaaagaaatgcaacctcaatatccacatccacctcattagagaaagcagagatgtatgaggtttagtagaaactatatgatatcatataactcatgccagctggtaggaggcatgatgcatatgcctctttagtcaccagcaaatgaagagggagcagaagaatttgctaatacctgaaatttaggcagtgtctaaagcgtggagcaaaggaattgattgcttgtcaacttggcagtgataactgtcagaaaaaaacaaccttaaggagatgggtgctaaagagtcacagttgcctattggcttttcaagcatgcccagttagcttaagaaagtttccaagcccatatgaaaagtccatatgcagtgggcttccctctaacccacgtgccaatacttctagggactggggcacctactcactcactgtgtgtttgtttgtgtgtgtgcatgtgtgtgtggtgatacacacacacacacaaaaaagtttaagcatctgaaaagatgacattgaataaaaccttagagaagtgagggagatgaccatgagcgtaaaaaggagaacagtttctccataaggagctgccagcaccaaggcctaagtgtggagtgtgcttggtgtgtttgaggaatagcaaggtgtagggtggggctagaggtcaaatgggggacagattgtgcagattgtgtgggccagtgttgggactgtggctttccctctggtggaacgggagtcactggagggttttgaaaaggggagaggcatggtctgatcatgccaagtttgctcctgcactggaagctgttccctctctctagcatgctcctccccctggtcttttcatggccaactccttattatttggatatcagctgaaactgtccctaaccacccagtcactcacaatcacatcacttagttttgattctctgctcaaaactgatcattcattgataatttttcatgtttatttactccattattttctatctccttttacttaaaagcaagctctgctaattcccctcctcttcagtgtggtgggcaggacttagtaacttccttccaaagaaaagcaaatggaaaataatatcttcacagagaaggaacctggcagacaccacctgggccaagtgatcaaagctaactgcaccagggacgtcttgtggatattgggtacctctgatgcgaagagaagggcactttcccctgtgatatgtatccaaaaatccataagcccagaataattgtaagagagcatcagacaaacataaactgagggacattctacaaaatatctgataagtacccgtcaaaagtgtgaagatcgtgaaaagcaaggaaagactgaggatctatcacagattggaggagactgaatagagatgacaactaattgtatgtgagatcctggattatatcctgcaacagaaaaaggacagtagtagaaaaagtagtagaaactgaacatagtctctaatttagttcatagtgttgtgccaatgttaacttcttagtttcaataaaaaaaaaaagttaagggaagatggatgaaagttatatgcaaacttcctgtactatcttaactcttctacagatcaaaattatttcaaaataaaaagtatttaaaggtctggcacagtggcttacacctataatcccagaaattttggaggctaaggcagggatcacttgagcccaggagttcaagaccagcctaggtaacatagcaagaccttgtctctaccaaacaacaacaacaaaaaattagctgggtgtggtggcatgcacctgtagtctcagctactcaagggactgaggtgggaagattgcttgagcccaagtgttcaaggctgcagtgaactatgatcatgccactgcattccagcataggtgacagtgagaccccgtccttaaaaaaatttttttaagtctttaaaaaaaaaaagttctgcaaaagtcttttatttttaaaaaagaaagttctgcaataacaggggcatcgtctgtcttttttcactgctgtgttcctaatgtttagaatcataataggcactcaataaatatttgataaataaataggatggacatgaagtaaaatcagtgatagcatctttaaaaaaattaatgaagcatttaaagtgctttatcaaactcaaagtactttgcaagttgctatttacaaatgtaaggaaatatcattattatcctattttgatttttagaataggagaaggactgcccacttcctgaggcatagctgtaaaaagtgacagcttagcccaggacccacatgagccactgtatgtgatcaaggcatttctgggcatcactcacatggagccatctctgttcataaagatcttctgaatcaaaggctctgagacaaaagaaacttcattttaaagtaaaaaaaaaaatcgtcttggtgacatctcattaatctgggttcattaaaaatgtgtgggatacccctcctactccacaggtgattattactctgaaaacactcatcagagatggggggaagacctttcctcctgaagaattaaaagtgaaagcaggagattacatcctctccactcccttcctcctcacccccgacaaatgccaactgctctgtgaaaggtgtcctcagaaggctctggtaggagatagtccattgctgaggagtctccacttttgaaaatacaaacttgcctcccccaagatggtgtggaggcaacagggagagagatgaagaggtttagcaaatagctgaagagtgggtggcattgagacaaggctgcaattgacatgcatcacacacccatgatgtccatctatccagctgcctacaacaaacagggaagcagctgatgaaaccagcaggccactaactgagaatcagaagacctgagttctgatcccacctgtgccaccaaatgatttcattaaagttcatttcccctttctgagcctcttgtttgtcaaatgagggcagttctctgaaaaatctctaaagtctttttctggctcattctagatacatgttaaatatttttaagtactctgttctatgcttgtcatagtaggggaacagaatatatatagaatatgctctgtgctttccaaaggctaccagtatagttaaggggaaaaaatagatatccattggagagttaagtaacaacacaaggcctagttgattaagtatagacagataatgctacagatttttttatatatattttaaaaattttcaactggcaaatttaaaatgtatttatttttggtgtataacatgttttgaaatatgcttattttgtggatgggttaaatcagtctaattaacacgtacatcatcttgcacacttatcgttttcttgtggtgagaatacttaaaaatctactcgctcagcaactttgaagtatacagtgcagtatgttgttattaactacagtcactgtgttatacaatagatctcttgaacttattcctcctatctaaactgaaattttgaatcctttgaccaacatcaggattattttaaaaggagagcaaggggttacctggaatagtgtagatcagcctctcagagaaagtgggactcgtgctggacttaaaggaggcatcacatttacataaacagagaatgagtatttcccagtttcttctctgaaaaccacgtttatccaggcctttgcataggcattcatctgcccagaacgctccatcctcctgccctgtttgcctatcaaatcctacttctctttcaagattcagtttaaatgtgcacctgagctatgaagacttctccaaccccaccagcatcactactttcactccccgacaggtgaatgactctttggggctctggcagaatgtgtaagtgtgttctcattacacttcacatttttttgtacctagagggtcttcccacccccaagacagttcagggttcctgtctcgcttagaacacagtgtccagcatagagtaggcactcaataaataatgaatgcacaagtgcacacatatatgtataaagagcaagcccagggcccattacagctgactgtgaacatctgccttctactcaagcctgagaaacaagcatgtgggatgggtgcagagaaagggcagagaaatctcaagagaaaaagggtctctctcagtgagctgacacacccccccaggatgctggagaaggagagagaaaccaaaaatcattctttatcaatcagccagcaagtggccactgggtacctccctttgccctctcccacatcctagggatgtgtggagacacccaagagggctgcactgctggccctgccacagagagggttactgggaaagctttccttgccttgttgatatgctgggccactagtggtacacacttccctccctgaaaagtaagtggctcacgctgatgtaaccttgacatttagtgaaactaaaaaagaggaaggtgtgcattctattaaagttcaagccgacagcaatgagaaaaccaagaaaccaagccaacttactggtcctttctcatatgggttattcaaaagctattttcaaaggggctccggcccactcatcaatccttggcctgtccaggtgcaaataaagagaagcacaccagctggtcacagcaacttgtgtcctgtcctgtgcagaagccactgagatatctacatggagcaggggctttggaatcagattacagtcctgtcatttactgattgtgtggccttagacttcacctcttcgagtctcaggctgactatttgtgaaattggatataattccttttttgctggctcattataaggaatgcatatggtgactgttgaggaccataaaactgctcctaccagagctggctccttgtaggcactcaacagtgaaaactgttatgactacattagctattactatgccctttatcttcaggtatttactgagcggccagtagactcacaccaatgtgctgcgccctggggaagcacaaagatatttaagaggggaattgcatggaaggaatggaattttccctgggtcttcagggataggcatggtttagtttcattctcaagtcaggaagagaaatactctcttttacattgtattttcagttgcaaaccttcatctctttagagagcagataattgtttttccacattgcacagatatcataatgatattctgagaaaacaaaatttaaaaaaaggaaaaatttacccaccgttttccaccccaacaaatcaaagctgcttttgatttctgaagttcagagtgagtgcagttttattaagcaaagacagagtgaggaataacttttcattcagaagtggttgggcctcttttacctcatccaaagcatggaaattctagcccatcttatacttttgttggcaactgccggtgtttatagtgagcccattctgaacattcaggttatttgaaagtgcatatcccaactagaccctcctaagcacatatatggaaaagtttccttaagcaggaaataagcaggcagaaccaaatagcctcaatacatctcccaaccaaggaatgtcacttattttggcaatatttcatattccatccattacagaattcatgagaatgggtgtgtctgccactctgcaaggacagtaatagaaactgcacttgctggaagttctttctttcatttaaaataactgtttactgaatctcacactttctaattctatccaaaacctcattcctctccagccccctcaaaattccaaacttccagtcccccctcatcctcctgattactatttgtcaggcctgttcatctgccctgcagcaccgttgggagccagaacccagggcaagggatgtcagagcccttggcttctctcgcaggtgcccagggcaatgccaggtaccccatgggcacccagtaaacatgggctggctggctgcagtggtgccccagctaatgagtgcaaggcttttaatctgtactcagaaatgtgaggacagatggaaaagagggcagaggggaaaaacagcttcacactgaagtccagatagcattgcacagcgcatgcagcagacatgaaggattctgatttcggcaaagataaaagggtcagcaagcatgctatctgaatgacaagtaggctaaaaaagatttcagtctaattctgctttttccccatcaaaggaaagatgaactgagtttcaaaaagcttccccagagaccatatgtatgtcattccttgatattatacaatgttatttccctaaagtgtgtgtctttcccatagatgatatctgcgggagcactcagtagatgccgtcttgtcctgcatggtacccatcaccacatcccaggcaccaatcccaggcaccagtagcacttaccaagtgttcacatcctaggttctgaaccacgtttctcatacggaatccatccttttcttgaaccttttggcttcaacttcatgattcatcctccaatttcatccctagcctcaccttttgaacttgacattcagcgctaatttttagctgtaaccttgatcctccctgtcacagttcaagttctcccaccaactacatgtgctagtctaggttgagtaagcacatgcccaggattgactcatccctcacattcttctttccttgggctcttattgggcaactgtcccatttggtccagtcccacacatgggaagcaggcagcatcttgaaaggctcattaataaagctgagtgttgttggtctaattacacttttccaatctttgcctcaacaggagggaaactaacttgaggaggagtctatattttacagacagtggtattggcagggacgggggatggtaaaccctagatttgctatgaagaaaatctgcactgggggcctagatgatataaccaaaggagaaagtaccaaagtaagaagacaaatgggtttttaacccagttctaccagtgaccatgtggctttgggcaaatcacttcctgatccaggcttcattttcccttcataaaatggagggattttgccacatgatctcccaaatgccctccaggtttaatatgctttgattcttttactgtagtctgtctttctgagattccattctctcatttggaaaatagtgataatatgtctagttgaaatgtcctcccaaggctaatgtgagtgtcaaataagaaactgtatgaaagtccatggcacactgttaattttggtaaaggagcaaggggacagggggccctgaggccatcacacaacctactgtttagcagagttacttacatgagctgtgactgcaaaaatatatccctctttctcatttcttcaattaaagaaaacttagaaaacacatgaaatagaaccagattacaggatacccatatcagtcctgttgaaaagatgcttcttaagggtaaaatgtcacacacacctacaaatttgcaatggaccttaatgttggagcaaggaggtgggccactggaattaggccagatcattgaagtggctggggaggcatgagggagaataagcattcatacagtgctattgccttctagtcactctcggtgcattagacaattcagctgtctctgaaatcatgctgtaaaagcataattcattattattattattatatgttttttaacaccagcaaattctccagttctccaaacaccagctgacggttctacaatttaattcaattctaagatttatctacctaaagttaacatcagatcgcaagagttaaagtgtttagttacatcagactcctcctacttcagaggccaatcataagtctaggcctcaaactgactaagcaactataaatcctacaacccctcttcatgtttgataatttgctagaatgactcacagaactcaaggaaacataataactctggtttattataaaggatacaactcaggagcagcgacatggaacaggtacacagtgtaaggttgcagcaggactagggcaggggcgaggaatatgcagaatatgcatgaagcttctaggccttctttgggtgcaccaccgtctcagcacctcaatatgttcaccaatcgggaagctcatcaaatctcgcgaagactttttttaaaaataattatgacccctcaccagatggataggatttttttttttaattcatacatcttaaagtttattttcaactggccaggtgcggtggctcacgcttgtaatcccaacactttgggaagccaaagtgggcagatcacttgagctcaggagttcgagaatagcctggccagcaagtgaaacccatctctactaaaaatagaaaaattagctaggtgtggtggcaggcgcctgtgtaatcccagttacttggaaggttgaggcaggagaatcacctgaacctaggaggtagaggttgcagtgagccactgcactctagcctgagtgacagaacgagattctgtctcaaaaataaataaaataaagtttatttatttttgagatgaagtctcactctggcccccaggctgcagtgcaatggcatgatctcagttcaccgcaacctccacctcccaggttcaagtgattctccagcctcagcctccccagtagctgggatcacaggctcgcgccaccatgccaggctaatttttttgtatttttagtagagacggggtttcgccatgttggccaggctggtctcaaactcctgaccttaggtgatccgtccacctcagcctcccaaagtgctgggattacaggcatgagccaccacgcccagcctaataaagtttatgtttaactgacaaataataattgtgtatatatgtgggatacaatgtgatgttttgatctaggcatacattgtagaaagagtaaatcaagctaattgacatatccatcacctcacatcatttttttatggtgagaatgttaacaatctattagcaattttaaagtatacatacattattattaactgtggtcaccatagagcagagcataatagatcactaaaacctattccttcagtctacctgaaattttctaccctttctccttccctctctccaccaacctctggtaactacctttctactctgtttctatgacactgactttttagattgtacatataggtgagatcagttggtattcatcattctgtgcctggcttatttcagttagcataatgtcctccagttccatccatgttgttgcaaaacacataatttccttcctttttaaggctgtatagtattccattgtgtatatataccatattttctttatgtgttgatggacatttgttgttcaagactttttatagagcttatatctccagttttcagactggtggatgggactgaagtttcaaccctctactgagttggttctggtgaccagcctcttcctgaggctatctagggtccccaccttaagtcacctcattagcataaactcagatatgattaaaagtgttcattatgaataacaaaagatactcttattcaggcatgtccactgcttccagtatataatactgtgctataaaaggaagtgcagaagacttcctcactgcagtaggtttccaaagatggcaggaacctattgcatagattactcaatagaataattcattctagatgtcccatcctacttaagattcctcctgcctacatattccaggccagaaatcccaagagttttagaaattctgtggcaagaaccacagacaaaaaccaaataatatttcttattataccacaattattattactcttagtattattatcatcctttcagtgctggaaaaccagggttcagagattttatgcctattatgttctagagttgagcaccaaactccagcctatctggatcaaagcccacttcattgcctccttaaaaggctgcaaaagttttttgttttgttttgtttttttgtgacaggccctggctctgccacccaggctgcagttgtgggattacagctcactccagccttgaactcctgggcttgtgatacaccccccacctcaacttcctgagtagctgggattacaggctcatgccaccatgcctggctaacttttttttactttttgtaaagatacgatctcactatgctgcccaggattgtctcaaactcctggcctcaagtaattctcccacctcagcctctcaaagtgctgggatttcaagcaaagccaccacacccagccaatacttaaccttttaaatcaccccaacataagactgggatatcatgaatgaaagatatctgatgggtcttaacttctcttgaacagaggcagctcttcttcctatttgtaaacatgccaaaaacattttctgagacctgctgtgtcccaaatttgtattagatgctgggctacgggggaaatacaccatggatcttcccttcaattccccaatgactcaactttctagtctacttttcagcaacaagcgaacctcaggtgtcacctaggttcagtggtgagaggtgtagctattgcacaagttttgtgaggacaagttgaaaagaacaaggaggagccatctgggagtttaaaatttcatgccttcatgcctcaatttgcaggcgatgtcatgcatcatttatgtgggggttctggtggcatttattttattcaaagcccatttatcctggactttttccagtactgtgtgagattttatgattcatcaaatccctcttctccgtaatgtagttttgcacacatgctgatgtgtggtatgctcagatgagctctcagaagggaataaagagctggagtgaggtcagaggaaagtgtgaccaattttggacctggccatgcttcccatgtgtgatgctgtgctataagtagaggtatagaagacatcctcagggcagtagtatgagatatggagaaaagaaaaaacaaagtgtttttttctatcctctcattcaacaatcaacacttctgtgacctctggttgccaaaacacgtgaggatttcttcccacggtcaaccaagcaatcaattctgcagcagacaccagctgggtattctcttattcaattcaattctgacactatctacttggagatagcaacagaccccacagatggagggcttagttttccccccacttcagaggccaaataataagcacaggttgtaacccatgttcccatgaccacttttttgggttcaattaatttgctagagcagctcacagaaatcagagaaacatttaccagtttactacaaagggtattacaaaagataaaaatgaagagccggggggaataactgtatagggcaaggtatggggaagggttgaggagcttctgtgccctctccaagcccactgccttccaggaacctctagaactcagtgcttttgagtgtttattggaggcttccttacctaggcacaattgattaagtcattggtcattggtgattagctcaaccttcggcctctctcttcttcctggaggttgaggtggagctgaaagttccaatactttatttttatttatttatctatttatttttactgtaagctgctttggcttttatttcattttaaatctttttttcattttaaatctttttttcataaattattggggtacaggtggtatttggttacatgactaagttccttagtggtgatttgtgagattttggtgctcccatcacctgagcagtatacactgcaccatatttgtatgtcttttgtccctcgtccccctcctcctcttccccccaagtccccaaagtccattgtatcattcttatgcctttacgtcttcagagcttagctcccacatatccgtgagaacatacaatgattttccattcctgagttacttcacttaaaataatagtctccaatctcatccaagtcgcaaatcctgttaattcattcctttttatggctgagtgagtattctatcctgtatatatatatatatatatatatatatatatatatatatacacacacatatatatacgtgtatatatatacacatatacatatatacatgcatatatgtatacatatatacgtatatatacatgtatatatacgtatatatgtatatatacgtatatatgtatatatacatgcatatatgtatacatatatacatatatacatgtatatatacgtatatatgtatatatacatgcatatatgtgcatatatacatgtatacatgtatatatatacacaaatatatatttttatatatttatgtaatattatatatatatatatatatatatatatatataccagtttctttatccacttgttgattgacgggcatttgggttggttccacgattttgcgattgtgaactgtgctgctagaaatatgcgtgcacaagtatctttttcgaataacgacttcttttcctctggattgctggatcaaatagtagtactacttttaatcacatggttcattttcctggccaacaggccaatgttgggctagccaggtgcccaccaagagtcatctcattagaacaaaagatgctcctatcacccaggaaattccaagggatttaggagctctgtgtcagaaaattggggtcaaggaccaaatgctaaaaaattctagcacctctgtctacaggggtattcggagctctctctcaggaacttcagcagaagccaagcattagaacaaaaaaattcccctagcactcctatcactcaggaaattacaagggttttaggagctctgtgccagggactggggacagagaacaatatgtatatttcttattatttcacaagtgagggttccaaagatggcagcaacctattgcatagattactcaagtaacactataattcatctctctgtgtctcatcccagttaagatctccctgccaacattttcaaagctcagaagactataaacttgatgaacaaatgctggccctaccatgaccttgaccaaccttgggctttctgttgaatgaaaaaccaatttcctatcattgttcagtaataggtcttaagattgaagggtgcataaaggaaaggattttatacctaattcaacatttattgaggcctgtaattcactagggtacacggcacatgcttaaataattcccctacaagatgctatggagggaactgcagcttaatgaaccccaagttcataccttggtaagtggtgagacagtatttgaaccatgtcactgacatcaccttaggggcagccctgctacccactccaaccagagctcaaccctggggggctggcaagaaccaggaggggacagagaagttagccaatgggtgaacttcttggcattttttctcttctttttttctctgaataaatatcatttttcgaggccaaaaaaggggagagaaccatgagcattttagacatccttttatttgggggtagtttcttgcctcaggtgtgcttctcccaaaaatactgatccagttccctcagattagtcacgtccaggcccagggctcttccatcccaacccaattcccctgaaaatgattaaagagtctataatatatcactcgatctcatttgctggatcaaatctagagggagaactgctgagtaaggtgacccaggggaccgtccccaggtggggagcaaaagaaagaaaatagtagccattttcacagcgttttgtatagtagttattgatttaggaaaacaaacacaaaattctgaatcaaattacctggaggatgattaccagagtctgggaagggtagtagggggctggaggggaggtgggaattgttaatgggttcaaaaaataataattagaaagaatgagggccgggcacggtggcttatgcctgtaatcccaatactttgggaggccgaggtgggcggatcacctgaggtcaggagttcgagaccagcctggccaacatggtgaaaccccgtctctactaaaaatacaaaagttagccaggcgtggtggcacatgcctgtaatcccagctactcagaggctgtggcaggagaattgcttgagcctaggaggcagagtttgcagtgagctgagattgagccagtgtactccagcctgggtaacagagcgagactccgtctgaaaaaaaaaagaatgaatgaacaagactactctctgatcacacaataggatgactgtagtcaataataaattgcacattttaaaataacttaattgtacattttaaaataaccgaaagagtgtaattggattgtttgtaacacaaagggtaaatacttgaggggatggatacctcattccctgttttgtgattatttcacattgcatgcctgtatcaacacatctcatgtagcccaaaaatatatacaagcattatgtacccacaaaaatttttaaaaaggaaaaatttttttaattacttggaagcttctccccaaatatgttttttggttttttttaaattttattattattatattttaagttttagggtacatgtgcaggtttcttacatatgtatacgtgtgccatgttggtgtgctgcacccattaactcgtcatttagcattaggtatatctcctaatgctatccctccctccaccccccaccccacaacagtccctggtgtgtgatgttccgcttcctgtgtccatgtgttctcattgttcaattcccacctatgagtgagaacatgaggtgtttggttttttgtccttgcaatagtttgctgagaatgatggtttccagtttcatccgtgtccctacaaagacatgaactcatcatcctcccttattttgttcttttcaccacaacaaacttagaatgtgagaacataaagctataagaactatgattattgaaaagctagaattcttataaagtactgataatttgagaaaagggctcttgtgttaccaggctctgctatttttttcattctctgaataatgagcacccatttagccgaatcacgaatgtgaaggaagagccgtaatttccaattcctccctgcccactctctcctcaggccacaaactgaaatcatccctcataggtgtagatttaaaaattggtgttctgcagatttcttttgtctgtaattccttcttctctctccatctgagcacattcttgcttgcatctaaactaagcttctcccatcaccaccgaagtccattgtcttagcaagagcaatcatcgccttctcagtcatatctcccatgtttgaaaccagtgtgtctctacccacccacctgaatgtggcctcatcaggtatctagagaaggtccaaccttgtaaaataaccatagtgatgaggaccccagcccacctcccaaagagctccagagggaggaaggaaattatttttctagggcaagtcacaatacttggccctttttatacactgccttaaatctcacaaacccctgtgagaagacaggtattattgtacccattttacaggtgacaaaggtgaaaggatacagaatttgcccaagattacataaattgcaaatgacggaactcagttttttcagtcaaactcaattttttctggattgcaaaatctatgcttgttcccctatgagactttgcctctttaagaaagagatggatggtaacatataataatatcacaccctgcctctcaaattgaaaaggggcctgaagtaccttttatggaggcctcaggaactggtgtcagtgcttataccagcacaaatgcacacatatacagacagagcaaaagaaagagagactggcctttctctccttaggggcaccatggcagggagcactcagtgttctttgactataagaaacggaaaagccactctagttaatttaaggattagtttatttgagagaacactaagtaactcatagaatcaaggaccacaagaaggtcaggaacatcaggtcagtaccagggatctccgattcattctttctgagaactgccatcaaattgacttgtcttcattcaccttccattcatatttcactccacctataattcagattcctgggagactgagtctggccaacctgtaaggtcatgaacctacccaggaacagggtaccaggattggtgccccccagggccatatggaaatgcagtaggcacagttattcaaaggaaaggaagggtgctgttaccaagggaagagggataaataaatatatgctgggcaagataacaacagatgcctgtacccacactctaccctttgctctagtaagtaagcctagtgattagggaagctagctagcctttggtcctaggcttaagtgacaactaaggagtgatatttttcaaaagatatagaaccaaaatttgtattttttcaggccctatttttgtcaaatgacttaccatcatcaattgtcctcaagtcctcccgttgtccccgctagatatcattgatgggttcagttaatgcatatttggaattgtaaccttacactgcctattaaacatctatgcccttgctgtggtcatgacccagccaagaaatggccaattataggctcctttttccttctgaccatgcctgaagtccagccgttgatccagccccttaatcaatgataagaatgatgctcaaaccattcagtgcatgtgtaagatcatcttgagtagcagctcccaatccttccacatctctaaagtaggaaaatacttctttgggaagttacccgattgaagaagtgaagtcttcatggtcctggtgaaaacctcacctccaatttactgtttggctgagtttctgtgatggccttctgctctagaaccagagatagcttcccagcaggggcaagaaaagaggatctgtggaggacacaacagataatcagacagtgggaacaccaagtcacagagttcttgcagctgtgtgtcctgtgcagacaaagacactcaccctcctcctgcctttatggaaggaaggtcgtaggcaatgttactttgtttttggcaaacccccaaaagaagaaaccactccacatagtctgagaggtagtatagtaagtgttgtgcgtagagacctcattaatggccaacacctgttttatttgcaactcactatctttctagttaagaagagttcagagcctgacctgcacactatattgggagataaaacaatgagatgctcattctcaatgtgcctggctttatggagtagcttcattcctacaagtgtattctgtagatcaatatcaatccccggtgcctattgactttacagcacagttctagtattgctttatctttacagagcaaatttttattatcagaggcttctaatcctttagctttaaatgtctctattcctgcacttcagcttttctgaaatttttccaaagaaaaacattttatgagaaaaagctaaattactaagtatattcatgtgctatttctcctaatcctcacaaaagccctgtcatgttgtgatttttccctattttaaagattggacaactgaggtacaaggcatcattactaatgaaaaactacacaagggctcaacccatgtcttctgatgggactgaacctcaagtagcaagttattgcttcatcttcagtgggtgtttgtgaaatgcgtagaaagggcatggaagctgcatcatattcagtggacactgcaagtgatctgtttgctattcacttaacacacatttgttgatgacccattatgttcagaggtgaacaagatagtgtctggagcctggggtagctctcactttagaataggcttgtttatcaaagacaacttttgtcttgcctaagatcactcaacaatctctatgaggcagaagttccttggtccagtcatgtagacctcctgcccagatcccatcggtagccgctgcccctctcccccagcagctgtgactttgtctgattacacctcacagccaccgcttttcctgggggactgccctctgctaactgctcaacaggctaccacattcccacctcacccccagcagaagcccacggcccatgactaatagatacatgccaaggggcatcagaggctgatcttcttgtctcaggtggaactaattttgttgtgagattcatactccagcgccctcctatgggctcagactgaaacaatctgcaggcaaatcaaaagctttgcttagatatttgtttcagctctgtcccgctttcctccttccccttttctggggaccatatcctcaggaaaacacttgaactagactctccatcgcaggctgtgtctaaaggaacccaacagaagacatctagtttgactttattttgcagcagaagagttacaaatttttagtgtctgaaaaaaaatctgtgtttcatgttttcactcattcagattgggccttctcctaaaattaaacaaaaccagcaagattttgctttgcaggaaagatctgtctttgcaggattttgtttgtactgagggtaaggaaacagtgatctcttaaaatattcaggactactaaaatacaacaggtgcattgccagtttcctaatagtatatctcgaaaccagaacaacacacccgctgataggagtcatgagtttttgcttttgagtagtgatatgaacctaagtgtgagttgcattgaaaattaatgcgctgcctgcctaatcattttcacagagcctttggtgaggttgatgttgagcttgttggataattatctgttttttaaaaatctaagcatccttttatacgtcgcgttttctgtttgcaagtttcgcttcaagtttactgaaccatttaattaacttaagtgtttaaacttctagaggtgttgattgattctaatcagcattttctgctactctaattgaaggcttcctctcttggactattgtcagtgaagcaaaaaaaaaaaaaaaaaaaaaaagcaaaatgttgttcagtctttggcataatctaacacaaatttagttggtcccatgattgcatgaacttcaggaggccagaagagagccaatttgtctatgtttttgaaatcgcggagccagccccaggaagagactgtgctgcaggcacagggaggacttgcaacctctggtggggacttagactccaagccaaaccactttcaggtttggcagttttcactcttcctggaagctcagtcgggggatgttttgcagggacccttaccacccagaggaaatgattttctcctttaatcactcttcttttctcagaaaaacaaaaaattacccccaaactcccacctcctgtggtaacaccccaggcaaaggcaaacttagtccctagaataagagctgcccaatattaagtaggtctttctgctggtggtgagaagtcaggcttctgaactccaggtgttcagacaacctgggtgttgtgtttatctgccctttaaaattgctctggagagagcaagaggggagtccctgtcaaaacagctcagggagctcctccagcctgtaggcacctgagacatggcccctcagccactccccaacttcagcttttgaagaccaggttttctgctgccttcaaaaagattttctggcaagctgactttggtccctcctgagacaattctgttctagttgacttctgttcagcacaaaattatgtattatggatattgcatttttctgctaagaaaacgtcggctgctaaactagatcaaaccgccctccagttcttcagtgctgactcattttaattattgaacttttctccctggaaagtacactccgtgctgtttgtcgagaaactggcagttttaacacaatttggaaacttttcatagatggatcaccccaggaaaacaggcagctgatcaccagagaaattctgcagttcagattagtttgctgtgtgatgacactgaagaagtgaaatgtatggggtttctccctaccacccattccaactccctggctcctcacaagacaatgccactgcacgcagcaaggagctcttgttttctgtgtacttctgtgtactgtggggcccagctctagatctgtgacatgctcaccagctcacctaagcgaatataatccctgactccctccccaaatttgtttcttacctccatctaattcagtcatacctaccttctttctgcctggggaacactccaagccattccctacctgaggacatttgcatatgctattctgtctagtaagttccacttctagtctaggttgctttgcaaccctggctgcacattagaataattttaagccttaccttgaggtcaattaaatttccacctctggaggtggggtccaccatctatttttaaaaactcccaggtgatatgaatgcacttcaaaggttgtgagtcatcactttaaatcttcatgtggctgggtcctcccattgttcaggtctcagcaccaagatcccttcccagagaagcattccctaatcatcttatctgaagtagcctgaactctaagcccccagagctctctacatcactcactgattttattatctctacagtactcttcactctctgaagttatcttttctattttttatttattgtcttccccactgtaattcaagcttcaagagagggatttgttcatcttgttgacttctgtatcaggacatctgcccgatacatagtaagtgctcaaaatatatttgctagatgagcaagtaaatgaatagatggatatatgaatgaatagatgaatgaatgagtttctgccctcagaatctgtattagtcagggttctctgaagggacagaactaataggataggtgtatatatgaaggagagtttattaaggagtactgactcacacaatcacaaggtgaagtcccacaatagaccgtctgcaacctgaggagcagggaagccagtcccagtccccaaatctcagaagttgggaagatgacagagtgcagctttcagtctgtggctgaaggcccaagggcccctggcaaaccactggtataggtccaagagtccaaaagctgaagaacttggagtctgccgttcaagggcaggaagcatctagcccaggagaaggatgaggatcggaagactcagcaagtctagtccttccacgttcttctgcctgctttattctacctgcactggcagctgattagatggagcccactcatattgagggtgggtctccttctcccactggctcaaatgttaatctcctttggcaacaccctcacagccatgcccaggaaaaatactttgcatccttccatgcaatcaagttgacactcaacattaaccatcacagagtccaagttggtatttttgatagtatacgtcactggataagagctgccactcagcacacctggggaaaagtatactttctctacagacattattttctactttgagttcctcaacatgaggatgcaaaaagttttaataaacaacaacaaatttatttaactacaacctatcacaagttgcatattgatattgaaaattctgtgaaagtctaagtgttcagtgcctctccttccctgtgtcccatcagcatggccatcagagcagcaagccaatgctttgccatccagcacctgtgccctacccacccagtgccaagccacagtggaggcatgagagctcttttctttccctctctattcgctctgcctcctttcgaagctcctgagagaagcatttaaataatacactggtcttcaataatagaatctgattggaaggactgctggagcccacttgtaatcactgaagcagcaaggacagatcacgtctttcatgattttcttccacttttagtgccatcttccactcacttctacttccagatccttcctaggttggtgtcctgctttaagtgtctccatgagtgtcttatccactccagtgtcttcatcatgaattgccagcagctcatcctttgaccaacatgtgtcccaacttggagaagcccgatgagttctgggaaatcaccaccaccatgtttctcttactcagagctgcctccagtttttctataaaacccaaaccactattctccaaaacagaaaaatggtagagcttcaaatgtggtcatgaggtcttccagaagggattccattttcttgattaaggataggaacatgagaaacacacacacacacacacacacacacacacacatattcatccactttccttccctgcacacctgctcaacaggcacaatgcctgtgttaattcattcatatacaataaatttatcttctttcctcccctggtaagtggatgaataatggcagactctgccatttcctaccattttggctattaatgcacatcagcaagtgtgtttcagcttcagggaaccgagagatatttctggcaacctgtgagagctaattcaccttcaggaggtgagtaaccaaatatttataccttatcagattctgactcattctccacctttaaaagtatgtgtcacagtgcctaaagcttaggctgggtatcagggacatctaaggtgccagactgactctgcagtccagaggattcagaaatttgattttagcagaatctctataaaaagaatgctcggggagcctggcccacactaaccttataagccaggacagtttctgagcatacacataaggcttcaccccaagaagtgggctgaccattcattcacatgataaatatttattaagcacctagcacattgcttctatgagaatctaggcaccgaggaacaacagggaacaaaaaaagaacaaaaactcttttgtaatggaacttagtgggagagacagataatagacaaatatgtaaaatatataaggatcaaatagtgacaagcgctgtgggtaaaataaagtaggggatgagttataggaaaaggcgtccagtgtggggtggggattgcagtgttaaataaggcagtcagggaaggcctcagctagaatgtgacatatgaacaaagacctaaaggagatggaaaggccagcttgcaagtttctaggtagagaggtttccggccctcaggcaggagtgtgcctggtgtgtggcaagaccactgtagctggaacctatgtgttaggagagagtgcataggatcaaaaaagttggctaatgtggaatcctgaaggttttgggggactggatctggatatggattttcttctaagtgtgatggggccatcagacatcttcaagcaggggagtggtatgatctgatttagcttttagcaggttttttctggctgttagccaagagaagaccatagggggcaaaggccccggcaggcaggcctattaggaggccactacagtcctctgggaaagagatgctgatagcttgaaccagggcagtggcagcaaaaggagagagaagcaactggattctgcatgcattttgaaaggagagccaacacaaattactgctagacttggtatgctatggagaaaaagagaggagtcaaggtttagagccacagaaatgtacagtttccatgagagctcatttctggcaaatggctttactcaggaatcaaatgcagaccagatggacagttaggtgagcagagaattatgacaaagtaattcatctcactgacaacagctttcacttaagagcactgagtgtaggccaggccttgtgttaagcatgagcttacatcctccgtttcttcttccaacagcccaatggtaaacataccattatccccataaataaggaaattgaggctcagagcaaagtgatttgcccagcactgcgcagctactcggtgctggaactatgacttcaaccagacctgtctgacattccctcaaccactgcgctacacagattcctactcaaaatgctttttaaccacactcaggaacaattatggattgttctttttcctctagggctttttcaactacttaaccaatattctagactgaaaaaaactacccctaccttgcacagtggcagagacccctggtcaaattctgtctctctggccttttgttttttccatctctacctgtcacctctaccctccgtcagcagctcagcagtggcttcacagctattgttgcatccattttggttcaaaagggtcctcccccttaaggtttgagagacactgtgggctacctgatggggtttagagagcaccttgctcttatgagcagtgagtttacaacatatgggtggatttcttttgaggcattttttttttcaagtgaattaccccaataaggatgctatttcctgtcctcatctccgggtatgaggaatttatatttgtcagcctagggcactcaccatattctccatgtttgttcagacgaatgcttgctgggggccctgtatgtgccaagcactgttttagggagtgcagtagtgagcaaactagacccagttccttctcccaagagggtggtaagctggtggggcagccagatgttaaactaaggatcccctctgctatggttcagggttggggtttgtgctctaaaaggaagaaacattgatctatgtgtatatatagaagccaggcctcacctgggaggtgagagaaagtgtccctgaagaaatggtgagtaggctgctatctgaaggatgagcagttctcccaggatagaagatggggaaaggtacaagtgggccacacggaagccttgtaataagagggaacatagcaagtttaaggagcaaagatagcaagtcaaggcttaatacaaaatgagctggagaactgggaagagctgcgaagaccttccttaagaatgttgatctttagccgaagaggaatagaatccaccactgcagggatgaatgaaaaaaaagatgtgatagattttcttttcttttttctttttcttttttttttttttagacagagtcgctctgtcacccaggctggagtggaatggcgtgatcctggctcactgcaacctccacctccacctcccagcttcaagcgattctcctgcctcagcctccctgatagctgggattacaggtgcatgccatcacacccggctaatttttgtatttttagcagagatggggttttgccatgttggccaggctggtcttgaactcctgaccttaggtgatccaccactgtcgcctcccaaagtgctgggattacaggcgtgagccatcacacccagctgtgatagattttcttttgaaaagatgactctgcctacactgtagaagatagagtggatgggcaaggtggacagaggagaccactgactagattattgcactgtctgcactcacatgatgatctcatcttgccctgaatttgcctggacagagaatcttagcatatctgaccatgaagagatcttagagagcattccttgagttcagctacattattttacggatgaaaaatgtggcctagagagaaacacttgcccaagaccacagggccacttaaattacaaagtcaactctcaaaccaaggtcttttgacttaacgccttgtgcttgtaaccattgtttcaattgtgtgcttttacatgaagcctgggctctttcaaagtattggttatgtcatatttagtatagaatctccagtgtttggtgggagtagcaactcagtatatgttggatggataaataaatggccggaagaataggtggatagatggatggatgaatgaatgaatgatagatgcatgcatgcattgatggatggatgaatggatggacggatagatgggttagtacatggatggatggatttgaaaggatactgttttataatccacaagcttccatagaaacaatcgaaagagatcagttttcctttagtgaaaaccatacttcataacctttctcgagtcatggcaacctctcttgggccacagcatcaatgtgaccccataggacatccttcttatccaagtctgtgcctggaaacctcagtccctgaaagaaggtgataaacttactgcagttgtttggaatggcaagcagcccgggaccggttaggtcatgcactgactccttatttttcctggaaaggagcctagcttgctaactttccaaattgaattttaaaaactttaattaggtcaccacaaaggtttgtctcttttaatggcagaaagcccagtttcctaagtgtttcctcaggagcccatcctttgccacctcacgactcttgtacatcgcacacctcattaagggaggaccctgaatggaatgctgatgaaatattacttgagtgtcaacagtatggaggtgctcagaaaatggctcagagactattgccaaaatacacccttgacacacatcctctcattttattctcaaaacaatatggatgggtggggtggggagagaataaggccttatctcaattttgtaaacaaagagaatgagaccatagagtctaaggggctggcccaccccagggccaatacacagactcagatctgctagggacactcccagtttggaatatcattatctttccatggaaagatattatcatggaaagataatgatattccaaatgtgctgacttccttgttggagttatttagaacataatcactataactaatgaacaaagaaaacatgtttgtcatcagccaacatttattgattacctattatgtacagtacattttaccagaggcttatctcaggccaattggacattcctctttgccctccgagcatgaaactagggacctcattcaagtccccagtcagccactttctccacaatacgacctagagaaagacacttaacctccctgagcttcagtctccttctctgctaaacgggcacagtgatttgtatataacaacctcccagcaggatacatacagaacactcaaaattgaattatttgaggagaatgtattacaaaaagaccattcccaaagtcctgggtaagggagccaccagagataatgcactaacccagagatagaaagaacctggctgctactactccaaggtctaaagagacaaaaggaaggagaggttataggaactggaagaggagagattcttgtagatttggcatccctgagagaaccagggaccctctggacacagccagcctgagacaatttcacagagcaggaaccagagtagaagggacctgatctccctgtctacctccctctggtttccttccagggtggccatggcagaaacctttgatagccagaggtatgggagtcagtgagtgccatgcacacagtgggtctccccaggcagagaaaggcggagagggagtctggggtccaggtggaagccaccatcacacagcacctcctctgccttcatgaaagtgatttataaaggtaaagattctctgtaaaagagaaaatgtcaactagtatacaaaattttctacaagcctgagaataagaatgacctgtcaccagccttctattggctatcttgtgtgccaccaaggatgagagtgattgaaaagcagaggcccagtagttcaaggcaaggtcatataaagggctccagatccaggcaatgctggatctgaatctgggtctaccgccagctagctgagtagtcacagcaagtctcccaactgctctgggcctctgtgctctcatctggaatgcagagaccataatatctatcttgcacagtgctgtgaggttcaaagggaatagaataggaaactcacaatgcctggcacataataggtgctcaagaaatatattgtaaagtgaacaaatgaatgatttttaggatcccttctgactcaagaaatatattgtaaagtgaacaaatgaatgatttttaggatcccttctgactctcacatggtaggggtctgattctgtagtctggttggcaggttctgagaagcatttgtgacatctgggtaaggtgccaacctgaggacaagacccagggcaggatggggtggccggaggtacacatggtgactacaaggtccacagaaagaggttctgagtggagacaatgtgtctcagaactctgtctctagtcgtaaaaccttttgtagaactgtggcagcctctaggtaaatggaatgtgaatgcaagctagaaagtttgatagaatgtctaatttgtcaaaataggatttttctggcaatacattacaaatgactgtgaaattgttttcttggcctgttaccaaacatgggtgaataattgagagttaactattatgagactttcatttggggatataaataatatttaaaaggattaagaacttgagggaaggaagctgacatttgtgagtatcatgggatcctaccagctcatatattaaaggccccaatcttcgcagaatttattgagcagaggtaaacaaacaagaaacataaaaaaaataaataaataaatgagagtgttatgggttgaactgagtctccaaaaagctatgttgcagtcctaacccccagaacctctgaacgtgaccttatttggagccagggtctttgcagatgtacttaatcaagttaagactaagtcatactgaattaaggtgggccctgatccaacaactggtgtccttatgagaagagggaaattgggacacagacagaagacaaccatgtgaaaacagaggcagaggccggagtgatggtgccgcccgccgaggaacaccaaggattgccagcaaccacaagaacctgggagagagcatagcacagatccccttcccagcctccagaaggaaccaaccctgccagcaccttgatatcagacttttgaaaaaaaaattgtttttttaaattttaagttctgggatacatgtgcagggcatacagggttgtttcataggtatacgtgtgccatggtgatttgctgcacctatccatccatcacctaggtattaagccccacatgtattagctattaatcctgatgctctccctccctgctccctccactcctacccccataggccccggggtgtgtggtttccctccctgtgtccatgtgttctcattgttcagctcccacttatgagtgagaacatacagtgtttggttttctgttcctgtgttagtttgctaaggataatggcttccagctccatctatgtccctcagtttgtggtgttccgacagcccaggaacgtgaccacttacggaatgttaggcgacggtaagtgctgtcgtgaaaagcaatccagagaacaggtgagaaggattaggaaggagaggttaggcaggcaagggaagcatacagtcattgggacaggcttcacggagacgtgaaggtgagacgagcagatggaaggccatgagggggtgagccaagcacaggtggggaacaatgtggcagcagaggaagcaggtgccgtggaggcccatggaactgtgccatgttcaaggagcaccaaggaggccaatgtggccagagcatgagcaaacggaggtgggagaaggggccagagaagatgtcggacaaaacccaggggtcttgtcagccattgccaggattctgctcttgctctgagtggggtggagagctttgggagggtctgtgagcagtgcagcgatattatctgaagtatgacttaaaacatcccctctggctgctgcactgaggacagatggaagcaagacaaagacagcagtgagacctgttaggcggccactgcagcaacccggctaagactacttcactgaccgggacattcaccagttctccaaggatgctctcctatttcaaaggcagagctgggattcccagtctagttctctctgcagcatcgtgcagcctaccacctgatggccacaaccatggtgcaaacttattctaacatcttgaaaggaaggaaggaaagtactttgcatgccttctcccttcatctctgatgtctaccccatggggatgttgcaagaatcaaataaaggaacagctgtggaaacatttttgaaaaagcatgaagcactaaatgcaagagatcataattaatactaatagcagtcacctctctctctttatcctacaactgtctgcttataaataccaccaaaacaatgtctcataaagagattgatacccacatggggatgaagctggtatacacatctgctggggagaatttttcattgaatagatttcattgtaacaagatcagcaatgccccgttaccatgggccatctgtcgggacatgcaagtagacttgtcatgcagaactggactgtcaaagggaacagcagtctaccaacatgcaataaagcaatagattttttctgtatttttaaaaatgatgactgttttttcttatgctctcgagggatgtcttcgctgaagctaagcaaaaactgaacatgagggaccagtagccacctgctggcagacaagcatttgcaggaattagtaggcctgggggctgtgtgtgtctccggttgcaagaaggggaggaggttagttcaaagaaagctagaaagcactatggagactcctcaaaccaccttactatccagcaaccccacttctgggtatatacccaaaggaaataattttttttttttttttgagatggagtttcgctcttgtcacccaggctggcatgcaatggcatgatctcggctcactgcaaggtccacctcctgggttcaagcgattctcctgcctcagcctcccaagtagctgggattacaagtgcccgccaccatacctgggtaatttttttgtatttttagtagagacggggtttcaccatgttgcccaggctggtctcaaacacctgacctcaggtgatccacccaccttggcctcccaaagtgctgggattacaggcgtgagtcaccacactcggcccaggaaataaaatttttatcctgaacagatattggcactctcgtgttcactgcagccttattcataataaccaatatatagaaacaacataatgttcatgaacagatgaatgggtaatgaaaatggaatatcatccagccttaaaaacaaaggaaatcctgccatttgcaacatggatgaacctggaagacattaggctaagtgatataagccaggcacagaaaagcaaatactatgtgatgtcttatatatggaatctaaaatagtcaagctcacagaagcagagagtaggtggtggttaccaggggttggaaggagaggcaaatgaggagatctgggcaaagggtacagtatcagtatacaaaattaataaattctggagatttaatgcactataagtgacaacagttaacaataccgtattgtgtatttgaaatttgtatgagggtagatcttaagtgttcctatcaaagaaaaaagagaaaaggtaactatgtgaggtgatggatatgttaattaatttgactgattatttcacaatgtctacaaatattaaaaagtcattctgtataccttaaatatatacaattgccttctatcaattatacctcagtaaagcaggaagaaaaacagaagggagacaagaacattaagggcacgatggcatctctttgtcagatactggtcctaagtgaaaactgaagaagacttgtttcgtccagtgaccttgaaaggcttggagcacacgctgcttcacttcagggtccagatgagccagccagacggaaggtgagggagcagagcattttctgagtttctagggagaacatagcgacagcaatcagaaaggatgggaagcagcaacagtagcagcagcagcatctgctgtgtctggcaaggtgatgaggaagcagcaggacccagcagggaggcaggaaagcagcatcccacagagggcagcagctgctggacagagaggggccacccccataggacttcaagtacatgatgccaccacaagtccagagctaaagaacaaaatcagatggccacctgggccccaattataaatgactggaggagacatcagggtagtagtcaaaaaggagggtgacacctgcagatgtgcaggtttggcaagtagtgaaattgggcattaaaattattcacagttccaggatgaagtatcctggggaaatccaggtaacaacaataatagctacattccttagatgtgtacaatatgccaggcactgtactgagtgatttcattcatgcattcatttgtttattcattcagtgaatatttatggggtgccttctatgtgccaggctgtgttctagttgctggggataaaccagtgtaaaacacgaagaccctggccctcatatggcttacattctagcagttggagatagatactaattaataaatacaacgtctcatctacaaggagatgttaactgctatggaaagaagagaaagcaaagcaaagggtcttgagagtggcaggaggaggatacagaactaatcagaagagtcaggacaagcctcatggaggaggggacatgagagccaagacttgatgtggtgagccatttggggatctgagaagaaaatgtttgagcaaagggaagagctggtacaaaggccctgaggcaggcacttgcccagtgaatttgaggaatgactaagaaactaaggtagctggaaagaaatgtgctgtagggggagtatcttaggctataagctcagagatgaatgggaagcccaagtcaggtagagctttatgtttaatcctcaccatgaagctaaaatacatgttactgttcccattttactgataggaaggcaaaggtacagagagtttaagtaatttgcccacatggagatagtacataggtgatggtactagtacagttcagctctaacacggtgctttttttttttttcattacgttgcattattacctcttaagaggcccctgggagatacctacctgtgtacataaattaaaatcaaagtcctgtggtttactgatttcccaaagccaaaacacatagacacagatgtatatacatatcaatctatgggatgtctcttcactctattgttttctttgctgtgcagaagaatacagttgcatcaaactcgttttagtttgatgcaactatatgtttgttttttgctgcctatgcttttgtggttctatccaagaggtccaacaattcattgaaataaataaacacagagacagaacatgccaaaatctgtgggatacagcaaaagttatgttaaggggacagtttatagtgctaaacaccagcctcaaaaacatagaaagatctcagattaacaatctaacatcacacctagaggaactagaaaaacaagaacgaactaacctcaaagctagcaaaagagaagaaataactaaaattgagcagaactgaatgaaattggcaacccaaaaatccatacaaagaatcaaaaaatctagaaggtggctttttgaaaagataaaaatcaatagaccactagctagattaccaaaggaaaagagagaagatccaagtaagcacaatcagaaactgcgaaggtaacattacaacaatcccacagaaatacataaatttctgaaaacacgcaacctcccaagattaaacggaaaccctgaacagaccaatattaagttccaaaattgaatcagtaatttaaaacctataaccaaaaaaaggccaaatcaggtggattcacagccaaattctaccatataaacaaaggatagctggtaccaactctattgaaactattccaaaaaatcaaggaggcgggactcctccctaactctttctacaaagccagcatcaccctgacaccaaaccctggcaaagatacaacaacaaaaaagaaaactaaaggtcaatatccctgatgaacatagatgtaaaaatctgcaacgaaatactagcaaaccaaatccagcagcacattaaaaagttaattcaccatgatcaaataggcttccttcctgggatgcaaggttggttcaatatatatgaatcaatagatgtgattcaccacataaacagaattaaaaacaaaaaccatatgatcatctcaatagatatagaaaaagattttaataaaatccaacatccctaagtgataaaaaccctcaagaaacaagacatcaaagaaacatacctcaaaataataggagccatctatgacaaaaccacagccaacattatactgaataggcaaaagctggaagcattccctttgacaactggaaaaagtgaaggatgctcattctcactacttctattcaacacagtactggaagtccttgccagagcaatctggcaagaaaaagaaataaaaggcatccaaataggaaaagaaggagtcaaactatctctctttgctgatgatatgatacctagaaaaccctaaggactctgtcaaaaagctcctggcactgataaatgacttcagtgaggtttcaggatacaaaatcaatgtacaaaaatatagcatttctatacaccgataacattcaagctgagagtcaaatcaagaacacaatccctcttacaatagccacacacaaacacccacatatatagtaatacatctaaccaaagaggagaaagatctctacaaggagaattacaaaaacaaaaacaaaacaaaacaaaaactgtgaaagaaatcatacaggaaacaaatggaaaaatattccatgctcatggattggaagaatcaatattgttaaaatggccatactgcccaaagcaatctgtagattcaatgctattcttatcaagctaccatcatttttcacaaaaatagaaaaaactattctaaaattcatatggaaccaaaaaagaacatgagtagccaaagcaatcctaagcaaaaagaacaaagctggaggaatcatattacccaacttcaaactatgctataaggccacagtaaccaaaacagtatggtactggtacaaaaacagacacatagaacaatgggacagaatagagaacttagaaataagccatacacccatggctaactgatatgcaacaaagtgggaataaataagcaatgagaaaaggacttcctattcaataaatggtgctggaaaagccagctagccatatgcggaagaatgaaactggacccctacctttcacctatacaaaagtcaactcactcaagatatattaatgatgtaaatgtaagacctcaaactgcaagaatcccagaagaaaacctaggaaacaccattctggatgttagccttgggatatagtttatgaataagtcctcaaaagcaattgcaacaaaaacaaaaattgacaagtgggaccgaattaaactaaagatcttctacacagcaaaagaagctatcaacagagtaaacagaccacccacagaattagagaaaatattcacaaactatgcatccaacaaagctctgatatccagaacctacaagaaattttaacaaccgaagaagcaaaaaaaaaaaaaaaccccattaaaaagtgtgcaaaagacatgaacagccacttctcaaaagaaaatatacaagtgaacaacaacaacaaaatgttccacatcactaatcatcagaggaatgcaaatcaaaaccacaaagagataccatctcacacaagtcagaatggctattattaaaaagtcaaaaaacaacagatactggcaagctgtggagaaaaaggaaacacttatacattattggtgggaatgtaaattagttctgccacttggaaagcaatttggagatttcttttttttttttttccgagacggagtttcgctcttgttgcccaggctggagtgcaatggcatgatctcagctcactgcaacctctgcctcccgggttcaagcgattctcctgcctcagcctcccaagtagccaggattgcaggcatgcaccaccacgcctagctaattttgtattttcagtagagacaggatttctccatgttggtcaggctggtctcgaactctcaacctcaggtgatccactcaccttagtctcccaaagtgctggaattacaggtgtgagccactgtgtccagccgggggtgaatttcttaaagaacttagaacagaactaccattcaacctcacaatcccattatggggtatatatccaaaagaaaataaattgttctaccaaaaagacacatgcactcctctattcatcacattagtatttacaataacaaagacgtggatcaacctaggggccccccattagcagtgaatcaaataaagaaaatatggtacatatacaccatgaaatgctacacagaaataaaaaaagaatgaaatcatgatttttgcaggaatatggatgcagctggaggccattatcctaagcaaattaatgtagaaacagaaaaccaaatactgcatgttctcacttataaataggaggtaaacattgggtactcatggacataaagatgacaaacacaaacactggggactgctagatggtcgggggtggatagggggtgaaaagctgaaaaactattgggtgctatgctcagtaccttggtgatgggaacaatcataccccaaactcagcatcatgcaatatacccaggtaacctgcacatataaccccaagtcaaaaatgttaaaattatttttttttaaagagaaaaagatataattacccagaggagtctaaactgttctaaaccagccaaaaccagctaaaactggctaccactgctttaaaccagttgaagccagctgaaactagtcaaaacagatggctgaagccaactgaaactggtcaaagctgaatgaaaccagtcaacattggctgaagctggctaaaaccagtcaaaaccagctggaaccagttgagccctgctgaaactagtccaaattggctgaaactagtccaaattggctataactagtaaaaatctgttataacccatggaaattcgcagaagctagttgaaaccagtcaaaaccaaatgaaactggctgaaactggctgaaaccaactgactaagacctgttgaaaccggccaacaccagccaagaccattcaaaaccagtggaaacaagttgaagctggtcgtggacagccaaaaccagtgatggctgctcaaaaccagtcaaagccagtcacggccagttgaaactggtcaattcataataacactccttggtgttcatttaaattaataaaaaacttatttccacatgaaaacctgcatacaaatatttataggagctttattcataattgtgaaaacttagaaacaccaacatgcccttcaataggccaataattaatggattaaccatggtgcatctacacaatgaaatactattcattgataaacagaaatgagagctggaacaagacaaggatgttcactttcactgcatttatgcaacatagtactggagtggtcatgagcaattaagcaagagaaagaaagaaaatgattatccaagttggaaaggaagaaatcaaattatccttgtctgcaaatgagataatcttaggttttaaaaaaacctatcattcccatggtaaatggtaaaatagatagatagatagatagatagatagatagatagatagatagatagatagatagataggatggataggtagataggtaggtagatagaaaacaaactgtagcattactatatgttaacagtgatcaatctgaaaaaggaatcaagaaatcaatcccatttacaatagctaccaaaaaaaaaaaaaaaaccctaagaataaattaaccaaagaagtaaaagctatctacaaggaaacctataaaacactaagaaaagaaattgaagaggaacaaaaaactgtagtgagatatcccatgctcatgagctggaagaattaatattgttaaacatctgaactacccagaatggtctactgattcaagcaatccctatcaaaataccaatgacattgttcatagaaatagaaaaaattcctaaaattcatatggaatcacaatacatctcaattagctaaagcacttttagatcaagttttaagagccatgttttaagtatcccatgggttgggatttttttctcagcaacatctgaaagtgactcaggccaatatgatagcaagggtgacaaaggtgtcaagaacacacactggggaaaggacagtctcttcaataaatggtgttgggaaaactggatagtcacatgtaaaagaatgaaattagacccttaactcacaccatgcaccacaatagccaactaaaagtggattaaagacttaaatgtaagacctgaaactatgaaactactagaagaaaacataaggcaacattggtctatgacattagtttaggcaatgattttttttatatatgaacacaaaagcacaagcaacaaaagcaaatgggactacatcaaactgaaaaccttttatgcagccaaggaaattatcaacagagtgtagagacaacctacagaaggaaagtattaatatttgtaaagcatacacctgataagaagttgatatccaaaatgtataggagctcaagcaactcaatagtagtaaaaacacctgatttaaaaatgggcaaaggattggaacagacagttctcaaaatgacataccgatgaccaataggtatatgaaaaaatgttcaacatccctaatcatcaaatgcaaatgaaaatcacagtgagatattacctcacaacttagaatatctattatcaaaaagatgaaacataacaagtgttggagaatatgtgcaaaggatgtgaagaaaagggaaccctgaaacactgttgatgggaatgcaaattagcacagccattacggaaacagtatgaagattcttcaaaaaagtaaaaccaccatatgatccaggaatccctgtactgtatatatgcccaaaggatatggaatcagtatattgaaatgatatctgcatcccatatttgttgcagcattatttctaatagctaagatatgaaattaacctaagtgtccatcagtggagcaatggtaaagaaaatgtagtggatatacacaatggaatactactcagccttaaaaaaaaaggaaggaaattctgtcatttgagacaacctagatgaatctggaagacatgctaagtgaaataagccaggcacaaataccacaagatctcacttacatgttgtattagtccattttcatactgctatgaagaaatacccaagactgggtaatttataaagaaaaagaggtttaatagactcacagttccatatggctgggaaggcctcacaatcatggtagaaggtgaaagagaagcaaaggcatgtcttacatggcagcaggcaagagagcatgtgcaggggaactgccctttgtaaaaccatcagatctcatgagacttattcactatcacaagaacagcatgggaatacccatccccatgattcgattacctcccaccaggcctctcccatgacacatggggaataggggagcgataattcaagatgagatttgggtggggacatagccaaaccatatcacacatggaatcttaaaaagttaaactcatagaagtgaagagaagaatgttggctaccagaggctggaggaaggttgggggattagagagatgtcagtcaaaatatacaaaattgtagttagaataatttcaatagccctactgtacatgatgactatagttaatagcaatgtattgtggtattaaaaattgctaagagaggggccgaggcatggtggctcacgcctgtaatcccagcactttgggaggccaaggcaggcggatcacctgaggtcaggagttcaagatcagcctggccaacatggtaaaaccccatgtctactaaaaatacaaaaattagctgggtgtgttggtgtgttcctgtaatcccagctacttgggagactgaggcaggagaatcacttgaacctgggaggtggtggttgcagtgagccaagatcatgccactgcactccagcctggctgaaagagtgagactccatctcaaaaaaaaaaaaatcggtaagagtagattttaagtgttctcaccacaaacaagtatacaaagtaatgcatatgttaattagccagatttagtcaatccacaatgtatacatatttcaaaacattatcacattgcacacaataaacatattgaattttcatttgtcagttaaaaatataaataaattttaaaatgctaaaggaaggaagaaagggagggaaaaaagagaaagaaaaggcatgttgcctgcaccacagggcacatggaggctggggacagctcaaattgtaaaggatgtcagtctctatactggaaattgtcactggcaatcagcaggccacataaaatagaaagctgtccagcacaaaatcaatgttcttccttctgtggcatcatttccttatatctcaataaccccattattatttcaaattatatttatctcaaagtagaaataagtacacacggatcattcactttctcctttgccaatttatgacaaatgatattccatcacatattcatgtaatcattcattcattcaaaatcattgggcgtgtttgatgccatgaaaaaagaatggcccttggaatcaaatggccctgggctggaatcctgactgctatgccacctctaggagctttacatgaagttatttagcctcgctaagccttaggattctcatttgtaaatggccatttttaaaatctctgctttgtaaagttctcagcatagtattttatatagcagataataattgctgttatttttattacaagcttcccatattccaaaaactctagtgggtactagggaggccaacataagtgagccaaggtctctgtccatagggtgctccctttctctgagggatgatatggttgagagcaccacattgggagctgaaacgcccaggttttaatcttggctctactgcgtgcttaaatctgtgcctccgttaccccttatataaaatagagataaaaatagaacttgcctcttagggttattgtaacaattacatgagtcaatatatacaagtgttaggacaacacctggcctgtaataacagccaaataagtgcttggtaggattgtatatggtagaagagatggacatgtcagtaactaattgtaatacacatgataagtgctataatagagaaaagaatacagggacaaagaggaaaggatcagctcttctaaggtcaagaagggcatcaaagagtataaatacttgtactaggtctggaataaagtgtaattctgcaggcagatggggaaagggatacaattcaggcatagaagatggtactgcaaatcatttaggcatgaaatagtccataataatataaaacaagaataatgataaaaataacattcaataatattagttccaaacacagacatcatctcacttaatcctcacagcaacctaagaagtagggatgaatactatttctatgttatagacaagaaagctaaagcttagagatgtttagtggttaaactagccagtcgtgcaaaccgtaattcaaaaaagattacagcaatgcaggtctccagatttttggaatgttattaatcaatgtattagttatccattgctgcataattcattatcccaaaatgtaatgacttaaaaaacattacctcactgtttcaggaatctgggagtggcttagctgggtagttctggctaggggtcttccgagaggttgtagtctgatgtcacccaaggcagaagtcatctgaaggcttgactggggtagaagattcacttccaaggtggcttactcatatgggtggtgaatcagtgctggctgatggctggaggcctcagttcctcaccacacacatttcccatagggctgcttgagtgttcacatgacattgcagccatctccccccaaagcaggtgatccaagggagcataagaaggaagctgtggtgttttatgatgtggccctggaagtcgcacactgtcatttacttaatatcctgttggtttcacagttcaactctacgcaacatgagagggaaccacacaggagcatgaatatcaggtggcaagaatcattaaggagtattcttgaaggctggataccacaattataacttttttagaaaactagaaactttattgggttatcacagtttttattttgttgaggaagttaaaataaactcccaaataacttgtcatatattatcaatagcattttataagagcaaggacattttaatatcaaaaaagcaataagtaaataatctcaaaatataagcaagttgtttctatttgatagaaccacagtgatgtctttgttctcatttcactatggattgacaaaaacttgacccggaaaccactggtacaaaccatagagcatggccactataagctataaaatcttaagctagtttctctgggccttgctttctttcattgatagaattcattcattcattcattcattcaacatatatttattgagcacctagtatgtgccaggctctatattaggcattgagaatttagcagtgaacaaaatagactaggtccctgtttcgtggaatttacattctggtgagggcttgtaggtaacaaacaagaaaatactacatggtgataaatgactaattgatattgaatgactaagaatgatctaagaaggagacatttttatggtgtcatctaaatgacaagacccagtgagccctgtgaagatcaaaggaagtatattttacacaaatgaaatggtgcaaaatttcaaacatgggaatgagcctggtggataagggatgaatgatacaaaatgagatcataaaggtaagatgtagaaagtcattgagggtttcaaaagtcaggacaatgagcttggattttatacgacatgggatagaagccactggaggtttttaaataggggtgtgacatgacctggttttaagattactttggatacaagagggagaagtgagtagagaagagccaaaagtaagcagattaattaaaacttgcagtggtacaggttggacttgatggtagaatgacgttggatgttttcaagttggaactgaagactttgctggtggagtagctgtaggtagtgagagaaaataaacaactagtatcaagcttacttttggggcttgagagatcagtggatggggaagccatccactgatcaagtgtgagatgatcaagtgtgaaatagggataataatgaagtttatttggtcatattacatttgagacactaagtatacatccaagtggagagattaagtgggcaacttaatctcaaacttaactgcatcttggaattacctgtagagttaaaactaatgcctgggcccactcctagagatcttgacttcattcatctagggtgtagacattaagattttttttaatatcctcaaggtgattctaatacatagaaaactttgagaccactgactaagagatctaagctagggagaggtcaattgaaggtgtaactttgagtatcttcagggtatagatgattcttaaaagccacaggactgattgagatactttggtgagatagtgaggctgaagaagagaaagccaaggcccaagtcctagggcacctgtattagtctgttcttatgctgctaataaagatgtacctgtaactgggtaatttataaaggaaagaggtttaattgactcacaggtccacatagctgggaaggcctcacaatcatggcaggtgaatgaggagcaaagtcacgtcttacacggtgacaagcaagagagcttgtgcagggttactcccatttataaaaccatcagatctcatgagacttattcactaccacaagaacagtatgggggaaacagacgccccccccgacccatgattcaattatctccacctggccctgcccttgacccatggggattattacaattcaaggtgagatttgggtggggacacagccaaaccgtgttagccccccaatccctggggcaccccaggtttggaggttgagcagaggagctggcaaggagcttaagcagcaacagccagcattgagctcagaatgggtgtcaggccatttgtattcctctttgtggcgtatcaggtgcctgtgaggcaggaattaacttgatcattttcctccctctgacttttctggggttattttcctacaacagggaccagcctcttcaaccttcacctctgttgattgtttggctgccactcaggcccatttctattccctggtcagtgtaatgcaaaccaattcatttagcagctgttcctccttctgattgtttgttccaagacatattattttacatttgtccacattaaactgcattttatcattcattatcccaagtccttcagtgatctgggtccctctgcatttgattgcaaggctcagtgatttgtggtgcctgcaaaagccatcatttgcagatttgaaatccttcttgcagggccattacgtgggtcattagcatcaataacacagagcagttgtacctggcagctttgcagaggtaggaggagacacaaggggctggagatgggtttgttttctttaccagaggacacaaagacactctagccctcccatctcccactcccagcctatgggacttcccttccagtcctgatgatgacacagagagagtctcaaatgatttacagacggcaaatctgggtcttcatgccatcttccccatcattcatagcctccaaaaatctcaataataaaccgttcacagcagcatgcctctggctatctctaatcaagctgggtgtatttttcaaccatccctagcctaattgtaagggatatttctggagatcaaacatatatttgtatttttagcatgagagtcctcagatggctatatctggtaaaccatatgtccctcctaacatcctacaatttgcctttgacccacatgtgagacctaagaaggtgttcaagtgggtaatgcctgtctaatttttgcagtcaggaattcaaggccaaatgtggagctaagaaacaaaccacccaccccaggcatctaggtatctctttctctgcttcttttaatggcatttgatttcattattttcagcttacactttttaatattttaaggcattataaattctctttggaggagtgagatataatcaaagaatccatttattttcttcacaatcactttgagagcaccaactctgggccaggtggtggatccggatgtacagaggtcatgtaggcataaagaagtttccaatctcatagtgagcaaattaatactaaagagaaccattaagctttaaatgtatttttaaaattctgctcctctgaagcccattcccacatgttcttttagtccccagatgtgtcagcgatgtaagctatgcctttcaaccagggcatggcacgttttgggtagttaaatgatttgggaggctggcacttagtacttaatcagatgctaggtgccctgctatgctagaaaccagcctccactcacatgacaatagcaccccactgataaacactgggaacggtgggggtgcactggtttcctatggctactctaacactaccacaaacgtagtggctcaaaaccacacacatttattatcttatagttctggaggtcagaagcccaaagtgggtttcactgagctaagatcaacgtgttggtagggcttcattctttctggaggctgtagggcagaatccatcttcaaagccagcaatggccagttgacgccttctcacactcatcacactccaatctctggtcccacattacatcttctgtgctctccctgctccactattcacttggaaggatccttgtgattatgttgtgctcacttagataatccaggataatctcccccttcttctcaagacccttaacttaatcacatctgcaaagttatttttccatgtaaggcaacattttcacaggttctggggattagaacatgaacatctttaaagacctatttattcagcctgccgcagggtgggaccaggcttaggagtctgaaggttctctgacagtctcagtcactagagagtgatctaggcaacccccaattatccttcctagagtggtggtcctattaatattcatttatccatgttaatccagtggagcactggctgccacatatcatgagtttcagagaacacatgtgcacatgccttcagtgggtggcttgtcccggggtttcttgcatttagtagcagcctttgccagagagcacctttcatcctttatttcatctgtcaataaacgcgaattccttattttcacatcatccacgctgtctgaagtcacccaaaagtgagaagaaaagttcaaagctttacgtattgcacaaaaaagaaactggttacacagataattggggtatcaactccatcaggaatggataatattaagacctcacaggcggctttaccatttgcaaaacgttttcccgtcgattatctcatttggtccacacaatggatctggaagcagtcggagcaagtgagatttttttaatcaccattttacagaagaaaaaactgtgaccaggagagctttactaacttgtctaaggtcacagagctaataaattacagagctgtaactcagtccttggactccagttacagcggtcatgtcctctccaccacactgactctcaaagctctaaggaactgatatgcaaagcagaggcaaattttaaacccatcttgtctgtgtcttaattggacctgtcatttctaaggaggcaccatgaagccatgaaaagggtttagaattaagggtcaggcaaagctactttccacatccatataacttggggatgatgaattacagtttaatgaagtgttttccaatctagccgatcattagaaacccctgaagtgatggttaaaaatacagattttcatgtttccccagacagtaggattcagtaggtccaagggagggacaaagacctctggatttataataagcatgcctggtggttcttataagcaggcaaatttgggaaataaccacccacaggatttttgtgtgaattaaatggaatgatgtatgtatcaagcacccgccactgtgcctgctacagaggagcccttcatcaacgtcaggtttcccttctttgccccacgtttatcagggcgtgttccgtctttccatttccttacatttggttattaatggtaaggagacaagcttctgtttccaatgtatatacaaaatttcagaatgttctcatagaatatatggccatgggtaggtggggtaaatgggatgaagcctttgggtggtggcagtaaatggtcgcttaagaaggaatccgctgggttttttgaattctcttcattttctgtgttaactgtaattcaccatcccctttcacctttatccagggagcaggagtatctagcccaacgcatttattttacttacctgctgatttataaaacccaccttctgccttgagccctgagtatattatactcatgtaaacaataaaccccatataatcagtcttgtcaaccaaaccacatcccctgagataaattcagcctcctcacagtggccaggggaagtttcattttgccagcggtttcagcttgtgccttggcccaactctcagaataaacacccacataaatccacctggcctcccatcttatcagtgtggctgcccaaccacgttttttagaaacccgatggcagactctgcccggaaaacaaatggccacttcatggccagagttttcaagagtcttcttcctcagctggggctctgcaaaaaaaggtggtccctacctagagaacagggaccatgtcttatttctatctgtccccaggatcgaatgcagtgcctggcattaggggaaaacatggtatgttgttgaatttacagaccatagagcttggagatttatggtcagattttttgctaagacaaaaatcaaagcaatcctgcatttctcccttcaccccaaacagccacagatcagaaaatcaaataccccatgttcccacgtctaagtgaagcttaataatatgtacccatggacctagagtatggacttatagacactggagacgcagaagggtggcagggggagggatgagaaattacctgatggctacaatgtatgttatttgggtgatggttacactaaaagcccatattttactactacacaatatagccatgtgacaaaactgcaattgtaccccttacatttgtataaaaagataaacagccacgacttatttttctcttaccttaaaccagtggtctcgatcgaggaccatattgcctttcaggggacatttggcaatgtctagagacagttagggttgtcatgactgggggtgctactggcgtctctagtgggtagaggccagggatactactagacatcctacaatgtacaaggtagcccccacaacaaagaactatccagcccaatatatgaacagtgccaagattgagaagccatcccttatatcaaccaatgctatgcatggctaaaattggttcccctctaattttcccacctgctattctgatgccaacagcagcactgatggcatcagaaaatcagttcgtgttcattgaagcaaagagagatggaaactcatttacagggcacccctgagggccccaatattgtgctaagcctgccccacggattatctcaatcaatacttaaaacaatctattaccatacccattttgcagatcagaaaacaagaaaatttaaaataacttatccaggtttcccagctaggaagagacaaagctgaaatcatacccagctctttctgattgcaaagctagccacctaaccactgtgcagattaaggctggaagactggttgtgaataaataattgtcattgaccttcacccatcatgcaaatcttatctttcataggcaccataaatattccctacaatatagattctctttggatttgtactctaccctggcattctggctctctgggaatgttgggggggaaatggaagtcttttggtctcactgccaagcaatagcatcaatctgccctcttgcttggtctccattcatcactatccaagtgggttccattcccttcatccaagtcttttaatttctcaacctatggtcattctacaccacagaagagtcctcagactgagcatgttattgagggtgctgttgacattcaggggaggacatgtgaccttgcccagaactatagtcttctgcatcccactgtaaatcctttagcattcttgactcctggggagtaagtatcaggagatgtcccctaattagtatgacaacccaaaagagatgtttccaaacactccctggggaacagggtgcgggagtgtcactccccaactttgagaaccactggcttccaaatgctcacccagaaatccactgttatacctggccttcattattgctcacggatacacatgtagtccaccatacacttgcccaattggtttaatcttccagagctgggaaccagagtttctttgtgtcagagcatttctctttcccattcagaaggaagctggcagtctggacagcaacctggcttaaggctttcgacactgagatctgtagtcatgccacctgctttccttatttccaagcctatgcatttactagatttccttcctccccaacggctgccactcagatcctactcactggtcaagctactcatatactcttcctccatgaagtcttccctgatgaatacaactggaaatgatctttccctctctcttgaaatcccatattactttataccagggatagacaatttttttttccagtgaagggccagatagtaaacatgttaggcttcgtgggccatatggtctcagttgcaactactcaactctgcctttgtagtgggaaagcagtcacagacaatatgcaaacaaataggggtgactgttccaatgaaacattgtttacagatgctgaaagttgaattttatataattttcagttgtcgtgaaacagccttcttcaattgttttggtttgagttttttcccaaccatttaaaaatgtataaccatccttagttcatgggccatacaaaaataggatatggcctgcaggctgtttgctgaatctgctgtacggcatctcctttttattgtggttatcacactctagcccctcagaccaggaacacaggcttcacctctgtgctcttagaaatacggagtctccatttgggaggctgaggcaggagaatcgcttcaacccaggggttggaggttgcagtgagctgagattgcgccactgcactccagcctggtgacaaagcaagactctgtcttaaaaaaaaaaaaaaaataggccaggcacggtggctcatgcctgtaatcccagcactttgggaggccaaggcgggcagatcacgaggtcaggagatcaagaccatcctggctaacacggtgaaaccccatctctactaaaaataaaaaaggaattagctgggcgtggtggtgggcacttgtagtcccagctactagggaggctgaggcaggagaatggtgtgaacccgggaggcggagcttgcagtgagcagagatcacgccactgcactccagcctgggtgacagagcgagactccatcccaaaaaaaaaaaaagagaaagaaaaacagtctcagaccctgccccagacataatgaatcagaatctgccccagacataatgaatcagaatctgcattttaacaagattgccaaaggattcatatgcacagtacagtctgacatatgatgctgtggtttactgtatacttgtttgtgtccatgtcccccacccccaccaataaatggtaaactctttgagggtggagaatgactgtagcatacaaataagaaatgcaattgctttggaacatgaaggaatgaatgaacggagaaagcttaagtctacagtcaatccttgtccttctttcccttcattctattattagtctctcccaaagcttagtttcctatttgctggctaatccattagggaaggagagggcttactgtacctaagactttctttgctaattaagataaagagagagacagaaacttggaggagacttcagatcatcccaaattgtttaatggagaaaaaatgccaattttatgctcctggatctgtctctcaggagaacttgcctgcatccttctccttcacatttttctcttgactgcattacaccattcctatggccctgtcttagatgttcacctgtcttagaagcaactgagttattaataactttcatagttcctgatttttacctgaaatccctggaccagcaaggccaagttaatgaccacatacacatgctggagggctgcgtattcgtcatctgtgttccccacatggactgagggattttcagttatagccagaagcaacagaagtaaaatattttttaaacggctttgcttttccgaataagtaaatcagttattcaggctcagcctttcatcctttattgttctataaacatatatacatatatatttttaattaattttaacagtataaaagtaaccattttaaagtgaacaatttaatggcacttagcacagtcaaaatgttatgcaaccacatttatctagttccaaaacactttcaccattccaaaaggaaaccccattatctattaaagtcactcccatttctcccttccccagcttctggcaacctgtctctatggatttacctgttctagattttacatattattatacaatatgtgagtttttggtctgctttctttcacatagcatgtttccaaggttcatccacattgtagcatgtattgtcatttcttccttttcatggcaggataatattccattttgtgggtataccacaaattgcccattcattcattgatggacatttgggttgtttctaccttttggtattgtgaatagtgctgctgtgaacatgggtgtacagttttcagtttgggtacctattttcaattggcagccggtgggggggggggtgtatacctaggagtggcattgttgggttatatggtaattgtatgtttaactttttgaggtaccaaattgttttgagtgcttaccccgtaccaagcactgagttgaagagttcacaaaatagttcacttggatgacaaacatctagagccaagaggagacagagggccacagtagttcaaaaagtctttaggaatttatgacagttctctctctctctctactccaccctgtctccctctttttatgtacatatttggttttttttaattatcagcaatgattaataacagcagtaaccacttctattagttcattctcgcattgctataaagaaatgcctgagactgggtacattataagaaaagaggtttcattggttcatggttctgcaggctgtacaggaagcatggcagcatctgcttctgggggggcctcaggaaacttacaatgatggcaggagcaggtgcctcttcatatggctggagcaggaggaagagcacaagggaggaggtactacacacttttaaacaaccacatctcatgataactcactcactatcacaagaacggcccacagtggatggtgctaaaccattcatgagaactccgcccacatgatccagtaacctcccaccaggcctcacctccaacgctgagtattacaattgaacatgagatttgggtggggacacagacccaaaccatatcaccaccatttattgaacaaatattattccacatagtagatattattaacccattttgcaggctcaagtagcagaatcagaattcaaaccctggtctgtttgacaacaaaatgtatgctctttcaacacactactacattaccacttcctgacagcagaaaaaggaaaggcttaaaacaaacaccagatatcaaatcgaggctgctcttggctgtcaggaagccacagagggctactctgtggccatggactctgtggtagacccatcatcacatttgcaggctggcctgggtggtaaagaagagcacagtctcaggattactaagataaccctgggttatttctactgtgacaagttaagagcccctgacatgatatggaaccgaggtgactctgcctggaatggtagggttttgcagttgtaagtgaagtgggtgcacataacctgctaaaagtggggagtgttgcatatgattcactgtatttaagttagagaagactaaaagctatctctaaaagcagtatctgacgctcactttgcagccaatagggtttctgatgtaagagcaacaagggtaacactgcacctacatctatctcggagcttctcagtcttgagtaatcatcagaaacacctagagggcttcttaaaaacagattcctgggcctcacccccagaaatgctggtgcagtaggtctgggtggggccccagattctgcatgtctaatatgctctcaggtgatggctgtgctgatggtgccactcacagcagacaatcagagtggggtagaggagtaagagcaagtgagcaagagggacaactgtgacagattcccaaagatgacttgaactactttggccctctggtctcctcctggctctagatgttcaccctccaagtacactatctcgtgaactcttcaactcggggcctggcacacataagtgctcaactttaaaatataggaaaacagtttggtggttcctcaaaaagttgaacataaaagtacagagtccagcaatgccggtcataggtatatacccaaaataactgaaaacacgtactcaaactaaaacttgtacacacatgttcacagactccacttaagtagcactagccaatcttatttgtgccaagactcccaataagcagccattgctgacttaccattaatacttaggaccttacaagcatcacggtgcttcatgtccctacaagatatgtgtagatccttctcaaaagcagagtgttccgatgggagtgtctctcacatgcaaatgtcttgcatgtgtcaagtaagagaaaatcttattcgttgggtacaaaagtaattgcggtccttgttcttaaaacttaaaactaatggcaaaaaccacaagtacttttgcaccaacctaagagaactactgattgagagaattgggagttgttgtgtgttttttgtttttgtttttttttttgagacgcagccttgctctttcgcccaggctggagtacagtggcgcaatctaggctcactgcaacctccgcccccagggttcaagcaattctcctgcctcagtctcctgagtagctgggattacaggtgcctgccaccacacctggctaattttttttttttttttttgagatggagtcttactctgtcacccaggctggagtgcggtggcgcaatctcagctcactgcaacctctgcctcctgggttcaagccattctcccctgagtagctgggactacaggcacccagcaccatgcccagctaatttttgtatttttagtagagatggggttttgccatattggccaggctggtctcaaactcctgacctcaggtgatccacccgccttggcctcccaaagtgctaggattataggcatgagccaccatgcccgactgagaactgggaattttaaagggcacggatcccattcacattgctcaggccatacagaataatgacaattatgctaattactcctccaaacctcatggcagtttgggggactatgcttttccctcctccggctgcctccatgggcagcatcctctgcaaaactacgctttcttacctccttgcctcttacaaaggagcgcacagccttctggagacagttctgtttgtttaaggcaacggggggcaacaggctgtgtgctgaagatgaaatgggagccatgttaatttcgtgttaatgacagcagcgcaattttcttacaggaaataactagttaccttaatcattttaagtagttattagcagcagcctaaaaaggatggctatgcttatcacaatacacgcacaaaggaaatgaagacatgaataacaggaccttaaacagacttctggcatcttccttctgggtggtattaaatggtattaatctttttaactgacttcaatcctgagtccacggccacgtgataaaatgttaagtgaactgctggaaatagaggtggtccccccagatttattgtgccaatttaccagcagcggaagagcacaccactgcggtgagaaaagccatagaaaagaaagaatgacaggtagatgtatggattaattagtataatgcagataatagcatcttttccaatattaatacttcttcagaggctgttctatatatgcctctgggaaagaaaaaagctagaatatattgtttgctatttcatcccatcccccttgcaagatagcaatcagagttaagaaatgaataaaactcagacaactttatccagaccacagcgacacaataaaaaagaaaaagtaaccacagaagaaggataaagtgcttgttcaagggttttacagttaagacatgtcaagtaatttttttcctaagtaagaagactatttttcttccctgcagtggttgtgcttgtgaaaggaatcagttggatcaattcagaaaaatcatctatatcaacaaagtatatttagtgcttatggtgtgtcagaagctgtgctaggtcctggggaaataatttctataaaccactgtctggccctcaagcagctctcattttacctgggagatgcgctgtacacaaatcattgcaatatgaagcagtagaggccttaatagaggtatgttgtgggcatgatggtagcagagaggcatgcatgagcatctctacctggagggtgaagcctgagcagggttttgaaggatgagtaagagttttccagatgaacctgggggggaaggacattctaggaggaggggaaggtgtgtttacagatacagatgtgcaaacagtcaggtccatgcagtggcttggcatggccggcttatgtgggctgggcagggaggtgaatggtgaagctggaggtcatggtgggcctttcaggccggataaaagagcctggacatttcccatagggaactaaggtgccactgaaggatttcgtttgcagggaagtgaaatgtttagacctagagccatcacaatggctatggagagactggcttcgagagacataaggttggaagcagcaagaccagttaggaagtgatgcaataataaggtgagagtacttgaggccctgatctgaagcagtagcactgggtataaagaggacagcaatagttgcaagaaccatgaagtgtattacaaaaattcacagaacttcatgactaatgagctctcatgaataaggaagacaaaagagtctcagtaggcgcccaagtctataaatatagcactgggaggatgatggccatgttagaggggatgaaggaagaggaggagatttggagtagagttcagggtggcaggataatgagcttgacttggaataggctatttgaagtacagaattcccactgagtgctcataagtccttcttgcatagacacaatgattcactacaaccagctgaggtatctgcatgaattgcctggggccatcccttggctctaccatctgggacatcaaggttcctgcttaccaaatgccaaaggagaatgaactcaagagaggatccagggctggctggggctagggggttcattttctcatcactgctcaacccagctctgaattcatggaccaagaaagcaaagaatggccctttcctgaaaccatccaatgtgataggcattaaggccacaagactgttcaactcagaaagaccaacaagagaggtgtgtgttttgtctcagccaagacagagtcaagaaaatccatttcttgggcatgccttggaataaactaagttggtggagttcttccaagtctcccctcctgcaaagccactggaactccctccccactagaaagcagccagagctcagggaactcattttaacttttccgggagaagactgagactggcagggtgagggatctgggctggtagaattcatttatgttcaattcagctcccctgggcagatagccctggcatgggaatcaagaaatgagctttttctgaatttctgaagccctttctgagacactggagaggactcttaaaataatgcaggctatctggagttcactttcattctggcttctggttaagagccaggatctgatattgggctcctggggtccaaattctagctcttcaacttattagaaaagtgagatattgggtaaactacttaacctctaagttttggtcccccggccccccaccactctgcaaaataggggtgatgaaaatgttattacctaaccccacaggggattcattgggaggctcaaataagataatgcttataaaacaccaagtacaatgccttggtgttgtacccagtaaatgttagctgcaatactgtactcacttagggcagctgatcccaacccaggtgctagttactcgtttgcaaaacagtgactaaaaccatgggctgctagggaactttatagcgctagcatgctgtgatcctgtacacactgggcattgagccatcatcgtggtggtggtagcagcagtagtattgtttgtgtgtgacgatctgtgtgtatttgggggaagaggtaataagaaatgtgggaatatgggtaacttaagattcttgagtgcctattgcatgtctggtggatactaggtgttttacatgcactaacttatgtaattcttacaacaactggggaaataaacagtattatctctaccctaaagatgaagttcagacaggttaactcaatgccctaagtcacagttatgaagtggcaaggctagggttagatttgtaactcttcttactacttacaggctatggaggaactgctacaagcagagaagctatcattgaaagcacagtcaagcccatattttaatgttactttaatgttacaagatttcaaaaggaggaagacagcaaattcatacaggaaaatccagaaggccagcatggaggagatagcaatttaggaggggcgttccactaacagaaattacagccaaaacaatggccattcctggtagagacaaaccgcatggataaagacccaaatgtggccgggcgtggtggctcatgcctgtaatcccagcacttttggaggccgaggcaggcggatcatgaagtcaggagatcgacaccatcctggctaacacggtgaaatcacgtctttactaaaaatacaaaaaattagccaggcgtggtggcgggcacctatagtcccagctactcaggaggctgaggcaggagaacggcgtgaacccgggaggtggagcttgcagtgagccaagatcgcaccactgcactccagcctgggcaacagagcgagattccatctcaaaaacaaaaacaaaaacaaaaaaaatgacccaaatgtgtgaaactgtgagtcatgttcagggggcatcaaaaagccccttcagcagtaggtgtatgttgtaaaggaggaggtgagagaaggctggaaaagtcaggattggactatggagaaccctgagggacagctcagggcagggagccttgaaggtgggaaggagatagcattagcagccgggaagagccaaaggccggcccccaatcagaacctgcaggaaagggttagtgctgtgcctggggtagctcctacctagaagacagaacctgagacttaacagctgacagatacaccaagccagctgtgcctatttctccacagctgacatgaagtaaaacactaactataggagtgcaaggggacttcattccacaggggttcatttatttagccaccccctaagtctgattgacaatcccaagtcccagagcacttccgtctattagaggccagataacttagtgcttaacattttgtttttggcatcagacacaagctcttgttctattaaaaactgtgtgacctggatacattacttagcatctctaaggctcagtttccttaactctaaattggaggtgataaggttctcatacgtcgatttttgcaaggatcaaatgagataatgcatcagaacaggctaacacagccctggctcacattatagcccaataatgttcactagaattcactagtggtggtgttactcattgtggatataagagacaagcacctggaaacttggggaagtatggatgctacagataaatccagagaaagagctggaatggagctcagggatcactgaacccctcagccagggcccaacaagagaagattaattccccagattcacgcatgagttggtgtcccagagattccagggggaaaaaaaaaaaaggaatgcggacccaatcaatcagggaagctccccacaatccttggtgagaaagcccacaaaccaggtctaacatgtggctctgccttttactgactgagtgaattcaagcaagttatttcacctcccccacttcagtttccccatctggtaaatggggacagtaatccctgcctgtacacctgttgtaagaactgaatgagatgacctctgtagggcattgaggaccctgctggcacatgggaaactctccttaaatggtagctactataattcttttaaattgaaggtcaggcaagggtccattttcatgctgctgagactgggtaatttataaagaaaagaggtttaattgactcgcagttccacgtggctaggggagcctcacaatcatggtggaagatgaaagaagagcaaagggaacatcttacatggcagctggcatgagaaccaagtgaaaggggtttcccctgataaaaccatcagaactcatgagacttattcactaccatgagaacagtatgggggaaaccaccctgtgattcaattatctcccaccaggttcctcccacatgtgggaattatgggagctaaaattcaagataagatttgggtggggacacagccaaaccatattgtgtccaaaattggcgggttcttggtcttgctgacttcaagaatgaagccacagaccctcacggtgagtgttacagttttcaaagatggggtgtccagagtttcttccttctggtgggttcgtggtcttactggcttcaggagtgaagctgcaggcctttgcagtgagtgttacagttcttaaaggtggtgcatctggagttgttcatccctcctggtgggttcatggtctcgctggcttcaggagtgaagctgcagaccttcgcggtgagtgttacagctcataaaagtggcatggacccaaagagtgagcagcagcaagatttagtacgaagagcgaaagaacaaagcttccacagtgtggaaggggacccgagagggttgccactgctggctggggcggcctgcttctattcccttatctgaccccacccacatcctgctgattggtccgttttgacagagtgctgattggtgcatttacaatcctttagctggacacaaaagttctccaagtccccactagattagctagacactgagcactgattggtgcatccacaaaccccaagctagacacagagtgctgattggtacatatacaatcctccagctagacataaaagttctccaagtccccacccgactcaggagcccagctggctttgcctagtggatcccacactgggccgcccggcagagctgccatctggtcccgcgcctgcactcctcagcccttgggcagttgatgggaccgggcaccacaaggccatgcgggagcccacggcggggatgaggttgcagggtcttgggcatggcaagctgcaggtccccagccctgccccacagggaagtggctgaggcccagcgagaattcgagcttggtgcaggcaggccagcagtgctgggggacctggcgccccctccacagctgctggcccaggtgctaagcccctcactgcccagggcctgtgatgccggccggccgctccaagtgtgggcgcgctgagcccacgcccacccagaactcgcgctggcccacgagtgcaggcacagccctggttcacacctgcgcctctctctccacccctccccacaagcagagggagctggctctggcctcagccagcccagagaggggctcccacagtgcagcagcgggctgaagggctcctcaagtgtggccagagtggatgcagaggccgaggaggtcccgagagcgagcaagggttgctagcacattgtcacctctcaatatcaggacagtacaccggacaaaacagcagcttgaccaagtctacagatcgaaattagactgtgtttgagaatcagagacctgaatttaagtctagatctgttgataaacaaccgagtgactttgggtcctcagctcctcctgtctgaaagacagtttcaaagcatcctggcctaattcacagaagggctattgtttgggttcagaaaggaagtgggcaggaagatgcattgtaatttataaagctctgcctgcaagagctgggtttctctctctctctctggactgagaaatgcttgaggccaagactgagtctcttcttgaaatcgcccctccctggtacagtagctggcatggcatgcatgccaccactctgtggatgggaaccacactgtacccactcgcccttgggaatgcctcagactccggctacccaagggataaagacctttccctctagctgacccagttctactggaaacaacctttgccctggcaaaagacagaggccccagagggagccatggtatttgggggtagaccctttgctgaatggttgggcctgggttacaaggatagggaggaaagaatgaaaaatggaatctgccccagagagattgggaccggtggtttccaagtaaagccacagtgctctcacatacacacagatacacttggaatggatattgaagtcttaatatagagtgcccacacgcctgttcccaagtgctgtcagcaaaatgctgtctctgtttccctcccagagcatattttggaagcttaggacaagggcaccatctggacttccctgcagtacagtgagagtaatttggctctccctccttctgtctcctttccccactgtcacccccaactcacctttcagtcacaggaccaaagatccctctgtaaaacaaaatccactaggagagaaaagaatcagctgcatcctgcacagaagtgacattcaatgaccacacagagtgcagcaggaaggatgttctaacccaaggtcattttttttttttttgcttgctcagcagaaatatgtagcacaaggagctatcaatcattcttccaatttacggatagggaaactgactttcctagccacagccctccatctgggcagtacacacacatatataccacaagggctgttttaaactgggtaggaggtatttgggattgacatcatgatggaagtactgcaagcagttagtgggagtggtgcaaaggttctaaaggccctgcaagcaaggggcaatcacacacaatgaagacttgctcagaccccactgtccattgacctctagcaacactgtctggggagcagggggagagctggattctgagatttaacttggcccaaaagccctcccatcagaagtcacaattcctttttcaatgtggtgcattcctgtggctccctccctcctatgtggcatgtaagagcccataaaacagatctcattgtcctctggcatttggcttcatttcaaattgcagcaatgggctggaatcaatatgactatccctggattgttcaaattagttcctgaatcattgcttttatacttttccacataaatgtgggtactttcttggtatttggtttttcttgccatttattttccaataattggatgaaatgtgtcttgtttcttggaataagctaatactttcctgtgcttgccaaaagttgttttgtgctcattagtcatcttttataatcttcttgggtgcttttcccaatttttcagaagcctgtgttgggatctcctattccctgcaatctgaattgatacatcattttcttatttgcttttttattttaaaaaatcactaaataatttgtggtgccttgtatagttaaaatattaatactcagatattcaaattacttttaacttgtcaagtactggcacatgagagaggttattaaatttgagtgatatgattccaggattaggaatacctggctcaccaagaacctgggcaggctctggaagggcaggaataggggaaagttggcaggcagttggtaatgtgatttctggaagaatcagacaccacattgagaaaaggcgctacagtaaagggtcacttccctctagagttttcaatcgagtgtcagaaacaaacctgctgtcatcaacattccctacccctgcacgtacaacccccttctccatcttcaaactttggatgactttccactgttctgaggatagacaatattcttaccagggtctccaagcatgaatgtggtctgtccttacctttttctcctgggtcagcctacctcattccccttcccttctgggctccagcctcttcctcttacacatggtcttccatgatgctacaggacacttgcatatgtgcctcctactgcctctaaggtcttccctcttttcatctcctcatgcccagcacagtgcctggcacatgggaaacacatacgggtttgttggaagaatcaatgagtgaaggtttgagatattttgttttgtttggatttggtttgatttgacctaagcacgatcaaatgaagaaaccaggagtcacaaagtggctgccaggagaccctgggactaagctgcacattcatattttttggccatggcctttgcctagccttctcctctgttgagacaagcagcctggtcccatagtcatccatttgcaaccccaggcataaacatgctgcctactgaaactttggtttaaatatttggtttcaattctacatacagtcacataccacctaacaagatttccttcaatgacaggctgcctatgtgacagtggtcccctaagactacaatatcgtattttgattgagccttttctacgtttagatacacaaatacttaccactgtgtgcaatacaattgcctatggtattcagtacggtaacatgctgtgcagatttgtagcctaggagcaataggctataccatataccatctgggtttatataagtacactctatgatgttcacacaatgacaaaatcacctaataacacatttctcagaatgcatcctggtttttaagcaacatgtgactataacttaattgactttgatggaaactcaagaggcaacatcctatatttcccatcagtgttttagaagaatgacaaaaccctgtccttaaaatctccatgttttccagataaagaccctgaggtctaaaagggagcagtgactcaccgagcacacctacctactgaatgacagagctgtcattcaaactcagcccctttgactcccagccctgtgctctttctaatattcatcccctacagtcaatccactgcgggtttaatggctttgaaataaaccagtgtgtgtttctgcttattaagtatcatactttatgcaattaatgtgtacaaaaccaagcctagttttgtgaacagtttatccaaatcgctgcgcagcttcatttatgagaggagagaaaaccctcctctgttatctaatagatgttatgtgtctaattttccatgaatatatcagttaggacagtagccacctaaagtgactcttctgaattaaccctgagtgaataagatggctttggcaagcagtgtgtgaggattcagtctttccttcctccaggatggggactaactgtgaagtgagctagaaaagtcttctccgtcaaccccttggtgtgcatctactgcaggtactgagagtcattgcccctggatatttgaaaaatcacattcctctccaatttagttatatctataccagtgaagctataaacttttatgaataactataagaggataaaacttcgcattgtggtctcccgaaatatcattcaatcacattgccctctggacaccacattgctgaagctttcagagcctttctcagcatcacagagacatgctttggcctgaattgtctcatgatcatctagaagctgtcttccttgttcactccagagctcagacctcaggcaaaagacatcccaggcatcaggttgaagcattagattctattttttttttttttttgtatacttcatccatttaagtgagaagtaattccactaaaatggatgttaatttggttagctctatctaaatacaggtactccatattgagatgttcatgtccctttttttctgcttcattcaattgatgtgctagatcacattggaagatttctccagcattgatttacccttaactcctgatatgagccctacttgattgtaataaattatttttaatgctgttttccactagctagtattaattttggctttttgcatatatgatcgtaaaagatattggcctattttcccctcaaatatctgctggaatatacttataaacccatctagaccaacgcttttttttgcgtaggagatgaccaaaaataattcttgccttaactcaaatgaactacataacattaaatctctacaataattaaaacaaagcgagcctttattaatactatttatgtgggctctggaatgacttaatatttaacaaaaatgccctacacataccagtacagtggttctcatgggacaaactcttccacagaaatagcaacaatcctaaaagagaaaaggtatttggtatgagacatgttcagtatatctattttcataatacaagaatacgagctacagaaagaaaagactggcaaaatcttcttggtagtcatctgacaataagataaagtaagatgcaaatgtgaatgatatatggactgtcaagaaatacagtcccaaagtgtgaatggcctgactttgttgttatctatggaacttaacacgtcacttcatcattctagggcctctccctttatcagagccccagcagccagacatttctaataataatcactgcaactcccatttaatgagggcttactttgtgccaggcactgcatttgaagcctcctttatcccatgtacacctgagctcatttacatgttttggttcatttaatcagcacgattatttgagtggttatgttgtcatcacagttttgcctgtgaagaaattgaagttcaaagaagaccagaagacccaggacttggagccagagcctaactctcctcatccatgccctgtgttgggatgagtttgaggttgcaggagcatggggaagaaataggcttaactaaaatcagcagaagtttcaaaaggacctgcagacctcatctctcattcttggatggtggcagccactgcctacaagtcacttctgggaggatctagacgtcgtgcaggaggctcatcccactctggctttcagcagctcctttataagaagttgaaggatgcgaaggcctggggaaggaatcgagaaaaagtggtctcgaaacgcattccaagttccgggaaaaaaaaaaagcatcacggaacttccctgattctttatgtgttttatctcatctgtttatcttgtttacttataccctgccaagttcctgaaagactgtgtcattatcttgtttcactctcatgacaattcttagatagatgcatccctatattatgcataaagaaataatcagaggggataagtagccccacattacttggacagaagaggtatctgactaggctcaaggtcttgcattttccagcatgatcctgcacccaaatatatcactctacatttgtgcaaactcccatacaacttgatgaaaaacatgctttaaaatccaagttgtgttatcttttgggggaaaataattacattccatgctggttttctaggttggtatgatagccagaccacatttggggatcttctgtcaatgaaactatggaaaattatttttatttttagccataattgcattccatagcctacaatgcagaaaatctcatcaccggacagacccatgatagttaccaaaccttagggtgagaatgtggtggctggtaaacatcaaactgtgttcttctctgcagactgtgtgtgctcttatgcatgaagacaaacttgttaatgactttctataaataagttctagcttatagttgttccagcaaaagctgctgaaatgtgatctcccctcaaatacagaacacctttccttttctctttactttcctgtagaaagaaactatttgcatatgctaatgtgaaatgaatagtcactgtcactttttgtctgtgtgacctcagaagaggtgcttaacctctctgtgccttaatgtcttcacttcacctatttattttaggaacaaatgtggtaatatgggtgagctgttttaggctatggaatatacagcattcatctctggacttctgggatctggcatagggtgggcatttgggacctatacgttgactagaattcagctcatttgagttgaatatgccttgaaaagtttaaaggactatataaaggtaacaatagtaatcatcatcatttaaaggaaagggagagcttaatgcttaggttctctcaacatgtattttcctatctgtatagaacacttactggaaaatatatgactggaagttctttattcatctcccaaatttaaactagcagcggtcagaaaactacagtcacagaccaaatctagcctacgctgtgtttctgtagctttactggaacccagccacgcccattcttttatattttgtccatgactgctttcatattataaaagcagaattgagtagttgtgacaggtactatacagttggcatagaaaaatatatttactatctgaatctttacaggaaaaagtctgctgacccctgaattacagtatgagccattcggaatgcatttctctttaaaagttctcgcctcattcagtgtctggaacacagtgggtgctccccaataggtgacaccttcctcaagtttccttgggagaacagactcaatgtcggatccacaaaggagacctgcacatacctaacccctatttctgcagaagctgaaggctgtattatctattgcttgcataataaatattgcataacaacaacaatagtagcttactatggaatggttactgcatgccaggccttgggctaagtgcttttttatattcggttttatagaatcatcacacagtgctatgagtattagttatgaattattactatccctcttatagatgagagacttgctcatgtaaggggacccaagggtgaaaccaggctttgcaacccacgcagcccaatgtgatactcagtgtcttggttcccattagagataacctttggaattccagactgttctttaaccagttcagccaagcgccttgttctctctgtcccttgggacatcacacttcattgtacaatagacagcctgcattgcttcattcattaacaattatttatttctgccttgatacagttaatatgtaccaggtataggagatgtcacaggggccaataagatagagcccatgcctggatgaagcctaaagtcagtctagggaaagaggtgagcattcatcagtcacacaacgaatgtcaagctaaaactgtgatatgtattttgaaaagtacagagtgccatgacagtggatcatggggatctccctcaacaggtgacccttgagctgagatacaaaggagttcataagtaggagtcaaacagtgaagggagggaagtttattccctcccttctctgtttaagggaagggaagcataagaaacagaataagcatgtgttctaggaaaggaggaagcccagtatataagggaggctgaaagaaagacactgagcagagcacagaaaacaaggacacatggttagaaaagccaggggccccagatgtgcatctttatgttacaggcaaggggaagccactgaggtgtttaagcaggggtaaggtgatagcattgtcactgtgaacgccacgtgtggtcttctgttccaaggctgctcttttgcgctcacaaaagggcttctgctaatggagcatcacgctgagaaaggtgatctaaggtctgagaacacagcctgttgccctcctgaggcatgaggggtgagtgagcagcccccggcatgcactagtgcatcaccttgctaccacaaaatgaaaactctgagacctgtgcaactgaagctgctcccagcttaacctatgacaagtgtggcttgtgtcaacttggaagcctcttgcagcaggtctgcttatttaacacagaggagtacttgtctgttagcttgaaagctgagttaccggtcaccaaaggccaatggttttcaggcttccacttcaattaagtgcataggagaaactttgcctctggtcctaagaaaattctaggacataagtgaaattcttcgttacccttaggatggaatcaagaccccctaccttggcctgccaagctctccatggtcttctcctgccttccaatacaatttctcgtcatatcaccctcccttacttaggagttgttcaataaacacatgttgaatgattggatctatgaatgactgtataatcatgggcaagacatagctcctctttgatcctcattttcttcatttttaaaagtcatgggctgagaactaagaccttgattttctctaagaccccttctaagattctatgagatgcagaattggtattcattcagcaaatgcttgccaacatctcctctgagccaaatcccatcaccagggatgtgatgatggatatccatgcccttgagatgtttacccaaaagtagacacagactcaaagagaatagtttcaaaatagcatgtgcttgagtatgaactcaaatagtcacaggaactgggcacaatcccacctctgccactatctctcagaggcttggtgtccccatgactcaaatggaaataatggcactaactcatagaagttttcaagaattaaatgagttgtttctgctggcatcgtctctcacacaaagaggtgttcgacaaatgttggtaatgatcatccaaagtggtgatgatgactaactttaacaatgatattcagcactcatgtgactgtactgggcgtctatggtttacatctgttctgatcacccggtacccatcccattttggttgcaaagtattttgaattttgattagtcagggttctccagacaaacagaatcagtaggctatatacatagatatataagaggagatttattgtgggaattggctcacaattatggaagccaagaagtcccacaatgtgcagtctgcaagctggagaaccaggaggtgctgatggtgtaatccccaatcccaaaccacagggagagaggtggtcgctagtgtaagtcccagagtctaaaatctgaaggcccaagaaccaggagctctgatgtccaggggcaaagaaagagggatgccccagctgaaggaagagagaatcctccacctttttattctattcatacctgcaatagattggatgttgcccaccctcgctgataaggccagatcttctttactcagcctactgattcaaatgctaatatcttctagaagcaccctcacaggcacacccagaaataatgtttttcctgctgtctgggcatccctttgcccagtcaagttgccatataaaattaaccatcacaaatttgcctcctgggtgagagcatcatgagagcagaagggagctgcacttggtgttcagagacagtgtttcatggaaggtgtcctggagaaggtaagacacaaagagaatagttgcaaaatagcatgtgcttgaatgtgaactcaaatagtcgcaggaattgggcacaatcccagctgaactatgaggtaaagaagggtaggcaaggcttcctcagtccccactttgccctcctccacaccagagagatctttcaaaaatgcacatcagatcaattggtttcttatttaacacctgtgacttcctattgtgtttggaataaaatcaaagctcctcaccatggtctacaaagccttgcatgaactggtcccatcttgagccaccttcatcctttcccagccattcctagccgcttgtccctatctcaggctctttgcattggccgtgttctctacaagtgatatgcttccctctgatcttcccatacctggctcctggtcatcaggattcagctcaaatgttagcctacccaaagacttttcaccaaccatactacagaatgttgcccccacttctgcatcctcgcccccattctttccactactacctttcaatctgtaagtaagtcaaaatcttgttttgtttccttcaaagctatctttgccaccatctgaaactatctctaggaggacaaagaccttctcagtcttattccaattgacctcagcacatagttggccctcaaagattttttgaacaaatgaattccaggcccatgtaaaggattgaggtgaggtggcctttctgaaatgagaagtcaagtcacatcagatcatggaggacttcttagatatagagaatgcactgcatcatggcaccagccatgtgggagcatcatgacaagactggtagtattctccctggaagactgcctgccatttctcagtcttgcatttccaggaagcttctctaggaggatactcgcctaaaactaatttaaaaaatcaagattattaaataatttccaggaatccaggtttaaccctttcacatggtaatgccaactaaactagcagaagccctcaaggcatctctttaatgaatagcttaaattcttgaacttgaacttggtgtttaattagcatgtcatcattagcccccgaagagtttgctctcattgtccctgcagtcttagtcaaatcatgcacttgctcagacagttgaacaatcacttattgatcatctgtttcacatcagacactgtgattactctgcataagccttaaagttggggctcagttaaggtatagcttagggcccatctaaattattcaaaattcagactttatatggttgagatttaaaagtgttacctatacatggcaaaaagaaatccatccacaggcatcactttcagaacccatctgccaatctgatactctgtccctagcaggatgtggtttgcacattgctgctccccaagcccaaagtcatggtaggagaagcagtgaaccctgcttttctccagacccacctggacccatgcatattgtgagtggttagtgggtattgggttagcattattgtgcctggctagggaagagcaaaggcaacagctgcaggaactgtgatcaccaccaacaaagacctggaaggcagtagaaaggaagcagcactttttcatggttaagacctgctgttcatgcatgaactgatacaggtcccaggttatctttgatgcccaaactgtgttcttacagctgagaacaaaaagcctggtgactgtcaagctgtctcctgtgctcttctgttgctcctagatgttctgttgcctggggaaatctcctggtgcctcttcagcacacaaacatacacattctgtaaactgcaaaggcctatagagcacatctctgccttaataaccatcatctgaaattaaataccccccaacctccacctctattttctcctggctccaatctaccctcttacagtccatgctgattatctcattcccctgctcaaagcctttctattgctgacattccaggggtcctatgatctggactcagcctgttttccaacataggtgatgcatgtgctccttaacccacccaaattgaagtggagaaggggtaaacagccagacaaaacaggactctgctcaccagccaacagtatctgctatagcagcacttctgaaactttagcgtgcatccaaatcactaggaatttgagaaaatgcagatcttgattcaggagacctgggatggggctcccgattctgcatttctaacaagctcctagatgctgtggctgctgctgatccctagagcgcacactgtcatcttattaacatctgactgggggtcagaaagaaaatgctcaaaactcatattcaaaatagctttatttctagaatgtattaactataaattcaccagttttgtaaagcaaaagatcaatttcatgtggttcaacctaacacaatagacagtccatcaacaactactaatagaaaccaaagctcctgatatcagaatcctagccaactcaccttggaacagagaggaggcatgacttcagatcaaagttttaaatgtgttaactcaagcttaaagcacagcctcagccctgtacttgccagctcctttcttacagttcctggctcccaaaagaaccccaccctgagaggcagcccatggcccaggagacttcttcctgcctttttctgccttgcaagctggacagaaggatcactccactggattgcctttcatgtccctcctctgttcagaacatgctttaacttcaaggcatgtctggaagcactggcacatcccctggcagttttgttggtcacctgtatcagtgggaagaagttagcagatggcagggtgtgttttgttctcattagaagcttactcagcactggaagggaggtgtgctgagtgtgtgagaaccccccagtccctggttcttccaccacctggcaacatttctccacctgcagaaagtcctggttgtgtgggggtacaagggaggggggattaaaagtcctgcggaggcagagcaacgcctggcctgcggttgcctttctgatggcagagtagctactatagagtcatccatctccactggcaaaactcataggtgaaaaagcaataagcaaataggatatttcaagagcagcagtaacatgtgctctcttcatgagaagttcctctacacctcaggaggctcaggatattctcagattcaaggtactgtccatctgactaggcattgatgggatattaatgttcattgattatgttccacttgttctgaagtccaacttccctctagctggtaagcttttgatgaatacaagtatcatcccaaatcaattaaatcagaatgtgagaaggcatagacaggcacaggtgggctttaaaagcacccaggtgatctggatgcacagtgaaggtagcaaaccactgggttagatatggtttctttttctcaaagttcaaggaaaagcatcttttttgatcatcacatttctcaacttctaaaacttcaccttttttaatgcaattcaagatattggcaataatgagtactctcttacactttcagagtcacaaatcacttctacatgcactatcttattggattctcaaatcagcctgtggaaaatgctaacaccattacagaaagatatatgatgtgcttgctgtgacattgtttataagagacaaaaaaatggaaacaacacgaaagccagcgagaagatggttaaatatgttatgggtgtttgtgcaactgagaattctatagttatttggaagacttggggagatctatatgcattggcttagaaagatagctacaaactacttttaaattttaaaaaatcaagttcagaatcataattattaatcatccctttctgtttttttaacagttactgtggactagggaatttattattttttatacgctatgtgtgtttgtgtgacttataagcacaaaacaagtaaccacaaggatgtacactaaactgttaatagttgtatgtatagcatggactagaattagaaagaggtggtggggggggcatcacgttttttacttctatattttaatttgttaaaaaattatgcttctggccgggcgcagtggctcacacctgtaatcccagcactttgggaggccaaggcgggtggatcacgaggtcaggagatggagaccatcctgggtaacatggtgaaaccccgtctctactaaaaatacaaaaaattagcctggcgtggtgacatgcgcctgtagtcctagctacttggaaggctgaggcaggacaatcacttgaacctgggaggcggaggttgcagtgagctgaaatcgcgccactgcactccagcctgggtgacagagcgagactccaacttaaaaaaaaaaaaaaaattaggcttccatactgttaagaaaaaactgttttaaaatcacagccctgagatgatgaattttaaggaaagatcatcatatccatttttcagaggaaacaattgatcccagtgatgtggggtaacttgatcatgtggctaaaaattgctggagcatctgtttgaacatatatgtatgtttatacacgatttttaaaaatgaatttaaaaaaattaagtaacaggaaaaaggctcaacaggtggactgatccttattgaatgaggaggaaataaagtcctacacaaccagatgaccgggacaggctggtgcatcagaagcctgatccatcagctactactgcatcttgcaggctggccagtttcatcccagtcatggctgactcaggacctaacagctccctgtttgctccgaggctgcaaggaagatttactggctgccagtggcagctgttggtggtgcagcagggacacaacatccacccctacagggcagttccgttcctaataaggaaaattcactttacacacgctttaggggaaatgtcctgggatggagccagagccagatgggctctgagcttatgaaaagcatgcttgttaccagaaaacatttgcaaatatgtatgggtatttttgtgtgcgtgtacatgcattttacacacatatgcacacacatccctctgaaatcccttcaattaaaattgtcttccaaattgttcctcaatatactttgcagttcacccttatgtaggggcaggtgctatgcctcataccttttaatgttggattattgttctgattcttgtttttccctcctgccaggtgcagctcatccactataaccatgagctatatacgaatgtcacagaagctgcaaagagtccaaatggattggtggtagtttctatatttataaaagtaagtctcttgcattccttcattcttctcaccatccccacctcaatcagaataccaatttacggtctctgttggagttagaaatattaaaaggggtgctatccatgcctaagaaaactatgggatggtgccttttatatacatgagatttatgaaaaatgaggccccctgcagtgagatgcaaaaatgataatctccatttcagagcatctgggcctgaggattcaagcagcttctgtcctagaaagaaaaagggggctagatccagggacaggctttaggacccacctaatgcagtgaaatcagaaggatataatactagaagggtgggtggctcactaatgccccacaggattaaagtcctgttcaccattcagctgccccttgtaaacataggaagaagtgagatgtctctcccctccaggcactgcactaaatagctccttccagcttcctcacaattgctctgagcatcatctttctctctcgctctcccgttccttcataagcctccctggtaataagattacccacactgactttatgacattttgaggaaactccacatctccctaacagtcaacaacgacaacataaaatctccaaccaatcacattctaatttgtttaaaaaaaaatactaattacctttaacattttagcagatgtagagagaagcaggtatgcaaattttttaataaaaaaagaaattgcttttctaattagaaaaataaaaattaaaaaaaagcaatgtgtggcagttccaaacattagcagtcaccatgctagcccctggggatgttttggccagatcattagagaaagtgccccaatcggaattgggaatctgatggagatgatcaatagatcaaaactgccaccagggaattttaacagggctgtcatgatgacatcattattactcagaagaatgggcacctggggcactgatccctctccccgcccccacaaaagaattaccccgtgccataggcacttcaccctccctggtcatccatgccatgccccctcctaacttcctcaccctccccttggtcagatcagggcagacctatgcactgggcaggggctggatggggcatccatggcatgttgctatccctggccactaacctcaacctcctctggtttgtcattaacaaagagaggaagggacatttggccagggaagcatatttttaggctttcatgcctttgtgatacttgacatgacatctcaaaggaaactggtcccagcacagattctaatggtatctcctggcatcatcacaaaccctggaataataaacagtagatttctgaatgccagacactatgatatgtattttacatctattttgttgtttagtaataaactcagaggttgaacattcgtgttgtatcttacagatgagtaaaattattcagagaacctttgggatttcacccaagttcatgtcgcttataacagcccagccaggagaggatccaagtcttccctgactttaatactcatgaaagaatggcttactcattctatgcctctccaatagagctgggagagagcaagtgagggcaagaagggagtacatgacattttaaaacattcttcccacactccccacaaccccatgctactcataagcacagggcaaattcctgtatctcttaatcaagccctgattatggcattgataaccaatttgtacattcaacctaggctgcactcactgtgaagccgtagataggtcacaatattgtcatgtgtgtccaggagctcacttccccctatgactttcccagcacaaatcctgcctgccccagcaattcctgtcctttggagagtgtctcggccttggtcctgactttacctcatgtgtctgaaaacttgagtcagtgactgtcattctggaggcacaggcacatgacagctgacagagtgacggatacactgggaagccaacaacaaattactggtgtgtttcacaagctcctacagaaatgttcattcctaccgagctggtgactagcagctggggtttgcaagtcctagttgcttgcccacaggctgttgaaagaaacttaggctgtagaccctgaggtcagtgaagggataataactagctcctgcatcttctcaggtcagtttagctcctagggatgaagccattctttccctgagcagacctgaaactttcttgctagatctcaaaataagccacaacatttctgtcttccctccatataatcaactcccagaaaatcaactccaccatgagttatttaagctgtgactgaccattcactcatctcaaaactctgatggagcatgaggtactacaggccagccctctgctaggcactggtatccagaagtaagatgaacaaagctcttggtccctaagggtgcacagcctcttgtagttgtcctcccctccttctgaactctctgccttcccttcccagcagggtgggcaggagtgggatatgacaagccccacatcctggtagtttagtcctagagttatcaccctggctaaaagctgagccgtagaaaagctggagttactctctaaaaggagatacttgcttatctatgagttttatttatctctgtcctccacaaatcccccacccttgctgtgaccacagggaactgagatttggctgtaattgctgctcaatcacacaccattaacttcccacttaagctcacttataccaagtacatattttatcctctcacccacgcagccaacacactagagcccacaaatcatctgtgtgcactttggaaatttttcaattatttttaatcagctcaaaatggtctgctcccaacgcaagggctgaccagactcaccaggtaccaggagctcaaggcacccaggaagtaaggtacataacagattccttacctgccacgacaatatattcctagccatctttctttcatggggtgcatcagcaccaggagcaggcttcaagctatcttttaaatggctgaagaggatgtcaaagtagatgttgaatatagcactgaggggagcagcagtattcaatttgggactttttctatttagggatggacttttacctccactgggcattgtcactcaccaagctccctttggtgtgtgtctcaccacaacacagccaggaaaccgcaaaaagggagacagatggagggaaaataaacagtctgtgctttctccaagctaaaattacctgttgcttatctaataataataatcatctgctgcaatttttccaaccctcagataaatcagatttaaaatgttgatgtgtcacaacatccgattagccactgagacataaattacagagcagagctaagcaaggtaggagagaaatgactaggatgaacaatggtaccccagaaaaggctgagtaaacaggtgtttttaagaaaacccttttcttatgtagggccacatcacagtctcatcaatgatggttccctgctgaagcccctggaaacctggtttcttctcccaacagaggaatttgaagctataagggcataggcataaaatgggaactgatccctgaacatctggtacaatgtttggcccataatagaccctctgcaaatatttatttgttgggtgggtggctggctggctggctggctgactggctggctggatggatggatggttggttgattgaattacatggcttatgatatactcaattcatgcaataatgagcagtgatacttttcagtttttttttttttccatttccttatacctctattctgggtactctttatgtctcaccctctacgtagatgaatttccccttcctaacatgtcagtccctaccttgcttaaaagcctgacatgatctggcccctgccaatctttctaggctcacttcctatccttccccataccctcagctccaagtacactgaagtctttgcatgagcatgcctggttctcacttccccatgtccgtgtatgtaaagattttctgtatgaaatgcttttccttgcctttcatcccttttcacactctatcaccagaacgctttgttaacttctacccatcctctcagactcatgacttagattctcaggtggtggctggtcttcctccaacatcattacaccaatgactcaatcatagcactcttcacactatatgagaacagtttgttcacttacctgtcttcctctctagactgggctgtccttgagaatagggactctggctttgctctctgaatttgcagctgtcattgtgtttggctcatggtagatactcagtaactatgaatgaataagtgaatgtcacggggagatgtttgtcctgcaagagtgatgcccagtcattaatattttcttttctcctccaggtttctgattcatcaaacccatttcttaatcgaatgctcaacagagatactatcacaagaataacatataaaagtaagtttggttcaatttcctccacagcaactattctataaaggttagacctgcctgaaggcgggaagccagaactgatgatctccatgggcccttttcagtttcatgatcctgcagttctgtagaaagtcactctggagattagggtttggctaagaagcagctcatttcaagcagaagtccctagggtgcctttgtcatccatgcctaaggtgataatgattatgactatggtggtcatcgttatcccatagattggtaatgagccaggggactctgctggctgacacgctccaccgtgtcagctggtcacagttggggctttgccaattacgggattgagaaagccctcatcaggtactatggatccaatcgcaacatttacagaagccctcggctagaccatttctctgtgtgtggctgggtctcctttccaggcagagacaggatagcatctctcttcagccacatgtgtggcccatggatgtagaggactctgtccagtttccttgggtttccagagtgttttatccccagactcattatgcagaaaagagagaacagtgcaaagttgaaggaggaaggaaaaagatgctgctgtcatctccagcaatcccagaaggtgcaggatttgggaaaagttgggtgagacagcacacacccatagatgaaagaaataatatgaggaaaaaagattgtctttacctaattaggagcgagtaggatactgggattcaagtcctggctttgtccttcatcaaggagtttcctcactttgactctgtcattcatcttataaagtaaaaaagttgaacttcaagtttctaaagtccttctaggtctgggattctgaatcaagcaataggtaaataatgattctcacaaaagtgaaaaacagttggcaaacatccaagcacccacatccccttggcatgcccttcaccaagccaggagctcagctgtgtctgctgcttctctctccaatggtgatgtgaagaaaaaaaaatgaatgtgtacagctctcacattggactgccaagggagagtatggagaatgcttcactcagccgtttactcacttattcgacaaacatttcctgcatgcctgccccatgacaggcaccaagcgaagctccagggatgtaaagatggcccagacagcagccctacaactaccacgtgctcactgccaagtccctcccatctgcagaggctgggagactggtagggctgaggaatgaacctggagaatcccgctccacctagagagacattgcccagaagaatgaattaggttgtctccaagcatattctgccttttctcattagtattcttatggagtcctctctaagcacacacttagattgctcagctaagggagatatttctgtcttgtgtgtaaatagcacatttataactgcccataaaagattattattcttttaacttttttgatgaaaaaagcatgaaaattaaataaaatgttttcaaataatcttggatttgcaatttagagaccgtgaaaatgcatgaaatcacacattaagccccaacacacagtctaacagattaccagttgcagagtcaatcattagagggactttcctccccaccccaccacccatcccccagcactggtctgattaatattaagtgatgtggcttgtgccaccaagggaggagcaagagaggggagggagaggaaggggaggcagggaagaaggaaaagacagatggaagggaggaaaggaagaaagggagggagggaaggaaaagcattccaagtgtggggagccacatgcacaaaacctggagagcactgaaggccggtgaagagttcagagggaggaactctgtcttcatcagctcttcgtctcagtgcctaagacgaggcacgcccaataagcattggtgatggcctgggtgaatagaaggatgaatggcctctttcaggagctgtgacggggcagagggagtggcaagaaagatgttctggagccggatcttgagccatgttaaggtgtttatgcagaaggcaggcagacatttaaacacccttttcacctctgaagacacattcctagaaatgcaaatagaagacagcaggagcaccctctccttctgacccccatactctacacctctcagggcccagggaaaagaaaggggagccaaagcaagataaagagatcctggcctgcatggggaaagatagctgatttaggccccctaataacaggaattttgtgctcctataattcagcagggagtaattgaggtgtcctctgtagtgacctttgtcacatacctgaagggagcagcactgcaggaataatgatggccgattcatgagaatgaccctgacactgctttgcccaggacactgcggcagaaatgaattgatttgcgcagcagaaaaccacagctctcttttgtccctagggcagccagaaggttagcccagtggcaggcaggggagtctggagtaggagtcattcactagaacacagccagtgggtgggaaacataagactggaagtccctcccgaggctttccaacaggcagcaggttaggccagcactggcccataaattcaggttaagatgaagaaaactcagggggccctatcagggtatcctgcttctgtccttctaaatgttcgagagacagaaatcaaccccccaccccaccatttctaccatgctactgagggacacctaacctccacccctgcccattctactgttgctacccagaactgcaccccagcatagcttcaatttgctctgctcatttagatgcagtatccactctgcaacgtgctgagccccaggaatatggagatgatgcttactgagcactttccacacaccaaggtctatgctttacatacaggctccttacctagtgctcacgaagtccttcagagcggtatgattgccatccccagtttacagatgggaaaaatcaaggcttcaagaggtgaagtcatttgaccaatgacacacatttaatggctgtatcagtcagcaacttctgcgtaataaacaagcattcaatgataagcattgatttcttattgctccctccttgggttggtaggggtggctctgcttccagctacaggtctgcaagtgagctgaagcagctcagctccacgtgactctcattgttctaggatcaagatgatatccagggcaagtagttctcatggtagagggaagaaataagtgatgtgacttaaggcctagtcatgaaactcacacactcactctgtccacttccacaagccaaagcaagccatatggccaagctcaacatgaaaatcctgccaaggagatgaagatgaggaagaagtgaacatttcctgaaaaatattcttccatagtagaagagcaagtatccaaatacaggtcttcctgggtactgtttcctctgcttttccttcctatcatgctttctccctaaggaggaaggaaagcttagctccagggtcttaaaactaattgcagtgaagatgttttcacattccatgaaacttgtcagcatgtttttctcttaattccaactttggttcagtttgaagaagcatctttttgctatttgcatgtgcctccacttgaaagggacatatactaaccacagaactgatgggaactttggcagttcaagtacatcctgacctaagctctctccaactcctgcctggccctgaacatggtacctccagtggaaatcagtcattcagagggacacagtgacattgccattactgacatatatagtcaccagagaaggcacagagattaattctagagggggtcagtcttctgaaaatctgccccttgaaggtcattgtaacaaaaagtcaatctaggaatttaagcagagtgacatcatctgttgacaaaaggatcgcctcattgcttggttgagaatagactacaaggggcagagtccacaatagaagaggattgcagcaacccaaataatgagacgatggcactgaccatgaccgggctgatggggattggcagggagatggtgagaaataattggatatattttaaagaaaaagccaagaggccgggcacagtggctcacacctgtaatcccagcactttgggaggccgaggcaggtggatcacgaggtcaggagttcgagaccagcctgaccaacatggtgagaccccatctccactaaaaatacaaaaattagctgggattgtggcgcgcgcctgtaattccagctacttgggaggctgaggcaggagaatcacttgaacccgggaggcggaggtggcagtgagctgagatcgtaccattgcactccagcctgggcaacaaagcaagattctgtcaaaaaaaaaaaaaaaaaagccaagaaatgtactgatatatctgataatatatctgatgttttatgtgagagaaagaggggagtgagggatgactgtaagacttttagcctgagcaactggaaagaagacattttcatccactgagatggggagactgtggatgaagcgtatccgtgggtgggaaggaaatcagaaattttgaacatgttcagcttgagatgtttataaggtacccaagaagaggtgtggagtaggcagttggatatatgagtctggatttcaggagggagaactgaagatataaatgtggaagacgttggcatccagatggcgtttaaacgttggtgaaatcctgagagtaagaataaatagagaagagaggcgggacatgtcctcacttttgaaagagcaactcaaatctccatgacttaggattgaaaatcacttctaaagatatctttaaaatcccaccctggaagaggctcccgtgtggctgcctcatcagcaaactgaggtggtgcagggagctgctgcacacatggaggcagcggggtgaaatcacaacatggcagctggaagagacacagtccatttgcccggtttgtaggattgggcacagaatgaatgaccaggaaaaaaaaaaagggggggaactgtgcaaaatcattcttttgagccagttacaaaaaaaatcaatgccaggaaattcatacaaggaggaaagagggagaatctcgccaagaggattgggaattttggaggctaaatgccatgctggtaaaggcaccacacccatgggaggcagtgtgttctagtgaagagagatctgggctcctatcctggctctaccacttccttttgttgcctgactttaagcaagcttctaaacacctccccgatctgtaagaggaagatattaatgctgacgttgagatggttggcatgagaatcaaacaaggtaatgagtcaaatgcctgaacaatgagtggtataaactaggtgtaaaatgaacgtgtatttctaagttgtcttaaggtacctggctatcaaatccagcttccctcaggggaggaggcaggttgctatgatgccaaataaaaattatgttgaaggtaaatgcaatacaggacacagagtcaacagaatttgcttgttttaaatgaaataccgctcctgtgcttgaatccatgcagtggatggtgatgatttaatgagattctactactttactttccttgcaagcttagatttcatatgtctgagtgaaacttataaaacactctaactgggactgacaatgaaaaaaactagcctgaactaaattcgggctgaatttagaaagtcttctaaagaaaacccattttattaaagtcaaattccccttcaacagactgggggttaagactaaaatcatgacattgaaaaatagattttccgaatggattttctggaggagatattggtaatttacttgaagtattttaattttttaacgtagtgtattggaataaggctaatatccctccatttttcttgtgttaattaattggcattaattaacagaatcccaattaaataaaaagtagtattcttattttattatctacccaatttcattaagccagcattattttttaaaaagagattttatgctgttttcaagtggctaaactagtgaccaatgaagtgcaaagaggcttcttaagtgggtaagagggaacagttattagaacactgcatataaaacactttcctctaacatcttaggacagtattattttggtagcttcattctccttcagtgtcgcatgcccccattcatttagtccaataagaatccaaacgatcacaaatttcaaatttaaaaaggtatggtggctgggcgtgttgactcacacttataatcccagcactttgggaggctgagatgggcagatcacctgaagtcaggagttcaagacgagcctggccaccatggtgaaaccctgtctgtaccaaaaatacaaaaattagctgggcatggtggtgggcacctataatcccagctactcgggaggctgaggcaggacaatcactgaaacttgggaggcggaggttacagtgagccaagatcatgccactgcactccagcctgggcgacagagcaagactccatctcaaataaaaaataaggaaaaaaaaagatatggctattgtcctaatgtatttcctctaaggaaataaaaccacaccactgaaggcatctggaggagagctttcagattcagcgctttgacacgtggcacaagccctttaaagcatctttttcagtcttacctgtttataactttgctttacttcccccaacccccagatcttctattcagctaaaagatgcatgtgtaggcaaggacagatcaacttggaactgccttatacttctcagttctttgggaagtgttttatgcgccgctcctcagagggacgtggtgttaaatgtgacgaaatatcaccaaggagtttaagcatattgctcctggtgcctttctctatgcttaattgaacttgtactttcatttcaaaggaacggctttggaaatgctttcacagaatgcaaaacgcagcacaccactttccatgttgcaatctaagtagttactcacgtcagcaaggaacagaacaggagcagcttacctccacgaatccaattctcagaggtcccttttatcatttattgtttgtgtaaaacaaaatatcatattacttcattctttagtaattgccttttttcatttcagttgaatttgcctcagattacaagaggaaatgtcattctatatgagaaaattgccaaatagttccatattgatcaggaacaagtccagtattgatctctgaaactaccgtgccttgttctcattggaatagttctcttcaaatgggaacttcataagcaggaagccgggcaatattaaatctcatcagtggtccacatgagtaagcacaatgcatttaacagaggctgcctgttaaatgcagactgaaaaaaaaaagttcagactgagggaaagtttcccccgactcccccaagtggtcctaggcattttatcatagtgtacgtctcctacaaaaagaaaaagtcagcttgggagttgtaaccacgactaagaactcagtataagataaatcacaggttcatcaagaacatgtcaaaaaaccaaaggttcagctgtcaacttctgcagtcatttgaaataataaaattgggtgataaaatacacacatatattctacacttattgattattcaagatccaaggggtcctcctttactataaagatacagccaacacatacaaaattacaacactctcatataaaaatttgacctacctaagataaatttggctaacaagcttgcttatgttgaaagatggtttcggatccatagaatgtttaatacctgaagatgcaattttccaggactgtttggtatcctcaagtaagaggttacattcttttccatgaaggaagaatgagttgctggcaaagctaccactagaactcagacttgaattaagactcttgacttgacatctaggatttgccctttataagctattttctcatatgacaggtaagtaggtgatagagatatgagagagagagagaggagagagagagagagctgagagagagagagagagaaagaggggataggtagagaaacctctctgcaaaactattcatgaaactttatttgaacatctgtcctcacttccaccaataaacatccttaaagcaagcagagacatgcatgaacactcccccactggcctctgagcttcaccccaaatttgcatctttgttcacaaacaactctgacctcctctagatctttgccatccttactcatgaatagagccttggaagtttagagaggagaatctcccttctggtatattggtcctcagtctactttctgtctataatgcccagacgataacgctgacaagaaccaaacaatggttttctgctggatgctgcaaggacaagatagtttgtgactaaaagctagttcctggcctagttagccctgaaaacaccccagtgtgccttgacattagggctgaaaacttctgttttactcatgttcttttcttgggtccctctgcttctgtcctatcaaacatacaaagcaagcttcaacagagagaaaagaagatgcagaaagttagccagtggctttcaaatcccaatacctaaaagatagacactgatttaatggcagcctctgaggcagcatgatgagtcatgaaaacaaacattacacgttaaatgcgcactgactcagcaatgtaaatatgaaggtagaggagtctttggtatggaaacatggtaatagcatatggagatggaaacagggcaggcaatctcaccctgatgtcttagggtgtgagacataggggggagatggtaggcagcatgtatttaagctaaggatgctgactggagcctcagagatgcttcccctcatctgataaatgatgtcgtctcttcctcccttgcttttgcccaacactgccagcaggtagagctgctgagcagaaaccatttcatttgttcattcgagcagtgtttactaaacacccagtatgtggtggactcatgctggcatttgggggcttagagatacaagatgcaaacccttcccctgaaggctcacagcttagcagggacagtcaaataggcaaataatgattgacaagctaattcagtaaatacagcaaaaaaggagggcactggcccagctggggaagccagggagtccttgaggagaggagcagtagttattccagggcagggtaggaggatgtgacaaacctggaccacaccttatgctaggtgcttgaaaagcatgatcctgtttattcctcaaacaaccccgtgagcaaagtactccaaccatctgcttattgcaaatgtagaaactgaggctcagagggttacctgtgggtccaaggacacacggagagtgagcagcaaagtcagcactccaactgcgatgtgagtctaaaactcacactctccactctgggtctttccaagttctgctgtgtgaggatataaaaagggcaaaaggtagagtataagtattaacaagatttgcagaaggaacacagtggggagtgaaaatgtcaggagagcagaagctgcctatgtcctctgatgactgttgcatcttggagagggagtggacaaagagggatctcctggcaggacctcagtggatggagtctggggtatcagcactacggtgttttggaaacctgctgtgtgtgataaatccctgagcataacctttgactcttgctcctagcctacactatacctcggcccccaatcttttccacaaatatagctgcagcacaaaggctggttacagtctcaaagaaacaaaacatgttccttttctttactccagtcatgcctggaatgcctctctttctacttcccccttcactcctccccaccgccccgaataaaataaaatgcaataataacagcatgctagagtacccaatgtgttcctcgtgcaagcttggttaaacaaatcacattgacctttaacaaaaatgtgctgaatgcttccttctcttattcaatatgttaatcttcaggccaaaccaccatcagagcaagcctcattaagtgcaaatgtgatcatgctactccttggcttcaatcccttcggtggttccgcattgcctccggatgaagtccaaactcccagtagtgctgggaagaccttctggtgtggtctgtgctgaccccaccagccacatttctcacagcagccctccctccccttccatctccacatcgccctgcacctcacactccatctgtccccaagtacacaccactccttccttgactctttttctagcattgctctgtctacagtggccttgacaccctacccgattcccagctacaaactgatcacctcctgctgttaaagatgcagttcaagtcaactcctcgattcattccttcctgagtaccccgcaccctcgccccagacagaactcacagcctctctctgggcccaatgcagatttatgtcattgtctctgtcatgccttctgcattcacttaattatttcctactcatctatacctggcttagtgcctgacacatcttagggacttaagaggcagtcagagacaaatgctgatatccaatgttaacttattgggttggcccctgatgtaacccccaaggtccctcacgtcgtgtgtgccctgggcactgtggctttgttatggaagcatctgcccaaacaggccatagtgcagacccaggctggccatattccaatcactgtgtctctctcgagcatgtcctcgttccttggtgttttgacggaaaggtagaaacatttaaatgaaaagtgaaagaaagtccttcctcctagggttggtctccaaatccagcttggtgaagctatcttcctcagagactttggtggatggaaccctggaggggttcccttaccccatcaagggagtaggaggccaggaagggcagctttgaatggagtaggcaaattgtgattgtatttatatcattccaaacgattggctccattgatttgttcacaatttaattgacaaagcaacactgaaattcaagttcccttggcaaaggtaactctttcttattggagaaggctgaacgagcaatttctagaggaagaaatggaggagagggcatctttgccaaggaaaataaattagcagcattaatcagtaggtaagtacaggcaggtcaaggtgcacttattactgtgacattatagcctacttatttttattttgccatttgttatctatctctccaactagaataaggtcaaggactgcatctatcttgttaattgctctgtccccagagcttaacactgtgcctagcacaaagaggttctagtgaataatcgttgaatgaaaaaatgaccttggtctggaggtcggaagagctgagttctaatttccactttgcagtcaccagctagccctgtgaccttgggcagcccactttgcctccctgatctttagtttcttgtcagtggaggatgttactatctgcctgactcattttattgagtcaatgtgaggttccagccatatgtgaaagtcttcctttaccatatatgtgcacaatactaaactgaagaggttccctcaacccctgaagaatgagtactttcccactgggagttagacacatggacgagagaacatgtgtgcatccatggggctggagagtcagtctcatccctcggccagccaggctttgggaccctgccatgtgttctccaggtctcctggactggccacagtgatgggtgctcatggtatgcctggggatgtgatacctctagagatatagatctggaatcactgggatgcagaaggcaagtgaagccatggatgtagatgagctactctcagatgagaggatagagtaagaaaagaagggagccttggactgatctttggggaattgcatcattgagagaagcaggtagaagatcaggagacagcaacaaaacctgagagagaatggccagaaaaatgggaatactaagtatggtatttttgaagccagcagaagagaacaatcacgtgctaaaagaaaggaagaaggatcatgaagaggggagaagaggagagatacattgcaattaactgatattttaaaactccaatacacacaattttatcaaaaatacaaccaatacattgactaaaaaaattaacaggaaacacaccaaaatgctaatagtaacagttttagatgactgaaattgttttttcttttttccatatagtctgtgatgtacttatgtcatttttaccattgaattactgtatttagtaatagaagatatatgggtatgaatacctcaaattggtgtaagagaaaaggctatctgcatagacctgagagagagaaaaatacacacacacacacacacacacacacacacacacacaaaataatcagttgttgagcttaaccatagaatctcatggtaggatttggcctgatttacttttctatccaaaaatattttcttattgttgttttaagtgagaatggtcaccaggtgaatttcaacaggtctagaagctttaattgtccatctcatgatacctgtaatgcctaggagtccagatctcagggactagaatcaaggactcctcaaacaatccctgtggtagaacgcattgcttacagctcaccaatgctcagggccccatcctgtggaaggaatgtgcttcctcgcatccccaacatcagccttaaccatgtgacttctttggctaccaaaacatgagcacaagtgatgtgtgccacttctgggatggaagttttaagaaccaacacacattcgccatgctttcgcttctgtcactgtgatccgcacaggtccaggtgtttactgctctaagagtctaggtcccaaagcatggacaatgacatggagggaagcctcagccaacctggaatgatcatgtgtgtgagcaagaaatacattcttattgcttaaaacaaccgagatctgggggacaactgcttgttactgcagcctgttctgacagatagagtcttctggaattccaaaagaaatacatatatatctgtgtgtgtatatatgtatgtatatgtatatgtatatgtatgtatgtatgtatgtatgtcagcaataccatccctttctcaagaaacctaatttttaagtcttctttccttctctagatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcaggtgagtttctctctggtcatttagctaatggagaagaatgatgttaaaaaaaaatcactgaaatgtggagtgcctattataatagtttactaggaccactataacaaagtcccacaaactgggtagtttaaactaacacaaacttatcgcctcacagttctggagactagaagtccaagatcaaggtgtcagcagcgttgcttccttcagcggaatgtgaggaagaatctgttccatgcctctcccctagcttctagtggtttgctgacaatctttgacgtgctttggcatttaaaagcaccaccccaagctctacctccatctttttttttttcttttttgagatggagtctcgctcttgtcacccaggctggagtgcagtggcgtgatcttggctcactgcaacttccacctcctgggttcaagcgattcttgtgcctcagcctcctgagtagctgggattacagacacgtgccaccacgcccggctaatttttatacttttagtagagatggggtttcatcatgttggccaggctggtcttgaactcctgacctcaggtaatccatttgcctcgacctcccaaagtgctgggattacaggcgtgagccaccacacccagcctctacctccatctttataaggtgttctccctgtgtctgaggctctgtgtccaaatttcccctttttataaaggcaccttctgtattccattaaagcctaaccccaataagcttgtcttagctcattccatctgcaatgactatttccaaataaggtcacattctgagcaactaggggttaccagtaccttcagcttatgaatttcaggggtacacgattcaacccatatgcctgggtttaaagagccagcatccaaaaggcttagcctgagctaattatagaagcatctcaactgtctcagtgggaaaagatagccattaattcccagagtgtattctacaactacagtgttcagaaagcaagcaagcaaaatggaagatgtcattatgcatttgaaaaagttgggttttaaaaagttaaatagattccattgttgaaggatttctggggtccttcttaaatgctaatatatgtgtcagtcttcaagaggaagtggtatgatatgtagtattttgcacacatatttgaatgtgcagtgttttttttggatcatctcacagagttagtactcatcagaactggatgggaggcagatgggtcctcctgtgtgagcttggctacacggcttattgtgctcttcaggcctgtcacccacctctatgaaatgaacactcctcttctttattgagagggggataaattacatgagtttgctccagctctgacattctacgactgtgggagtctataacaaattaaaggagagatgagcaaaggaagcagaagccaatatccttgacgggatatgtgttcccacctgaccaccatttgaacaatttgaagttccttaacctatctgtattgaatgggacccactgggtgacaggcaacagtaactccccacttaagcttagaaaaagcatttatttgagagctacgagggcatcttagagaatttaaaatcagaaattgacatcagaaattcactgaaatgggaaccccagaagtgctttctctctgttgtcctcttctcaccacacattcacttcattcttctctcctgctagagaccgtcttcttttgcctcacagtcctgtggcagaacatggctgcaaacagtccagccacctggccctcatagtctcacagaaaagaaaccaaactggtccagcttagtttagctctgacccatggaccaatcactatgatccacgtaataccatgtgggagtcatggaattattgaaccaaagagtatcaaagaaagaaagaaccttagagaaacctaaccagatttgctccttttttggatgctgcatttgagggtgagagagcgcaagtgacttgttcagaggcatacacaagctagtaagctagaagaaaggctggcttcatgtgtggaggtataatgggccttcagctcaactgaacccatggaaaaaagggactctgtggggcttatacagccctttcctcatacagccaataccacctagcttggccagagtctctgtggtcttatttcttccctagtgcatttaagaggatggttggatctcacggccacttctctctcctcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagaggtgggtttggtggctcagagagtggaggatctaggctagagctcagtctttctgcttagacctgttcttaaaggcctggcattatcttccattataggaatgatgactgtaaatgacaatagccatcacactccatttgcatggtgatgaaggtctaaagttttgatatatgtgatacagatacctgtatgaatgcatctaggtaggttggtaggtaggtaagtaagtggatggatggatggatggacggtaggtagatggcaaggtgtagaggtttgatatatgtgagatatatatatatgtaacctttaaacacatatatcaaacctttaaaacccctgtagatcaggcaagacagctttttattgccatttttcaaaagagcccagaaaggctgatgttcccaaggttatctgttagaacaggacagtgaaaagcattagagcttttaagtatatggaagaaagacctgctttcccctagaagatgaacaaatactctaaagggcaggccattagaatccaatggggtaatttgtgagtgtatctttgcccagtgctatgtccctagaaatggttattattcccactaaaggggacatttaagttgacatctgcctcctgtaactctgtggtgcacacccagccctctctctcttcccttctgcttactactaaacatctgttaatcattgtggtaaacactcagtgtggaaagaaagatggaggaaggatggggtcttggagagccctggactggaaatcaggacacccaagttctgggcctagttctaacaagctgtgcaaacccagccacattgtttaccccctagacctggcttcttcgtgacagttcctatgccatctacttcacagtttgttaaaggaagcaaacaagagcctggatagggaagccctttgtagcaataacatgctccccaaataggagggctgtggttattaccagacagcttttagaagcagcctccaccactactccttgatcctccacttcattcctcctacttcccccttgttcccttcttttttctctctcagatacacttgcatgcccaaactacatattttccacacccttccagccggaactaccagaaaagtaaatacctaactcattcattgcttcttctctttagtcaaaacccctgtattgtgttcctaccatgtgtcagttagctgggtgatgggtgacagataagacacctatccaaacagagcatatggtctacaacaggagtctacacactttttctataaaggacagagagtaaatatgttaagttttgaagccataaaatctctatggcactctgacattgtagtatgaaatcagccattgataatatctaaatgaatgggtatggctgtgttccaataaaactttatttataaaaacaggtattgtgctggattagatctgtggactgttgtttttccatccctagcctagagcagtgtcatccactagaactttctgtggtaatgggaatgttttcatgataggttgatgactatcctgcactgcccaatacagcagctactagccatatgtggctattgaacattggatgggtgactagtacaatgatgcaactaattttttattttaattaatttaaattcatagtagccacatatggcagctagtggccaccatattggtcagtataggcctagaaggtcatggagaattggaagggagtagttggaatgcatataagtaagcaggcatttacaaaacagtcccttcccctctggaggaattctctaaaactgtgtgcaaattaattgagtatgcctcgttttatgttgtatgtgtgattttttttttctttctctctctttgcagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagttacccagt

SEQ ID NO: 67 - DNA, 255588 bp, Homo sapiens
gacttctccagacaggttatgttacctgcagaggctgccctgaagctccctgtggcctggagactatgtacaagaggaatggtctgatggctagcgtgttggtcacctctgccactccacaggtactgaggctgcaagaatcgggacagtgggtagaggggtctcctttcagctaacccaggccccagctgagccttggacagcgaggcagtagggctctgtgaataccaccattcttagcactcctaaggcccctggccatgccaggcgtgagatttgggaggcagtcagccctgaggatcagcgtgttttctgaagttgttctcttcaaagaaaaacaaatacctgcccagtccagctgtagcaagtgccacattccattttggtggcaagaagggatcagacctttcccaggaaaagccgctgctgattataaataagtcacacacattccggaatgaagtcagacagaagtcattccaactggccctgggttcttatttaccttgctcagtgggaaatggttataaggactggtggtctgcagtggcctgggctagggcccctgctgtggggtttgagagtttgatttccatgctcggtaatggcacagaagcatgcaggaggagtgggtgccatttgaggcccaagatgccaccaccctattgtgtgtgtaacgcctgctcctcggacagattggcaaggccataccagggtttgagcccacaaggccctcctcattatgctaggcttttgaagtgatcctgggtaacctgccaaaaagtcacaggaatcagttagtttcttataaacctttcaagaaaattcggtgttttgatctctggtcctgaaatcgggataggtttaagtaaagctgttgctgcagcagaattgtcattaccctcatcatcatcaccaatgaatgtatttggggcagcttttgatcaacacgtccccttgtatgattgtgtgtgtttggggcagatacaatggtgtgtcactggaaagttataatacccgaaatcccaggaatggactcctttttgtaactagaggagtcagacttctatttccatttagagtgaagcttctttcttctctggtctgtatgtgtatatatgtatatgtgtgtgtgtgtgtatatatatatatttgagtgtgtatatatatgtgtatacacattatacacattcacacatatatgctgtgtatatgtacatatatgtgtatccagcacaaggtaagtactcaataaatattttttgaataaatgaatgagcaaatgatgaatacatgtataactgaagtgctcaataaattttgatgactgagtgatacatttacaccaacatagccccataatttgttgcttactatataccaggcacttttttgcatgttccataggcactgtctaatttaatattcacaataaccccatcaggtgtatattattattttatccctagtttatagatgaggaagctaaggcacagacaggtgaacaagctggcttggaatcacacagctgccatgtgggtggggattcaaagccaggcctccctgactctcgagccggtgctcctaaccatgacattataccatccaaaagaaaatccaccctgtcaccctgatatattctgttttctggaaggtgggtatagaagtatagaacggtttgtacagaattgtctgctcaggatctacatatgagactgggagatggagtagactgccgattccagcagcatcaggagaaatctttataacttttcaaaagttcactctgcgtaggttctcctcaggggagaatgtcctgtcactgtggaactttaaaaatagccatgcctgggctgggtgtggtggctcatgcttgtaatcccagcactttgggaggctgaggtgggtggatcacctgaggtcaggagttcgagaccagcctggccaacatggtgaaaccctgcccctactgaaattacaaaaattagccaggcatggtggcgggtgcctgtaatcccagctacttttgagctacttgggagactgaggcaggagaatcacttgaacccagcatgtggaggttgcagtgagccgagatcacagcactgcacttttgcccgggtgacagagcgagactcccactcaaaaaaaaaaaaaaaaaaagccatgcctgagctcacccgagtccccttgaatcagccctcctggggatggaggcagattctgccagttattttttaagctttattttatataacccgtactatagccctgggaagtaggtttaatatcaccattttacagatgataactgagactcagtaaaacgaagttattcgtctgagcacagacagcaactggtgtggagctggcattttatccaggcctatctgacctcagaggtcttaaccactatggtatactgcttcttaagatcatcttaagagtttttggtatagtagactcattttaaaatcttttgatgacacaggcctatcgaaatctgcaggtttaagttcctgctcctctttttaaccttacatttgcagttgttgactattggtttccctcactggcctaaaagcactctagttttcaggaagattacaaagtttttccagatatagccattttggaaagagtgaaataaagaagaattaataaaagcatattctctaaatcccagtccaagatgttgaggttaatggaaaccacaaaatccttcttcgtgagctgagacgaataaaatcatttatgaacagggcacaatttttgggcggtaagcttgattgagcttgatgaagttaaattaaagagaaagtatattcaacattctgggatccccacagtgttgagattcgtgaaatcagccacatttgaggagttttaacttgcctttttatgggagactctttcatatacatgcaggatgcagagcgtccttagcacaaaggactctactaaatataactttcacaacagcctctaaagccagttggttacctctcacctcattagcaagcaggctttgaattccaagtgccccgcatgataaataagccttgagagctactttcacattttgtgtaacaatttcctgcagtgacttcaagtaggaaaaaaccaggtaatgtttgaaagacatcatgaggcagattgtctcctcaggcctcctaagacatgcagtcctgttctccctcaaggaagattgggctgtaatttttttaccccaccactaaaccactggccagagaaagttagggtgtggcaactgaaggtatgtgttttggggtcggatagatacaaaagtaagtttactttctggctttccctttcatagctgagataccttggagaagtaacattgcctctacttccttctctataaaatgggaacaataataatttgtactcatagggcacatgtgagaaggaaataagatcatacacatgcagtgcttaacatggtgcctggactggggtaaagctctaatcaatagaagccattttttattgtactattccattgctctcccatcctgaattccgaggaggtttgggaggcaatgattccacgtcatatcattcagttggcaccatctttccctgctctccacagggcagcagcagctcggactctctggagggccagagctgcgactatgccagcaagagctatgatgccgttgtcttcgatgtcttgaaagtgaccccagaggagtttgctgtaagtgaaacagggctggtgtgggtggctgggcaccacagcagggcactagagggagccaccacttaggctttgggctcagattggaaacattctatatgcccagcaagaggggagtgttgagtaaagtccgtaccaccctttgtgaaatacaatgcagcattaaaaaggatgctgtcttgaaattaactaccctggaaggctgtacgctatatatataaatgtgaaaggagcagactaaagcaacgtttgtggagaacgtgcaatttaaaaaattcatgtacagactgggcaaggtggctcacgcctataatcccagtgctgtgggaggctgaggtaggaggatggcttgagcccaggagttcgagatcagcctgggcagcatagggagactgcatctacaaaaaatggaaataaaaaaattagccaggtgtggtggcacacacttgcagtcccagctactcaggagacaggtgagaggattgcttcagcctgggaagttgaagctgcagtgagctgtgatcatgcaactgtattccagcctgggtgacagaggaaaaccctgtctcaaaaaaaaaaaaaaaaaaaaaagcatgtacaacacacatatgacatgtatttgcatttgcatgaggtctagattttttgtttacatattcataaatgtctggatctatatagccaaacatattatttactgtagtatttggttatagattccaggtaattggaatttaatttttctttttgtttatgtatactttctatatttttataacaaccattttctacaatgataaacaatattatttgggcaatttaaaaaaatataaattaaaaaaaaagatatatcttcaaccaatgtgttgctcccggtctaactaagggactgtcccttgtggtggagcagtgttagctccttgttttgccatgacttggtttcctctttttgaactttgacagtagagggagaatattgattctggggtgacctcaaacctgattgagagtgttgtccaagcgttgaacttctctccagaaccctgaaagtgtttctaacccatacccacgtctcctctaccctctttggtaaaagaggtttcttgtcctcctaggtgccaagggaactagctgggccccatgtcattgctctgccatcattggcttcttccgtgtttactttgtgccaggccatactgagcctggcacatgcatcatctccttcagtgtgtctgagggatcattttaaaaccttcaaactctctagtggctccctcctactagaatgagacccagagttcctcctgaggcctccagtactctctatggtctggctaagcctcctcttctgcccccacctctgtgctctcccactgtctctttcttccccaggctcacctgcatcctctgtccttttcttttttcagtcttcatggctcttccttagttgtctgctcactctgtgttcaaatgtctgtccttaggactttcactgggctaaagtagcatctttccatcattatctttctccttactctgctctgtttttcttcataactcttattactacccaacattacattatagaataatttttttttttgagacagcatctcattccatcacttaggctgaagtgcagtggcacagtcacagcttataaaagcctcaatctccctggctcaagtgatcctcctgcctcagcctcccaaagtgctggtgctacaggtgcataccaccatgccctgctaatttttttgatttttagtagagatgagatctcactgtgttgctgtggctggtctccaattcttggactcaagtgatccttccacctcagcctcccaaagtgctgggattgcaggtgtgagtcaccactcccagcctatataataataaatttaaattgcatatctcttccactggaatataaactttctaaggacgggaacttatctgacttgttcactgcattttttcccagtgcccaaaatatacctggctcatagtaggtgctcaaaacatacgtattgcctgaaagagttcaattctttttttttttttttttttgagacggagtctcgctctgtcgccaggctggagtgcagtggcaggatcttggctcactgaaacttccgcctcccaggttcaagtaattctcctgtctcagcctcccgagtagctgggattataggcgcataccaccatgcccagctaatttttgcatttttagtagagacagggtttcaccatgttggccaggatggtctcaatctcctgatctcatgatctgctcgcctcggcctcccatagtgctggttgggattacaggcatgagccaccgcacctgaccaagagttcaattcttacaacaactcaatgagtcatatcatttgctcccaattttctgataaagtaaggatccaagagattaattttctacatggattatatagccaggtattggcagagccaggtctgaaactctcatctcctaattacccatgtaatgctaggaagtaattataagagcaactcctatttttgaacactgattatgtctaggtcttgtgttaaatgttttacatgctttatctagtttacttttcataacagctttataaattaggtataattattattcccaatttactgataagcgagtcaacacttagagaagaaagtcgtctcttcacacagatagtacatggcacagctgggatttaaaaccagggctgtctgacactgtagaccagtgatttccaatagaaatacaatgtaagctacatatgcaatttaaaattttctagtaatcgtccgggcgcggtggctcatgcctataatcccagcactttgggaggctgaggcgggtggatcacctgaggtcgggagttcgagaccagtttgatcgacatagagaaaccaggtctctactaaaaatacaaaattaactggacgtggtggtgcatgcctgtaatcccagctactcaggaggctgaggcaggagaatcacttgaacccaggaggcagaggttgcggtgagccgagattgcgccattgcactccagcctgggcaaaaagagcgaaactccgtctcaaaaaagaaaaaaaaaatttctagtaactacattaaaaaatgaaagaggtaaaattacttgtaataatatgttttatttaaccctgtatgtctaaaatattatcattttaaaatataagcaacataaaattattgaaatactttatattctttttctttacaagctaagtcttcaaaatccgatgtgtgtgtatgtaagagacaaggtctcactatgttgcccaggctagagtgcagtggctattcacaggtgcaattacaccacagtgcagtgccttgaactcctggactcaagcccttttcctgcctcagcctcctaaatagctcagactataggcttgtgccactgtacctggctccaatgtgtattttacactttatggtgctagcaacatttcacatgctcagtagccacatgtggctagtggctaccatattggacagtataacactagagcctgcactcttagccacaaagctgtattgcctctcctttagaggacgtcatggatctcgcaggccagtggcctagcttctatgttctatttatgtatgtttacttgtacttttaagagtcatgttttttagcttcatgaaagaagcaataacgaggcttaaaaatccctttctagctgtttaccctgtggaatggcagagagttagactgcatcatagaaaaacattgcctaacaggactccttggtgagacgcagggcctggttttctagcctcagccgtagggtattgcttggcttgcttcaggctgcctttctgaggctgggaagactgtagggaaggatggtgaatactttttgagaatgcagtgctaaaactttggctgtccctgctggagctagtatgtcttcagcttacatgtgaaaccaggtctctggagtctttggcctctgggaaagcactggagtgcctaggtgttagaattgaaccagaccaactggcattttagtttcctgtctagtgaaagaaaaaacccagacatgaaaacccagtgaaagaattatttgagtgattctgggaagatggtggcggcagtagcatatttttaaattctctcttaatccgtattcccccaccgccccactgtaaacattcagaacaactagatagcaaaccctgaaacccatgaacaaaattgtagtaaacctaggtgacaagttatcgtcatcacccccaaaatacaagtggttgaatatataccaccaacatccacaagaccttcagggtatcagcatctgtagaggagaaagcagaataagcactggggtatttgatagacttgagaataagagaaccccaaagttgtcaataggtatttgctagaaagttcagtgggtcagggtgggaatagcagctgaaattggcagggattttgactattcaaataatgggtgagtagaagggatctgtggaatagccattatgacctcttgaaaccaggcaactagggggtcccttctagaatgatgctgcgtacctaagaaattcagtagggagtggagtcaaaatgatcagaaaagatagagatagttgtggcaaaagatgatctaagagtgtgtgtgtgtgtgtatgtgtgtgagtgagagagagaaatctcaagaaatagtggctatggtgttgaacactacatgaaagcaacctaaaacagctgtgtgaagttagaaaaggtactctgaaccatattgccctgtaaaagctcaggaaaactaattttgcataaacataagcaacaggaaattattgctgtcaaatctcattcagagttattgtacaaaaaaagagacaagaatccctatagacaatgaaagcatgccacaaaaacagacaaaacctgtaactgtttatttttaaatgagctaagagatgttaagatcacacatgaagaacataaatcagaaatacaaaaatctcagaaatgagatgacagaacttagggaagacttaaaaataaaagaattcttttggaaatgaagattgaactagaaggaacacaggaacacataaacataacagaaaatgcctaagggaggaaactttttcacatgaaaataaatgaagaaagaataagactttgggaaaaagtgacaaatattcatgatagccaaggaacatccaacatacagacaataggaatgcctgaaagcagggaacaaaaaggcaagggaacttcacaaataattaaaactaaaatttaggaaaatgttcatgatatttaaaaaaaaaaaagatttgaaaccgcatattgaaagaacacaccatgaagccgagaatgtcaaccctaaatggtcaatactaaagacatatttttttttttacaaactactgggttttaaaggaaaaaaaattatttgggcatttaggcaaaaacagcaaatgacatatacaggaaatgattagattaccatcagtcttttttgacagaaacatgttttttccaaaaggaaatggaactacataattaaggaaagaaagaaaaagtgagccaaagaatttataatatatccagcaagactgactttaaagtataaaggacacaaacaaactgttgtgaacatgcaaagacctcagaattttattcccctgagcccttcctgaggaatctatgagagaatgaatcttagataatgaacataatgagagaaccatcactataaagacagagagcagtaaacatgcaattacttgtggaattaagactgaatgagggttaaaggtagagggtatagtttgtaatgaatgtatgcccagatggtagatatagtatgactataggataaagtaaatgaaaacttacgggattctggaatgctagtatactctatgtccttgagaccaagattttcaaaatagaagaaaggagatacagatgtaatacagaagaggttaagtaagtttttaaaaatgccctgaatttgaattggaaatattagtatgaattctgcattgtggtcttgaaatagcatttcttactaaaagaacccatggcttccggagaactggttgattccaagcctgggaaaggacatgttcaagatgagcctggtacatcttcccagtacccagtgaggaagctgtcaaggaataggagggtttgtggcaaacggactcaagagctaggtagaagaagctcccattgccccatcatggcacaatttgagcttcaaaaggataataattgcaaatgattgaaactcatcaagcaatgggtcaccttttgatgataatggggcagtttataatcttaaaaactggtaaatatgaggaaagaatcaagcatttgtcctaccttttacttttgaacaaactacactggataaccaaacagtagatgagggaaagtgtctattaaattattcagttaagaaaaggaaaagaaatgaaagaattggaatatcatcattttgtaaccccagtgaatgaaaatatctaagcagtgaacatcaatagccactaacattacaaaaggagagccattgtgtgcctcctgatgaagcagtgtgccgccacctgcggtcttgccaaagggatgcacctgtgtctgatgaagtccctgggtccagctgctgatttgcagacataccaagaatggaagaacacattgacctgttccataagtgtggagaacttatggcttggattcttcagcagatgtattacaaggaatataaagggatggagagaatatttgtagattaaaagagattttaaaagtacatatcggctggggcagtggctcacacctgtaatcccaacactttgggaggctgaggtgggcggatcacaaggtcaggagtttgagaccagcctggccaatatggtgaaaccctgtctctactaaaaatacaaaaattagccaggcatggtggcgcacacgtgtagtcccagctactcaggaggctgaggcaggagaatcgcttgaacccaggaggtggaggttgcagtgagccgagattgcgccactgcactccaacctgggcgacagagcgagactccatctcaaaacaaacaaaaagtatgtatcaggttgagcatggtggcttacatctgtaatcccagcactttgggaggttgtggtgggaggattgtttgaggccaggagttagagatcagcctgggcaacagagctagaatccatctctacaaaaaattaaaaagttagctgggcatggtggcttatacctgtagttgtagcttctcaggaggctgaggcaggagggatcacttgaacccagaattttgaggttagctcactaggtatgatcacaccactgcattcaagcctggacaacaggtaagacactctctctaaaataggtaggtaggtaggtaggtaggtagatagcacttatcaaatttttaaaaaagtggacaggactaccctgtgatgtataggtgtatatacttgagtgattaaattatttaaaaaacttgaagaaagtcaggataatggttacttttggtgggagagagacttgtgattgggacaagtcacattgaagaacttctggggtggctcttttattcgttttgattgtgccaaaatatacgtaatataaaatttactatcttaacatttttcagtgtacaattcagcagtgttaagtacattcacagtgtcatgtaaccaatctccagaactgctttcgtcttgcaaaatggaaactctgtatccattaaacaactccccattccctctcctcccaacccccagcaaccactactctactttctgactccatgattttgactcttctagttacctcatgtaagtggagtcatatagtatttgtctttgtgacttttctgtagatttgactttctgttttgttttgagacaatctcacttactcccaggctggagtgcagtggtgcgatttcggctcactgcaacccactcctctcgggttcaagcaattctcttgcctcagcctcctgagtagctgggattacagacatgcaccaccacacccggctaatttttgtatgtcatattacagacagggtttcaccatgttggccagggtggtctcgaactcctgacctcaagtgatccgccagcttcagcctcccaaagtgctatgattacaggcatgaaccactgtgcccagcctagtttgacattttttaaaaatgaaaagttaaaaaagctttaaataagttactgctagattaattttcaaaaggaacagaacagttcctaggcccatcccctgactcttttctaaattgccggacacgggctttctgtggttctgtgagtcaaagcaggaatagatctttggagctgattactctgttctgtgcgccctcctggccatgccttggtggagtggggtaaagccaacagctttttttgtttgtttatttggggtctggaagacccttacatttaaggttgaggctgggaagagaggatttagtcagccactgttagagaggagaaatactacatttaacatatgcaaaaaacttttttttttccttttggctaaccaagtagcatttcccttaaaagcctgggtttttagagggccctggactaggaggaaggaggagatgggagaaggcttaaggaagccattgccaggtgactagcttgactggacatcctatgttaatgctttatttctcaaaataaggataggccattaagagacttacgagtgttctcgctcagccccactactggccggatttgctgcttggaaacgagagtgggaggctccttgtctcatgtttctgttgaggctgtaacatacccctagaaaatgccttttctctccaggaaaccaaggtacctctcctgagggagggacagggcgctgagatggtcccgagagctggctatgaagtgtgacaggacctgacctcacctcttaccccaacccctacccatacttcccacccccctttttggtaaaactgagtggccttgagggttcaaacttccagggaaggattactcatcagcgacctctaacatatgtttggctttttagtaaaatggcatgaaatcgataatctgatgatctttgtaagtatcttgtatcaaaatatccttgctctagatactgtatcttttttggtcagaattgaaaggatagaaatagagattcttctgaaacctcattatgtatttcggactagctagtctaagtctggtgacctctgttgttgtttgttttgaataaaacacctgaacacattttctgacttatggtctgagcagagagcagaatatttgaaacttggaccatccaaaaagtgtgaaatgtaaggtcactgctttaataaatcatctggaaattcagtagcaaaccctagaactggtggcaggatggaaaggaagttttctcattttcacattagcagacgtttggttcttttcctaaatgacattgcaaacatcctgccggttctcccggatagggtgttaacttgaagtgcaggggagatttccaaggtcctctgagctttcaggtcaaatctcctgtctttacaaggcctttctgttccccaggatggcagacttaatccaaatatgagaagcacttggctaaccatcttgatggatctggcagaagaaatgccagtctgtttgcactgctcaggacatagttctgagccatggagctctaggccaaacatagacctataggccttcagggcttactggccactcaacacccagattatgagggccagatacattatgctgatgtcaagagtctccttgacatcaagaggtgttgggtggaaactggaggcggaagagctcagattccgctccagtgcttccttattcctggtcctctctcccacctctcagccaggctggtggcagcatctcacccgtttccatgaagaacactagctccgctcctgggagagtacaaagaggctctccactgaagccagctgcatgttttcctctccactctgcctgaggatggtctgctttggcctgtatcccgtgcttctcaggaacccagtgaccttggaccacctttgagtgtgttgccatttttctctaatatattcttaatacaagggtttttactggctcagtggattttaaacatgttctttagagcaacctcagtgcatgaatattcaaccaaattaatggtcccttatttgctagcttatgtattggtcaggaaccgtaagttcacatgccagtacatgagcccatctgtgtggcttccattttgacacacacacacccccttacactcaacactcattctcacacacacacacacacactttcatatacacgcacacacgtacaccctcacacatacacacacttatacgcttacactcacattcacagtcacacacaccatatactcacacacacacacacacactcagatacacacacataaacacactgtcttatgtgtttattgagcatctgtcaggtgccaggaacgctacctcttgtcttgaattttcaccaagatcccataaaatagggattattgtcatcattttctagatgtggtacctgactgagagagattgtgtgtcaaagagaacattgccgttaagtgacagtgtccagacacacacccaagccctgtagactccagagcccatttgttccctgtatcatgtcatcctggatggcctgtgttcaatggacagagtgtcttctcacattaaaggcatccaaaggtcttcagctctcctctccctggcgtgtcacagaggcatctcttaactgacatctggcatcccatgtgacatggaggtaggtggatcacgtgaagtcagttcagttcatgccttggtctgaaaaatggtcagcatgatgcttcctgttactgtcaccagatgaggttcttatgatgggcacagccttttaacctgatgtgtgtcttctctattgatgacattgctgcatcttaagccggctgtggtgaaggactagttttttccatttgcaataatttgaggacagatacttaaaatgtatataatggaaatgtcatggtcatgtaaaaaattgctatgcaagttccaaatgcttgctctcagcttctgtacttctctcattgtgggctggtggaataaacagtttgttgtcccgtgctggtctgtgggtgcgtcttgaatagcactctaccatataatttaggggcagtatcaatgacttcagaagaaaaatataatttctataagccacagctttaaaatgaacttaatttatagtaatagtgtttctgtttagcattctaattttaaatattgtttctacaactttaaaaaattacaaaagtagttcatgcttgaaatacaaattcaaatagtatgaaaattttcaaataaaactgttcccttttctcccaggcccaccccccaaacaacttttatcaattcctaaattgaaagttcatctcacattcaagaaagaagggtgtggatcagaatttatgaagcgggggaagggatgggagaggcatttcagaaatgtatccaattttttactctatttggtcttgttttttatctcaaaggggaaagtataacttttatgagtgtatatgactctgtataaagtaacatgacagttatctttgatgtacagtattttctaaaattgattctcttttgttgcagagccagattacattaatggatatacctgtgtttaaagctatccagccggaggtctgtactttgtctttctactcttctattcatgctgtgggtgggcagcgaggatttagccagccactgttagagtgtctcagtttctctcttgcaggctctataaatgcatgttatccatttaaaccccattctattcttgatggtgctcatgtttttgagcccagtatttggattttccagagaatgtctcccgtctggcctactctggcagggctgggagcagttggtacccacaggactccacgcctgagagtcaggtcttaacaccctcattccttttcccaggctcctcctgctgaaaatgtttgctttcaagaagtgatgtgagggaacatttttctggaaagttctctttttgttcatcccaaattctggtggttgccttgtttctatttttgaaaccagttgccgaagcaaacatgtacatatttacattgaaagcatatatgggtcaggtgtggtggctcacacctgtaatcccggcactttgggagccctaggtgggaggatcgcttgagatcaggggtttgagaccagcctgagcaaaatagtgagtgtcaaaaaaaaaaaaagcatatgtacatttttagaaacagcatattcaataaagggtaaaaagttgattttggtcttaaaaaaattcctggaaatgtttggcaattgataacaaggttttggttattttacccagggtgtgtgtgtgtgtgcgtgtgagatcaggtaaacaaaaatccatttcaaagtagctgaatagggaggctgaggcaggagaattgcttgaacccaggaggtgaaggttgcagtgagccatgattgtgccattacactccagcctggacaaaagagcgagactctgtcaaaaaaaaaaaaaaaagtagctgaataggctgaagaggaatttattacaaggataaagggacactttacagaattcatggggtgagttcaggcatccagagagccaccaggacacaggcagtccctacttcctgctccgcttttacctctccttctcctgctttcttgtctgatttgacctgatttggcctttccaaagggcccacgtttacatgatctttaagtcaccgtcccagactgggaccagcagatttcagtccaggccagcatagtcatgtgtccaatgctggtccagtcacctaaggccaagagtatgtggtcaacatgggcaaacactgagggacccagccttgtgagtgaggttcagacctcagaggagaggagtgtggttggggagatagatcaaaaagtgctgcaactagggtgtgaattccagaatactcttaacttaatgcctttcttcttacagaactgttaagacttgacaaagagcatatcttaacacaaagtcacagtgttcaagccttccgagagctggcacctagtctactaaaaattaggaggaaactagtaccactagctttgttcagcatttatgtgaagacgtggcagttatttgtattattgtattattatgtgtgtgtgtgtgtgtgtgtgtgtgtgtgtgtgcttgtgtctgtgtgttcattagggttggggaacagagctttgtttgctttttttgaattggctgacttccattctttttctgttttgttctaatgtggtatgatccattatttctaatcaaaaacaacatcaaatcactgcctcttgaagccctttggtagaataggtgtgtgatggttgccttagttctcagctgaagctgtttctgattatgttctctgcttagctctgatctggagcagtttagacatttagggctttattcttcatccgaacatcaaggagggcagcccacctgccgtgagccctgaacctgcatgtgcccaggagactgggatccttgccaggctgctggaaggagggaggcgggtgggggcttcttcctcttcagaggcatagccaaggccagaccaagacttttccccagggtgctgcagtttggaaggtacctcatcaacacataccttagttcaagttgtgacaagacgttagagtggagatgttttgttttcaagactgtagtttgtagcagtggttcttaatcgtggctgcacatcagaatcacctggacagtcttggaaacatgagggtacccagagtcccctccccaacactcccccacagaccattgaatctgaacttaaatctcttgatgggggtctgaaacctaatcagccctattttgtaaaagtttcccaggtaattctgaggcagagtgaggattcagaactagttgctttaaggtatctggagaaaccccagacttgaacattttggatctataacatgttagctaaaaatggaagagtttgctcctcattgtcaaaactgtggtcaaaggaagcaccctgggagctgccccagcttttttgctgatgttattatcattagcagactgaaaactgaaaattttcctcttggggatgcctgccatgttgtggctggaccaccccagagttggaagggcatgaataaagtacaattttaagtatgcagaggccagcatctgagagcaagatgggtgctttgagtgacctatgctcccaggagatcaggaaacttgtagactagtgcctttcaaccctggctgtgtttcaaccctggctgtgtatcagcatccacttgggaattctttaaaaaaattacaaatgcctaggcttcagccttagagattctaaatgctttggtttagagtgtgactcaggaatctgcttttgactgggcaccctagtggttcccagttggatgagaaccagggatgtagtgattgtaagactgatagcaatttgctttgtgaaatcctaattttctaatttctaattttcttatgtagtgattgtaagactgatagcagtttgctttgtgaaatcctaattttctaaagattttttcttgcgtagttactaagattacccttaattcagcccacagaggtaagaagaagaatattaaccatggaccctgtagccagtacctgaaccaggcctgtctgagccctgaccctagagctcaagctctcagcccctgttgcatgtgggtgtagcctgactcctgcactgcacagtgggcttttacctcttttgatgtggaaacagccatcttaccaggcttccattgtgtaagcaatatagtttatgaatatattcctaggctgttcagatccttcacaactggagaattgatcctggctgggtctagatatggtgatttggacttctggggttgtcctggaagacatcagccacttcctagctggtcatttttccaccctggctcaggtttctgctttcccatcatgctgtttgccaactctgtgcttattaatgaggagatgggggtatttagcttgaaaaaagaaggtacctgagggacatgattcttgtccttggagatctgaaaggctttgagcaagctatgaggagttatggtgagacctggatacttttggatggtattcgggatggtcctggaagaagaatgttccaggttgtgggattagcatgcacagagggtgtggtcaaggacatttgctttgatggaggagtaggggagatttgaacataaaggcttctaaagccctccctgccatgggggtccttgagtttctggcgcttgtctggagggcagctcccaatgatggagtggtgggcaacacccttgcccatgcagacccttgcctctgtgtccttgcttggctccctagccctctgacctaatccctgaatgcccaatggctcactatgcacagggttgaaaaggggtgggtgctgatgtggactgttgctgggtagcctgggctgtttacattttcctgagcatttactgtgtgcaggctctaggctaggctccttagatgtagggtctcatttaatccgcatcacagtgttatgatgtacctgctgttattgtctttgttttatatatgaggaagctagagctcagacatgttaagtattataacttagtccatgattactgtattagtcctctgttgctatgtaacaaattactcccacacttagcagcttaaaataataagcatttatctctcatagtctctgtgggtgaagaatccaagagtggcttagctgggtggtcctggctcagggtctctcaggaggttgtagtcaagatgttggctgggactgtagtcatctgaaggcttgagtggggatggaaagtctgcttccaaggtggctcgtgcacaatgcctggccgttggcaggaatcctctgttccttgccatgtggaactgttcagagccactgagtgtcctcatggcatggcagttgacttctcctagaatgagtgacccaagagaacaagacagaagccagcaaggacttttgtgacctggctcagaagtcacatactgtcatttgcacagtatcctattagtatcacagatcagccctcttcaccaaggggggcactatacaagagctggacaccagcaagtaggaagtgggggaccccttggagactgcctaccacaggcctcaggtcagaaggtcaaatacagttagtctaactccagaactttcacagttctgcctctgccagtgccccagctatgtgaccttgggtaagtcacgtcacctctctaagttttggtttcctcattcatagagtggtgataggaagagtacctccgtcatagggtttatttggagaatgaaatgagataatgcatatagagtacttagcacagaggctggaacctattaaaacaacaaccaccatttttgaacgtgtagtgcataccaggcattgtgttgagcggttaaagtctttattcagagtttgctgctattattactattgttgttgttgttgtggctgtgactgtggttgtcacccaccagtttccctttatgtcagtctctggcttgctctagatacatgccttcctgcctcagccccctgccctgctgttctcctgtcttcttgcctctcagttccccttcctctccttcttattcttttaaaatatttcttcttcttcttcctcttcttcttcttcttcttccttctttcttcctccttcttcttcctcttcttcttccttctttcttcctcctccttcttcttcttcttcctcttccccttccccttcttctcttcttttcttcttcttcttcttcttcttcttctttttttttttttttttttttttttgaggtggagtttcgctcttgttgcccaggctggagtgcagtggcatgatctcggctcactgaaatctctgcctcccgggttcaaacaattctcctgcctcagcctcccaagtagctgggattacaggcacctgataccacgaccggctaattatcgtaattttagtagagatggggtttcaccacgttggccaggctggtctcgaattcctgacctcaggtgatctgcccgcctcggcctcccaaagtgctgggattacagatgtaagccactgcgcccagccctattctttttaaacatttcttattgttaacaattttgaatagatatgtgtatgcacatactgggtttatataggaagagtggtaaaatgaacctttgtatacctgttacctagatccaacaattgccatctttgcttcatttacctctttttttctttttatttattcctggaaattttgaaagcaaatgcctaacatcctattatttccctccttcaaacttcagatgtagctctttaaaaagttattttctaccataatcacaatagcattatcacacttaacaaaattagcaataattctttaggatcaaattgggggaatttcaaatttccccaattgtctcaaaaacaaacaaaacccactaatagcagtgacaattccagggcctgcacattgcatttggttggttgttacgtttctcaaattcctttttattctagtgtagtccatcctccctctcctccctcatgcgcttaacttattgaaaggttagtcgcactctgtaatattctaaattgtaaatattctgcttcttcttggtggtttaacttgttcacttgtcgcctattttgtttcaactagaagttaacccaagaggcttgattggattttgggtcagtctttttgggaagagtgtgtcctaggtggtgctgggtactttgtatcacatgtcacattaggagacacccagttgttttgctctgtgtcatgtgaagattcattgatgggttcaggtggtgactgttttattccttcattgtaaagttccccatctaccttttacctaattatttcatctgtcaatgatctttgcctgaattgagtattttattggtcctagcaaaatggtgacttttctctctttctttttttcctttttcagagacagagtcttgctctgtcacctaggctctaatgcagtggtgtggtcatagctcactgcagcctcaaacttgtgggctcaagccatcctctgcctcagcctcctgagaatctaggactacagacatgtgccaccatgcttggctaatttttaaaaaatatttgaagagacgtatcactgtgttgcccaggctggtcttggactcctggcctcaagcagttatcctgcctcagcctccccagtagctgagattacaggcatgagctgccacgcctgactcttatagctgaaattcttaagaagaatttttcctcatcagctagggctacttgtacatacttaattctttccttttaattatcaattttcagagtaagcaggtggtgccccacttacctttaatggtgacttgtgggtgtgtaactgctttgttttgtttttggtgagcagtctgtctcctccatcataatgaacttgtggatatttattatacgtcctgtgtgtttcagtcagttatagtcaccattctttttgatatacaaattgtcctgtctttgaccagttggatcccttttatgttggctcctgtatccttttaatgtgatcccactcatttttgatcacttccctgctttttggcccaacaagatccccagggttatgttgtatattttctgctgcagacctggaattaggcattccttcagggggtttcttttagtggggaataatatttagaaaccataatctgggtgaagactgcttagtattactgggttgccattgcttttaggcctttgccatggacagagctagtaaacagttattttttaaaaggaaaatgtcatgagttcatagttagggtagatgatattatttctccataattcttccttctcaacttactccttgtcataccttcactgtgggtggtgtatatctccccaccctattgactttgggcttggccctgtgacttggttttgcccatggaatgtgggcagcatggcagtgtgcagatctgagctgagctgctgagaggcgtggcaagctttggccagctgtcttggaactttccttttccatgatgtatcggtaactgttgcttgtttatcttcagtccccaaatgaggacattacagttgacctgaactgacccgaagtctagattccacactgagacaagccaaagccaacctggcagagctgagctgagctgcatcatctacagacctatgagcatgaaataaatgttgctgttgtaagcatctgagatttgaggattgctcgttatactacattatcttgtaaaaatttgactaatataatactgatctttccaattcaaatataacattatagagttgttacttaattcccttgatatttatatattttattttacagtgacaattttggttcctagcaacattacttactttatattatcccgtcatatatatgtaaaataatttaaaaataataatacgaatattactactaagcagtagactgctggtcaaattttaacattttcttgcagttagttcttttacttcttgtcttctctctttcctactacttacatacccaagtgggcctctcccctggacttttcccttaaaggtctttggaagcaccaggacagaaaaggagggttatgctaatttggttctagagggtctgcatactgagataccctgttgtaatcccagtacctggaacacagtacataataaatatttgttgaatgagtggagtgtgaatggatgcctgaaaggggaagcgccatagcagaacattatctggctgtgtttaggcacactgccaagcgagggcgtgtgccaaccaaaggagcgatattaccagggtgtcttgttttgtggtgtaaccacttcccgcaaagcaagggtatttcctggtgagctcagccttttgaagattcacatttccaaatgcagttgataactgagggtggagctgtggcttttcatgacttctgctggtttctgcaagggggaccacaaagaacatcatttcagggcttagaggaagccaggcagacggtgagttaaggattggcagagagtaaggaaaatggaagttacaaatatggaaccataactgccctgtcccctggtgactctaacgagtgaccaagtttatcaaaaattggtgtattaatgcagatatagctttgtagcataatatctcacagctgtgttgaacttacaagttgtggcctagaaccccattgccactgtggtggattgggttgcagggtagattcctgggtggattcctggctgccagggcttggggcaagggctgcattgtaaaggaggtctgtctgaaggtcctggtggtagcagccttctaaaagggtatgttttcaaggtggtgttttgtctctaccagagctccttaccacatctgtctgtcagtatgtccagttcccagcctatggagttgaaggcgcagcagtgtctcagaggctggtctaaatgtcagaactgtttttgtcattagttttagcatggagcagcatcaaggggaaactgctgttcttagaatgtgctgaaaatgggcacagcctgtgctttattcagcccagggttctgtcagagctgagctgctgggtctgttaaagccacacagcttgaagagcatgaactttgatctgatgaagctgaggttgagtcacagcctcacccctctagcttggagacttaggacaagtcatgtattttctttatgccttgattttctcatgtgtaaagttggcggggggtggaagtcatagcttttaccttacagtgggcatgtaagaacttagcgcggtgcctgtacaaagcaagctcctagtcatgcgtggctatcatttcaccaatgtatagtttgaataggcactgtgggttatagatgggaggttgttgctcagaatattcagatgatgcctgtgccggagccagtgtcccagaggaggtgatacctgtgtagcagagtgtttaagagcatggtacctgggatccttcagagctcggttcacatcctggtgccctggatagctgggaggctgaggtctggaccaagacatacaccatggtgccctaggagccctgcaaacatcatatggggaactcactcaatcttggggttgtgacattatcactaggccttgaaggctgaaagagatcatctcttattggtgatttggggagttggggggcagttggaaagggaatttcaggcagaatgaataaccctttggaaagacaggtgatgtgctcagcaaaatttaatactacttttggtgcctggtgctcttgagagaagaaaaggagaacctgctcttccctcagttctgtgctctgccagagcatcattgccagggatactggtacatgccaaaggcttaccagaagtcagtgtttcattcccttgccgactggcagctggggcatggtgtacggtgggcctcagtgtgatagaaacgaactgcagtgggtaccaatttcagtgaggtggaaagctttcctaagtgctcgtgttttttccagtcttctcactgcccctgccaacattgttccatccccactgtcagatttcccagtagtcagctctgccttcactcatttactcattcatcagtctactgtgctaaatgctggagaaacgatgaaggggacctcggcacaattcaacctgagtcaggcagacatgtaaataaatagtaaacaagaagtgttcaggggtggggcgctagcgtatcaaggaaagagtgagggtgaggatgggcagaaggcaaggagcatgtcccacagaagggatgtttgaataaggaagccaggagaacggggtggccaagagcatcgcaaaagcagaaagattcagttgcatatgggtgtttggagaacagtgaggagtctgtcatgacgggagaagtgtatctaggtctctcctgcaagaccaggaccaaaatccagaggatgagtggccaggaaatacaaggaccagtggtgaggtcagcagcagaggaggtggcaagaaaggaagagcctcaagcctggcgggggtgagagattgagaggccttgcactgaaacctggccatacaaggcctggcatctttgaggagcatggacacgtgtcaagagagccaggttgggccaggcagtttgagctgggcaggagacggcagtgaggcttggaagggaggcttagatgtgcctgactaaggagtttgagctttatcttgttagccctgagcattcactgagagatttaaaaaaacaaaaaatagagacaaagtcctgctatgttgcccaggctaaagtgcaatggcatgatcatagctcactgcagcctcaaactcctgggctgaagcaatcctcccaccttagcctcccaagtagttgggactgcaggtgtatgccaccatacccagccctctgaaggattttaaaaggggagcaccgtggacagatttgtattttaagatgttcatttcaactgagacagaaccacctgtagtcagggagactagttaggaggattttgcagcagtctgcatgaggcaaggtggtcacactggagagaagggcagggcctgatgttatactggttgtgaggctgctgcaagggccaagatgagaggaagcaggctgtagttgtgtctggagaaaagtgggctgcccacttagggagcagcaggaagaacaaggggcaaggaaggatgcacagaaagtggccctagaggtaggaggaggcctagttaagtcaagcagggtgatcagcaatgttgcctttagggagggaggccagaagggccagagacagccgatggcctgaaaaaaggctgaaggactcaggaggccaaggtgggaggaccacttgagcctaggagtttgaggccagcctgggcaacatagcaagaccccaccttatcatcatcatcatcagcatcatcatcatcatcatcatcatcgctgaaggaccaaaagtcaagaagagagcaaagcacagatttggttaggggaaggggagggaagccaggaaataatggagggaggaggatttcagagttcagggtctttgaggtggggtggctctggtgactgtgcttgaaggtgtgatggcagtgcctttgtgaagcacagaagaggttgaggcatgggggcacccagaagtgagaagtttagtgaagtgtgtagagatgacaacaggagaatgggaggaggggaagactcaagccagagctacaggtaagggagcatcatggtgggagagcatacagcagcgtggaggggaagtagaggtgttaggacccggcttgggcctccctgaagacaagctgtgggcctggactgtgggccttggaggtgaggaaccagaacatccccagtatctattcctgggtttgaggcacggaccaggtgctcagtgttagtggaaggcaggccaggggtggtctgggtgggcctgctggtcctctccctctagtcctcattgtctgtggccctggagggaacctgctaagttcctcctaagtgtgttttaaggaaaaggcagttctggttagaatgaggaggtgggagcagcattaacagaaatgttttgggacaaaggaggcattctgcagataaaatacatattcctgtgggacacttactctagagggattcgatttcacccttcctgcatcaggctggagctcgagaccttgagcttgacttgaccagcatctgttgggtccttttctggtttgcagaaaggctggcctgccagaatggaagactccctgcagaagtccacagtttcctccaggccacatgacacgttgcagttcaggaaaacactgcctgtgggtccaggaacctgaccctctggccttttgtctggatgccgtttgcctgctctgaagaagcgggcgttccagaaagccgaggtcaatgttggacgtcggacaaaccctgtgtgtctttgctgctccttggaatcagtgtttggccctcggagagggaagaatgtggccagcaggcagtcatttgtaaagtggagattggtttccctgacatcattaaaacccctctctcaggtcacatgctgggcagttttctcagaccatctctctctgctacaccaacctagtctaatccactgccatccctcccctgaatgatggcagcagccttttcatgtctcctcacattgagttccatcccccagcctcctctttggaaccagagacatctttctaaagccaaagtctgaccatgtccctgccctgcttagcgccctctgtggctacccactgctcctaggatgcagatccgccttcatgcagcctcccaggctctgtgaaataggccagcagcagacctcccgactctctcctgctccagttcaccactttgtgtgcacaccacagcctccctggtgttcactcctgtctcagcacctccgcacaggttgtgccctctgccgggaatgctctgctctgcctccgggagatgatgagcagtcagagctccgaggtagtgctcctccttctcatgctccctctcatagccgcctcatacttcttacgtatggcactttgcaccctcgtactgaaatattacgacttttaaaagtttgaattatgagttcaaagtctgtttccctcctggtttgtgaactccaggaatgcagagatcatgccactactcttcatccctgactcctgtgatctaatgcagtgcctgatgttgtttgttttttgtcgaatacatttaggatgtagcagtagtaataatactaaaatcccttgaatcctttccacttctatgctatctgcctctctttgttcaaaaaactggattaggtggtaggggcagtcttggtgtccacaagttggggccaaggcatagaaaggagggctcccagcataagactcattagagctatcgttacttagcacccaaaggctaaacagctgtctaatttgttaccgctctgagttcacatttgttatttgcacattttctagaaattggtctgttttaacagtttcttgtcacagtggaaacagagtagaaaaggaattccccaactccatttatttcatggtggagataagagtaggggctggagttcctctctgagccgcaggataaggcctgcctgaagggtggggagaggctactggggcaggagtctgaactggctgcacacacaggccagcagcacatttgatccaacactttgcaacttcgagactcattttttttttccttcttgagcatggatatgacattagtgttggttagaaaccaaatttccttttaagtgaataaataacacaaaacagagcctttggtgaacagctgttttcatccatagggacttggtgcctggttgggatttttgtctgcaaggaaaagagggtttgtttgaactcttgtcataggaacaactacatgatcccaggaagtttggggtagtgagaggatcataagttttggaggcaggaaggtctgcatttgaaacttggctctgctactctgtagctgtgtgatcataggcaagttccctcatctttctgtgtctctgttttcttctctgtaaagtggaaatgatacccatctcatagtgttatgatggttaagaagattgtggaagagggggcctagaatggacctcgcacatggcagaaactcacaaattgtttcttaatttttgagagaagtctgggaagtaataaggagaaaagcaataggcagcgctgataagtcaagctgagaagggctctgggctcagcagtatgtaaagcttcccaagggtaggacctcatctgtcattgctatatccctcatggcaagcagtgagtaagcagtgtctggtacatgacaggatcaatacttgtcaatacttgtttgatgaatgacaggtgtgtagaaaagcatttccacctgtatggcttaaagcttaagagcttgggctctggagagagaaggacctggatttttatctctgtgaccatggtcaagtcacttagcctctctgagtctcagtttctgtatcagtaaaatggaaattataatatgactacctcaaaagaattggacatgaggacagcatgagattattttcagcgttattgaggtataatttacatatgtaaactatgcatactaaagtcaacaatttgatatgtatgtatctgtaaaaccatcaccatctcaatataatgaacatacccatcaccccaaaaattttttaatacctctttgcaatcctttcctcctcttccactccttccactgttcttgaaattaggtagtgtacatccttaaagtttgttattctgtttcaaaattgttctgactattctaatccttggcatttcaatatgcattttaggatcaacttgttaagttttaccaaagaagtctgctgggattttgactgtgattgtgttgaatctgtagatccatttggggagaattgacattttaatgatattgcatcacctgaactatgaaacacaatgtaactccatgtattaaggactcataacacagtatatcacctcatgtatgtaggtcttctctaatttattttagtaatgttgtgtagtttgcattgtataggccttatacatcttttgccaaatatatgtagggttttctacacagataatgatgcctctgtgaataatgacagtcttgtttctttctgaactggatgctattgtttctttttcttgccttgttgcatgggctacagcctctagtacaatgttgggtagaagtggtgagtgcagatattcttggcgtggtcctgatcttagaagaaaagtggcctttactcattaaggatgatgtttgctgttagcagtaggttttttcatagaggtctttttatcaggttgaggaaatttccttgtattcctaatttactaagagtttaatctggaatgggtatttgagttttatcaaatgcttttcctgcatctattgacataatcatatggtttttctttttcagtctgttactttagagaattacattgatcgatttttgactattaaaccaaccttgtattgctgtggtaaaccccacttagttatgatgaattaattatcttttttgtatattgttggatttgatttgttaaaattgtgtttagaatttctgcatctgtgtttgtaatggggaatattgatccatatttttcttttcctgtaaagtttttgtctggttttggtatcagcataatgctgccctcacaaaatgagttgagaagtattccttccttttcaattttcaagaagagtttgtatagaattagtgtgagtctttcttaaatatttggtagatatcaccagtagagccacctaggtctggagttttctctgtggaaagttttttttttttttcttttaaatagagtttatttttaagaacagttttagagtaaaaagcttccactgtagctctggtctacagctctcagcgtgagtgatgcagaagatgggtgatttctgcatttccaactgagctttgaagagagtagtggttctcccagcacgcagcttgagatctgagaacgggcagactggttcctcaagtgggtccctgaccccagagtagcctaactgggaggcacccccagtaggggcggactgacacctcacacgaccgggcactcctctgagacaaaacttccagaggaacgatcaggcagcagcatttgcggttcaccagtatctgctgttctgcagccaccgctgctgaaacccaggcaaacagggtctggagtggacctctagcaaactccgacagacctgcagctgagggtcctgtctgttagaaggaaaactaacaaaacaggaagaacatccacaccaaaaacccatctgtacgtcaccatcatcaaagaccaaaggtagataaaaccacaaagatgggaaaaaaaacagagcagaaaaactggaaactctaaaaatcagagcacctctccttctccaaaggaacacagctcctcaccagcaacagaacaaagctggatggagaatgactttgagagttgagagaagaaggcttcagatgatcaaactaccccgagctacaggaggaaatttgaaccaatggcaaagaagttaaaagctttgaaaaaaaaattagttgaatggataactagaataaccaatgcagagaagtccttaaaggacctgatggagctgaaaaccaaggcacgagagctacgtgatgaatgcagaagcctcagtagccgatgcgatcaactggaagaaagggtatcagtgatggaagatgaaatgaatgaaatgaagcaagaagagaagtttagagaaaaaagagtaaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacatccccaatctagcaagacaggccaacattcaaattcaggaaatacagagaatgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctcttggcagaaactctacaagccagaagagagtggggaccaatattcaacattcttaaagaaaagaattttcaacccagaatttcatatccagccaaactaagcttcataagtgaaggagaaataaaacactttacagacaagcaaatactgagagattttgtcaccaccaggcctgccctacaagagctcctgaaggaagcactaaacatggaaaggaacaacaagtaccacccactgcaaaaacatgccaaattgtaaagaccatcaaggctaggaagaaactgcatcaactaatgagcaaaataaccagctaacatcataatgacaggatcaaattcacacataacaatattaactttaagtgtaaatgggctaaatgctccaattaaaagacacagactggcaaattggataaagagtcaagacccatcagtgtgctgtattcaggaaacccatctcatgtgcagagacacacataggctcaaaataaagggatagaggaagatctaccaagcaaatggaaaacaaaaaaaggcaagggttgcaatcctagtctctcataaaacagactttaaaccaacaaagatcaaaagagacaaagaaggccattacataatggtaaagggatcaattcaacaagaagagctaactatcctaaatatatatgcacccaatactggagcacccagattcataaagcacgtccttagtgacctacaaagagacttagactcccacacaataataatgggagactttaacaccccactgtcaacattagacagatcaacgagacagaaagttaacaaggatacccaggaattgaactcagctctgcaccaagcagacctaatagacatctacagaactctccaccccaaatcaacagaatatacattcttttcagcaccacaccacacctactccaaaactgaccacatagttggaagtaaagcactcctcagcaaatgtaaaagaacagaaattataacaaactgtctctcagaacacagtgcaatcaaactagaactcaggattaagaaactcactcaaaaccactcaactacatggaaactgaacaacctgctcctgaatgactattgggtaaataatgaaatgaaggcagaaataaagatgttctttgaaaccaacgagaacaaagacacaacataccagaatctctgagacacattcaaagcagtgtgtagagggaaatttatagcactgaatggccacaagagaaagcaggaaagatctaaaattgacaccctgacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggtttttttgaaaagatcaacaaaattgatagactgctagcaagactaataaagaagaaaagagagaagaatcaaatagatgcaataaaaaatgataaagggatatcaccactgatcccacagaaatacaaactaccatcagagaatactacaaacacctctacgcaaataaactagaaaatctagaagaaatggataaattccttgacacatgcatcctcccaagactaaaccaggaagaagttgaatctctgaatagaccaataacaggctctgaaattgaggcaataatcaatagcttaccaaccaaaaaaagtccaggaccagatggattcacagccgaattctaccagaggtacaaagaggagctgataccaatccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaacatacacaaatcaataaatgtaatccagcatataaacagaaccaaagacaaaaaccacatgattatctcaatagatgcagaaaaggcctttgacaaaattcaacaacgcttcatgctaaaaactctcaataaattagatattgatgggacgtatctcaaaataataagagctatctatgacaaccccacagccaatatcatactgaatgggcaaaaactggaagcattccctttgaaaacgggcacaagacagggatgccctctctcaccactcctattcaacatagtgttggaagttctagccagggcattgaggcaggagaaggaaataaagggtattcaattaggaaaagaggaagtcagattgtccgtttgcagatgacatgattgtatatctagaaaaccccatcgtctcagcccaaaatctcctcaagctgataacttcagcaaagtctcaggattcaaaatcaatgtacaaaaatcacaagcattcttacacaccaataacagagaaccaaatcatgagtgaactcccattcacaattgcttcaaagagaataaaatacctaagaatccaacttacaagggatgtgaaggacctcttcaaggagaactacaaaccactgctcaatgaaataaaagaggatacaaacaaatgaaagaacattccatgctcatgggtaggaagaatcaatatcgtgaaaatgaccatactgcccaaggtgatttatagattcaatgccatccccatcaagctaccaatgactttcttcacggaattggaaaaaactacttaaaagttcatatggaaccaaaaaagagcccacatcgccaagtgaatcctaagccaaaagaacaaagctggaggcatcatgctacctgacttcaaactatactacaaggctacagtacccaaaacagcatggtactggtaccaaaacagagatatggaccaatggaacagaacagagccctcagaaacaatgcttcgtatctacaactatctgatctttgacaaacctgagaaaaacaagcaatggggaaaggattccctatttaataaatggtgcttggaaaactggctagccatatgtagaaagctgaaactggatcccttccttacatgttatacaaaaattaattcaagatggattaaagacttaaatgttagacctaaaaccataaaaaccctagaagaaaacctaggcaataccattcaggacataggcatgggcaaggacttcatatctaaaacaccaaaagcaatggcaacaaaagccagaattgacaaatgggatctaattaaactaaagagcttctgcacagcaaaagaaactaccatcagagtgaacaggcaacctacagaatgggagaaaacttttgcaacctactcatctgacaaagggctaatacctagaatctacaatggactcaaatttacaagaaaaaaacaaacaaccccatcaaaaagtgggcaaaggatatgaacagacacttctcaaaagaagacatttatgcagccaaaaaacacatgaaaaaatgctcattatcactggccatcagagcaatgcaaatcaaaaccacaatgagataccatcccacaccagttagaatggcaatcattaaaaagtcaggaaacaacaggtgctggagaggatgtggagaaataggaacactttgacactgttggtgggactgtaaaaccagttcaaccattgtggaagtcagtgtggcaattcctcagggatctggaactagaaataccatttgacccagccatcccattactgggtatatacccaaaggactataaatcatgctgctataaagacacatgcacacgtatgtttatagcggcactattcacaatagcgaagacttggaaccaacctaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcacttacaggtgggaactgaacaatgagaacatgtggacacaggaaggggaacatcacacactggggactgttgttgggtgggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataataataataataataagtttcagatttctagcaaaattgaacagaaagtatagagtgtacattctgtatctcctgaccccgtacatgcacagcctcccccactatcagcgtcctcccccagagtggatttgttaaaattgaagaccctacactgatacagcatcatcacccaaagtccatagttttcattagagttaattcgtggtgttgtgcattctatcagtttgacaaatatgtaatcacatgcatctgccattatagtgtcatacagaatagttttactattctaaaatcctctgtgccccacctattcatctcttcttctctcttaacccctggcaccactggtcttttcactatcttcatagttttaccttttccagaatgtcttatagttagaatcatatagtatgtagccttttcagattggcttctttgatttagtaataagcatttatgttttcttcatgtcttttcatggcttgatagctcatttctttttagtgctgaataataatttattgtttgcatataccaaagtttatccattcacctactgagggatatcttgattgcttcaaagtttcggcaattatgaataaagcttctgtaaagattcatatgcagatttctgtgtgaacacaagttttcaacccatttgggtaaataccaatgagagtgatagctagatcattgtggaaagcttttaaaccacaaatttagtttctctaactattcagtttatctgtttcttttttagtgagttttggttgtgtttttcattgagcctgtgcattttatctgagttgttaaatttattcccatgaagttgttcataatattccctttttattcttttaatatctataggatctgtcatgatgtcccctgctctcattcctcatattggtaatttgtatctctttgctttttttcccctggtcagtccagctaaaatttactaattttattgatctcaaggagagcttttggtttcattattttttctatggcttttctgttttctgatccattgatttcagttcatattctttcttctgcttactttgggtttaatttgctcttcttttatagtttcttaagtagaagctgaagtcaatgatttgagcgctttcttcattgctaatgtaggcatctaatgctataaattttcttctaagtgctgctctagctttgctcccacgcgttttgatattttgggccttcatttccattaaattcaaatgctttctaattttccttttgatttctttttgacccatgaactattaaagatgtgttattcagtttccaaatatttgaggaatggctaggtatattcctgctattgatttcttgtcttgtctttttttttttttttttttttttttttttttgagatggagtttcactcttgttgccgaggctggagtgcaaaggtactatctcggctcactgcaacctttgcttcccaggttcaagcgattctcctgcctcagcctccagagtagctgggattacagtcatgcaccaccacctctggctaattttttttttgtatttttagtagagacggggcttcgccgtgttggtcaggctggtctcaaactcctgacctcaggtgatccacctgcctcagcctcccaaagcgctgggattataggtgtgagccaccgcgcccggcctctgctattgatttctaattccattgtagttagagaacatactttgtatgacttaatttaaatttattgagactagtggctaagaatatggtcaatcttgataaatgtttggtatgaacttgagaaaaaagtaagttcaggccaggcgtggtggctcacacctataatcccaacactttgggaggctgaggtgggtgggttgcttgagcctaacatagtgagactctgtctctacaaaacaaaacaaaacaaaacaaaacaaaacaaaacaaaacaaaacaaaacttaactgggcatggtggtgcatgcctgtcgtcccagctattaggaggctgaggtggggggatcacttgaacccaggaggttgaggctgtagtgagccatgattgtgccactgcactcaagcctgggtgacagagcaagactctgtctcaaaaaaaaaaaaaaaagtaagttcacactattttttgttctcttttccttctttttctgacttctttttaattaattgagcacacttcatgattccaccttaacttctttattggcttatgaggtataatttctttaatttcagtggttggtttagggtttttagtatatattttaaacttatagtctactttcaagtgataatataccattttatgtatagtgtaagacatttacaacagtgtatgtctatttacctccgtcctattctttgcagtattgttgtcatacatttttcttctaaatatgcaataatcgggctgggcgcggtggctcacacctgtaatcccagcactttgggaggctgagttgggtggattactaggtcaggagttcgagaccagcctggccaacatggtgaaaccccgtctctactaaaaatataaaaattagctgggcgtggaggcgtgtgcctgtaatcccagctacttgggaggttgaggcaggagaattgcttgaacctgggaggcggaggttgcagtgagccgagatcgtgccattgcgctccagccttggcaacaagagtgagactccatctcaaaaataaaaaataaaaataaaatatatatgcagtagtctctatattaatacatttgcattaaatgataatctgttaaagtctattatcttttaaagaaattttttaaaatgcatataatcaggtacacaaatcttaaggctataactcaatgcatttttacaaagcaaacaaacaatgtagccaccatctggatcaagatgtaaaacataccagcaccccagaaggctacctcatgccccctccaagtcatcaactatgtacaaatgtaaccatgattctatcaccataggtagttttgtctgtttttgaactttatataaatagaatcataaaatacgtacattttgtctggcttctttcacttaacattatatatgtgagatttatcctgtttttgtgtgtagcaggagtttttttctttctcatttttgtatagtattccattcattgtatgagtagatcatattttatttatatttttcaatggtgatggatattttgggtttctggtttggagctattatgagtagtgataccacaaacattcttttttttttttttcttttttttttattatactttaagttttagggtacatgtgcacattgtgcaggttagttacatatgtatacatgtgccatgctggtgcactgcacccactagctcgtcatctagcattaggtatatctcccaatgctatccctcccccctccccccaccccaccacagtccctagagtgtgatattccccttcctgtgtccatgtgatctcattgttcagttcccacctatgagcgagaatatgtggtgtttggttttttgttcttgcgatagtttactgagaatgatgatttccaatttcatccatgtccttacaaaggacatgaactcatcattttttatgactgcatagtattccatggtgtatatgtgccacattttcttaatccagtctatcattgttgggcatttgggttggttccaagtctttgctattgtgaataatgctgcaataaacatacgtgtgcatgtgtctttatagcagcatgatttatagtcatttgggtatatacccagtaatgggatggctggatcaaatggtatttctagttctagatccctgaggaatcgccacactgacttccacaatggttgaactagtttacagtcccaccaacagtgtaaaagtgttcctatttctccacatcctctccagcacgaaaacctaggcattaccattcaggacataggcatgggcaaggacttcacgtccaaaacaccaaaagcaatggcaacaaaagccaaaattgacaaatgggatctaattaaactaaagagcttctgcacagcaaaagaaactaccatcagagtgaacaggcagcctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgtagccaaaaaacacatgaaaaaatgttcatcatcactggccatcagagaaatgcaaatcaaaaccacaatgagataccatctcacaccagttagaatggcaatcgttaaaaagtcacaaacgttcttgaacatgccttttgttagacataaactcccattttccttggatgcaatgtgtgggagtgaaattgctggctcgtaaggtgtgtgtatatttagcttaatagatactgccaaactgttttctttctttctttcttttctttttttttaaaattattttttaaaattttattttaagttgtgggatacatgtgcaggatgtgcaggtttgttacataggtaatgtgtgccatggtggtttgctgcacctatcagcccatcacctaggtaaaaagtgactgtatcatttcacattcctgttggcactctgtgagagtttcagttgtccagcatctctgtcagcactttatgttgtcagaagacgaaacagtaccaaatgcagagttcacctcagcacatttatcctctttctggcatcttgggcctcaaatcctggcttctttggttgctctgtctctttaaattgctatgcttttgatattatagttactttatccaatttttatggttagtatcagttactttgccgtagacagagtcaaagtctcttttctttctcttctttcttcttttcctttccttccctttcccttttcctttccttttttgagatggagttttactcttgttgcccaggctaaagcgcaatggcgtgatctcagctcactgcagcctttgcctctcagattcaagtgattctcctgcctcagcctcccaagcagctgggattacaggcacccgccaccacacccggccaatttttgtatttttagtagagacagtgtttcgcaatgttggccaggctggtctcaaactcctgacctcaggtgatccacctgccttggcttcccaaagtgttgggattataggcatgagcctgtaattgttttgaaaacaatcttctgtggaaacattatttttcttaaattatattaaggcattgttctactctaaagggttgggatggcatgaagtgctactacttatgtctgggtaattgcagttttcacatcactatgttatgtctactgttatggtgtctggaatatgttccatttgaaaggaatttatgaaactgtaacttacctttatgattatacacatctttttgtgtttatttgatcttagcttaagttggaaaatgtcaatgaaaaaatatattgtgaagcttacataatctttagtgttactttcataagcagacatttagcctgcaatgataggcttcttgtcagtggttgcacgacatctgcaaaggagaaggagcatccacctccagaagatacgtaagggagaggggaccttatttatgagaagaaggcttgagttaaaaagtctggaaatttttgaaaactcagatttaccctaatacagcagccttgttttggaagacccttcaaaattgtttattgcattgccaagcaaaagaagtcactctggtaggagagaacttggtgatgctgcttaacttagacatgactgagctgagttgtggcccggagcagaggaaggagattaagcagttcctgtgtcaagtgatgtgatttctagagtagctcacctgtcttctggtgttttgaagcaggtcatggaaataattggcagcagtgccatttctcttaaaactcattgcatgaactgctagtgatagttttagtgcaacccagctcctattgacatctgtacctgcatgttgtcagcatccaagaagaattgttatactgcaaaccctctgagaaatttcagtcttcagaatggcaaacagttcctttgccaagctaaattttgactgaaaggaatgtcaaggctgtctgtgcacagatgaagcatctgctttctctggcaatacttctggttttgtagctttcatgaaacaagaaggcccacctgtcactgtggctgggactttctgtgtcagcgtgcattgatgtcaaagattacaatggtcttgaaagcctgctttgacagcctgtggtttcatcagagccaggccttgagtcactgccttctcaggaggtttttttttatgaaatggagcagaacagaaagctgcttcgactacacaggagttcactggctctccaaaggataagccttgaagtacttgactgaacttcagactgaagttctacttttttttctttgaaaggaaaggaaaactcacaaaacagagaaagaggaattcattcatgacttggcttacttaaccagatatttttggccatgtgagtgaggtaaacctttcaattcaccattatagatgttgctgaaaagtgggcatttttagccactctgccttctacaagaggagacgtgggtggacaagtctgcaaaccttctcctgctggaagaaatgtttgtgcagcttgggagtggcagagtcatgcttagtcttcagcagcagaaatctgcagagaccaatagatgtgaatacagctttcgataaaatccaacatctcttcatgctaaaaacactcaacaaactgggcatcaaaggaacatacctcaaagtaataatagccatctatgacacatccacagtcagcatcatactgaatgggcaagagctagaagcattaccctgaagaacaggaacaagactaggatgcccactgtcaccactcctactgtctgcttttgcaggtaacttctgctcagcaaaacatgaaaacagagtatggattcacggtccttctttggggacaagccattcgtgaaggaaaccttgacgttgtttttctcagggacttaagaaaaaagaagcgaatgcagtgttgatccacctggaaaacccttggagaatggtggcgttctttgacatctgacattcactgactcttgtcaataggctttgggagtggtgatttagtataccactgccttcctttgggagtctgggttttcaagcatttgttgatatctaaatttagaaaaggcaggttgaccaaatgtcaaggagtgtttcacaattccactgttacattcaataatgataatcattataactttgtttattgaatgctcgttatgtgacaggcattattctaataactttccatgaattaacccattgaatatttccaacactaatataaggaaggcagttttattatcttcattttcagatgaagagactgaggcccagagaggttaataaaactgcccaaggtaatagggctgctcagtggtggagttagatataaacctaggtggtctggctctagggtccacatgtccacacccctggtaactgcttctgttgtgccagggtacagcatactttgtgttatagttttcattttaatcttattggcacaatttggatttcttttgattctttttagggtgtcggtattaacttttgtgcatgaaagggagagagggagagaggagagagagaaagagaggaggggagggaaaataatctctgaaaagatttttaaaatttaactctaagataaattgtgtacaacatttctcatgcctttgttatttacattttactggggagggagctcgtaactgttattagggataccagaggcttctgagacccaggagcagggaccacatctgtgtgtctttgtctcccatatgcttagcatagttctgggtacatagtatttgttttgtaatttttcattgagtataaagttgctgtacttaaagagttaaagctctattttctggaaaacttactttttccaaacactttgcttccagctagttgatacaggataacactcatttggtcaacaattagttattcaatgccttctatgactgggtgcttccttaggcaccagacacacatagatgcacatattagattgtcaggtcccattcctgcacattgcttgtagcctatggaaggaagacatgacttgagaagcaatttaataaagaatggtaggggctgtcgggggaattacacgtgccgtagaagtacatagaaggagcatccagctttgtctggtgtatggtggggggctcaggaaagcttgtctgaataatagtatataagccaagacttgaggaatgaactggtaaaggggagaaggagtttttcaggcagagggagcagcatgtaccaaggcctgaggcaagagaaagcaagacagggagggcagagaactgaaagaacacatttcagcatggctgggtcacgccacaatgaggccagtcacagatgagctagagagccagccaggggtcagggccgaagacccttgtctgacaggtcaggcagtgtggatcgtccgctgatagcagtaagacattggagggtttcctgcaggggagagctttgattagatttgcatggcttacaaggattgctctggctgctctgtggagaagagacctgcgagggagagccattcagagactttcctgtggtctaggtgaaagacgatgtggtctgtgtgaggataatgcagtggacaagggtgacccacatagatgcaggaatgtctaggtgctgttctctgcaggccttggtgctaaggtggatgtggatgttgtgagagagggaggagtcaaggatatctcccaagtttctggtctggtcaattgggagactggtcaaaaaaaaaaaaaaatgatgtgggggtggggcgggtatgtgcagaatttggttttgcacatgttgagttggaagtgcctgtgtgatacctgcatgaggtatcctgtaccagcagcatgactgtgtggctagtacacttcttactcaaatagctgggctattccatggacctaatcttcatgccttctggcagaactctaggttcttagaagcagctgcccctggccctgtctgtgggaggacctctaggcttgtgaagggatctggttgggactggcttgccaccagaacctcattactggctgaagtgtctttggggattgggacctcagcaggaccagggaaacaaaaccgtcagtagaggcagctgtgggaaaagtgggatggggtgaagctgaacatcttagattagatccctagttgcctagaatcctccagaaaggaagggaggagtcagaaaggaagctcaagcaccttgtctttggggagactggtgatatcctggttagtagcctgaattatggtacagacggagctgggtttgagatcctgctctaccacaaccagatatgtaaatctgggcttaacatctcaaaatcttaattatctcatctgtaaaatggtgaaaataattgtacccacttcataggattattgggagagttcatgtataatgaatttagatcctggctagaacataatcaatgctcaggaaatggctgctgctgctatttcttctcttcctcttttccttcggccttcatttgctgttataatcatcactcagatgtctctctgagaagtatgttcttgaatcttgaatcccaattctatggctttagaaaggctttaggaaggctttttgctttcaaaatccacgcaagatcctagaggcttatttttgtcacatataccatttttcactgcaccacagtgatgtggagatacttttgcaagttcttctcaaagaatctgtcttatagaacattagggagccacatagacttcattgaaaggaaaatttgggagctgcactatcagctttaataggcactataggcatccctgtttctaacatacccattggatgcctcatcattgtgggccctttagctcatcccagcctcttccagctttcccctgaacgactctttgttcccccctcatcctttatcatggattgtccctgggatcatccatctccctttactgtacagagcagttcagatttctcaacacctgtggcccaacacacatcctccaatccatcaaggggaccagcaggtcagagcaccctccacctaacagggccacatttccttgaagtttgtgagtataaatatccccttttagcagagaaaggatctgatttcattattaatggtcacggatatctttatttgtgtttctttgatctaggccctaggagatgagtcagtgggtgaaatctactgaaggggttgtgagtatggattgtggcctatctaggttgaaacttgggccttcccacttactgttctgtggccttggacagtttgcctcacttttttgaatctctgagcctaagagtctaggctggtgtttctcttctttaaagctaccaccatctactttatgccttggaaaaaatgtccccagcatacctgtgagatagagtactgtcttagcctctgcccttcccactttcttgaaggtttagcccacagccctgggtttgttgatgtttaactgctaacttccctggagggaggcagggaagcaaagttgcacaccaggaatatctacagagattctagaattccacagaattggaaactgtgcccctgggtctatatttcttggctcctgactcttccaaggaggtccctggtttcctgtttgcttccattttccccaagagaggagctttgcctttccttcattgggccaccgtgctgaagggctgtgagagtagaacagtgggaggccaggtgagtctggcaagccaacttgaccaaacaaggaatttggccatcctcacggggcggtgtcatggaggctagaggtggggagaggctggagccagagcctggacacctggccaggctctagttgttcatctctctcctctttgtccttcctcatcgctttctcctgcctcccctgacttcctctgactgtattaaggtggctgccctacagctcctgagtcctagagactgattcactttttctccctccatctagcttccaaattcatacacaagtaatttattaattgcctggagggttcagattcatgtcattcaaaatgactgcctggattccacccctggctggggttgagggcaaggtaccgttcctagagatgtgggaatggttgagagccgagcactctcaagatgccaggaatgggtgccattgtccatcaacatccacttgtcctaatatgtcatttgcctcttggggcccttctggctttgagagccctatctgctttgatcagtgcctttcgtgttcatattgtgctggcttctgagcagaggccaagaacatggctgcagggctggtgggctgggagcccacagaggagtcagggaatgagtgatggctcctgctaattgatggcctcaaaatcatccacgttagtgcagcctttagttttacatgacttgggtcagatgtggggacacttggccattaggaagctttacatagctatttggggttaagaaagattccccttatgagagagctcattctacagttttgtaactcttcctttggtctctgatgtgctgtctctttgtgggataaagtctgcctctggagagtcccatatatcagtggcccatctgggtcttttgggttctgtggaggctccccgagacctcctctggggtggaaggagtcctagagctacttcagtcacttcctctgtggtgatcatagcagtgtggccaagccaggggctatatcttggctgggcaatgagggggtttgccctggcggctggagatgcatagggtgttcctagaccgagagcccaccaccccccagcccgccttttttttttgagatggagttttgctcttgttgtccaggctggagtgcagtggcgtgacctcggctcactgcaacctctggctcctgggttcaagagattctcctgcctccgcctcccgagtagctgggattacaggtgcccgccaccatgcccggctaattttttgtgtttttagtggaggtggggtttcaccatgttggccaggctggtctcaaactcctgacctcaggtgatccgccgccttggactcccgtagtgctgggattacaggcgtgagccactgtgcctggccaagagcccattttttatggaagtgcacttccttgggactcttagaattcagtagggtgtattagacaaattatatgtctaactagaaaaagtgcattttaaaagctttatttatatctggctggtactttaatagccatgttagtaacttctgactaggtttgtgcctatatttgactgagacagttaggttgactctccctctcaccctaagaaatttaaaaaataaatacttttataggaccataggattttacatgccaagatttaggctgaaaatccgagcataaaaattggtttgtatgtaacaggaagattaataggcagttcctcccatcccctgtcccccgtcttacagagtggtcctggcagcccctgcctgcctgtaaatacttgggtttgcctcattggcaggtcagcatggggcaggaagaagccagattattttatgatccataaacgcaagcaccagacatgctccgaaattcattagtgtttacttgtcattacaaatagcctgtgttgtttgccttccgactagacgggcagacagtcagggcccaattgcagggtgtggagggccctgaaaccccgactctcttgggaaatgagagtttaaagcaaagttttaatttatggctgcagattgtttctttctcctgagtgtaggtattgagggtgtgaatcttcagattcagactggctttttcttcagtggaaaatatgaagtttttggataaaacctactaataagtagtcatctcatgtttgttttgttttagttatttcccccttttgaattatagataaactttttaagcagggaaagcttaaaaagtttaagcttaaaaagcctcaaaatgttatgcccagatacttccctgggcagcagattttgtaccatctccccctgagcctgaccgctttacagagagcagccctgtgtctcggccacccttcccttccctcctcttggacctggagcacccagggcttgggctatggcaggcccctgactgtagcccccttggtccatttcagacccgggtgacaccacaaggtgattgtgagactgtggaaacccctaagctgctgctgttccgacgtggaggtagtcaggacgggctgagctgtctcagctgcacatgtgctgaagctgagactaaggcagcccttggaggctgagtggcatctgggggaaggctggtgtgcaaagggccagatgtctgaggtttctgagtggagttgtagatttgaatgtaattagaggataattcttccaaatgatcttcatgtggggctggcttaggcattcctggggtctgcttgggatggtggcttcatgtctatcaatcactcagttgttcagcacctattgaccaggcacataccatgtgtaagaccccctgcctggtatttcagggaactcgaagatgaatgaggaatccctggtctaatgggaaaggtaagagatttacctaaataattacaagggtctcactaaagaggacaaagtgctatatgggaggggagccaatacttccagctaggacaacacacaaagcatcctggtggagcttccgttgtggcctggagaattggtataatttggacacaagatagcgagaaatggcatttcaggtaccaggaacagcttgaacacaggtaaggcagttgggaagaaagtggccatgtacagggaccagtgagcagattagtttgatctaaagcaaaggtgaggagctttgtgggaagtaagactggagaatagagtggccccactatggccttggttctgtgggcgctggcagagcaagtgttgtttgggagctgtgcttccttcaagaagctgaacaggtggaagccaaagtcctacaggtgccatagtcacagcatgccccaaaccaagcctgattctttccccagaatcccgctgtggtacgcacccctggaatggcatgcctgcccacccagtcaggccagaagcatggtgtctgttattgacgccccctctctctcccacagtctctgctcccagtcagtccccacaccctatcttccccttttccacctgtctgtccccagtgctacccctcaactttggcacttatctcccagcgggcatctctacacccatgtctgccccatcccactccgttgcccaatctgtggttttaaatctctgtccacatccctgagcctcttcagcatctccagtggtttccccagtgcctttgggtgattccacatctctaaggggggcgtgcaggtaggagtgacttatcctttccttccaaccctcttctggcctcccgactcactctctgattcacctcctctggccttcccacaggtccttgaacctacctccaggcctgtgcattttctgctctctgcctggcatgctagtccccccacttcagctaagccagtccttcttatacactgattgcactctgaacttttccttatgcgttcagcaacatgttcataattgatgcctgtcttctccaccggaagccaagcattgccttgtcactgctgtgtcctcctaagctttgcacagtgctgggcacagaggaggcactccgtgaagactgactggcattactgattaaaggatgcaggtgacagagctggggagctaaggcaaacagagcagcccgggcctgaggttgggaacactgccatggtcttgcttccagccttaaaaaaggggtttcacaccattgaaggctagtggctcaaatgttcaaaaggtttcctcatacttttaagtatccctgtatagatcaaacatttgaaagttgtttttcctttgagccttttaggaaagggaacttttcctgaaagagccattcctcttggtctgtgtgcacaccagccatctgtagccatcatcagacagtacaaatgccagaacagcccagcaccccataagatgttccactgcgtagccattgctggaatttatcaaattctggcattgtttccaggaatcctactctgtctagagacttcaagctgcttgtgatcaaaaagcgagttaactgggatgggggagaagactctttggctgtgaaatgttgaatgaaattattatctcataataatttcattatgagattaggaatggagacttaccctgtggtccctcttgcagtctgccttgctgcatactgaattcggctggacactgcagggaggcctgggggtggggggtgtggccctaggttgagacagccttcagtccctgtgcatcctctaggcccatcatttttttacagcccccatcccccacctcatcagccttttctaagtgatgtttgtccactccctggtctcctgtgtggttatcttacatcatacccgggacctttgcttattaagagatgaggctctggagtctgccatttactacctggatgcacttgtatagttatttaatctctgtgagccacagtcttctcatccatcaaatgaaatagtaaaatctactttatggtctggttttgagacttaaataaaataaagtagatttaagcccattatatagtacctagaatgtaggaaacatgcagtaacttatagttctcttccttccctgtctttttgttccttttataacccctgtggtgccattcactttgtagatagtcactattattcaaaatactggtagaaaatcatggtaacaatgcctgcccaggctgacagcactgtggttaagagcctgggctttggagtgcagacctggatatgaattccactttgtcacttatttgttacattgactttaggcaagttaattatcctttctgaatctcaattttagttatgtgtaacctgggggcaatcatagcccttcctcagggtgccattgttaaaaaattacggagcataatgtgagaaaagtattttgcctagtgcctgagatacagtaagcaaactgttagctgctgttattagtgtttattattattattctcagcctgggaacaggactgcgaacagatcttgaaggactctgttcgcctctcaaagtgaggaggagcttggcttcctggcggttggttatctcagtgtgttcccactgtattctcgtcctgcctggtgagatttggggctacacggtttgggtctcagcgtccccaagatggtcctgggtgtaagatggcctaggttgcctctttggtatctgatcatctggttgtgtctgctcctgacctgcaaactttcagagacagctttttcttgggaacatggaaaacatgtgggacacttcatgtataccacccatttgttcccctcttctcccaagttcttctcctgccctggacatcacatccctccctccctgccctgctccacttggaggcacttctcacaccatgtttccacctccaaaagatgcacctgatcccacctggggtttaacccttctgcccttgactgcctttctctcccttctcctccttttttcttttctttcttcctttcctttcttccctttcttctcttcttctttttccttctctcttctctctgtctctttttctggaacctgagttttccatttgcatttttttctgttcatctgctcccatctgttcccaggctccctccttccctgccaccccactgtttcctgtctcctgccacaccagattgtcttgtccaatttatccctgtacaacagtgcagtgcctagaagcccccaccccttcctgactgtctctctcggactcaacctctccatttgccctcgaaacactgaaagaaagaaaagtgctgcaattgcccagtctccaggggcaggtcttacttaataacgtttttatgtaatgccggttatatggcccctgcttctcttaggctcacagaatgggagagctgggaggatctcaaagaccatctggtgctgctatattttatagagagtaatctgtaactcctgcagtgggatgggctgactttaagtcacagagggggtttaggacacatctcagattagaacccaggactcctgacttcataaaaatataaaattgccaatgtgaacggcatgtgtccttgtaggtctttttttgtatttatttcattctacctataacccgaggcctctaacagttgcagctggatctacttaacccattaatgacaagccctacctccttttgcaggagtgaagcatggaggtggggacagacttcaagcgatggagatataaacaacctaggtcagtcatacgcagtgtcatcatctgttcagtcttcctacttgtcctgggctgaccttgccctctggttcttagcttcctgccttggctccaacctcactccagcccttattgatggggcttcatggtttgtctttggttctcctaccttgaccccaccttttcaagaagtacaccttatatttcaatgtcacgtctttttacatcagttagagctgtgttgtcttaatatggtggctgcatgtggctgttgagcatttgaaatgtcattacttcaaattgagatgttctgtaaatattaaaaaaaagaccagatttcaaagacttactacaaaaaggaaagtatctccttaataatttgttatattttctattgattacattttgaaaagataatatcttggatatacagtcatatgtcacttaaagatgggatgcatcatgagaaatgcatctttaggtgattttgccctagtgtgaacaccatattgtgtacttacacaaacctaggtggcatagcctactatacatttaggtgatacggcatagcctcttgctcctgggctacaaacctgtacagcgtgagtacactgagtaatgcaggcaagtgtaatatagtagtaagtatctgtgtagctaaacatagttaaacatagaaaaggtacaataaaaatataatgtaaaagataaaaatggtatacctatataggacacttaccatggatggaacttccaagactagaagttgttctgggtgggtcagtggtgagtgaatgtaaaggccttggacattactgtaatacacaactgtagactttataaatgctatatatgtgggctatactaaatctataaaaaattttcttcaataataaattaaccttagcttactgtaacttttttactttacaaacttaaaactttttgactcttttgtaataacacttagcttaaaacacacattgttcagctgtacaaaaatattttcttttttaatatccttattctataagatttttttgtatttttaaaattattttttctttttcaacttttttcattaagaactaagacgcagacacacacattagcctaggtctactcagggtcagcatcgtaaatatcactgtcttccacctccacatcttgtcccactggaaggttttcagggatggtcacacacatggagctgtcatctcctataataatgccttcttctggccgggcgctgtggctcacacctggaatcccagcactttgggaggccgaggcaggtggatcacctgaggtcaggagtttgagaccagcctgaccaacatggtgaaatcccgtctctactgaaaatacaaaaacttagccgggcatgttggtgcacctgtaatcccagctactcaggaggctgaggcaggagaattgcttgaacctgggaggcggagctgcagtgacccgacattgcgccactgcactccagcctgagtgacagcaagactccgtctcaaacaaaacaaaacaaaacaaaacccaaaccaaccaaccaaacaaaataatgccttcttccggaaggacctgcctgaggctattttatagttaacttaaaaaaaaaaaaaacagtagaaggagcacattctaaaataacagtgggctgggtgtagtggctcacgcctgtaatcccaacactttgggaggccaaggcaggtggatcacttgaggtcaggagttcccagcctgccgaacacggtgaaactccgtctctactaaaaatgcaaaaattagctgagcgtggtggcgcgtacctggagtcccagctacttggaggctgaggcacaagaatcgcttgaacctgggaggcggaggttgcagtgagctgagtttgtgctgctgcactccagcctgggtgacagtgagactctgtctcaaaaaataataatgatgataataataataataataataataataataataacgatgaaaagtatagcaaatacataaaccagtaacagtcatttattatcaagtattatgtactgtatataattgtatgtgctgtacctttatgtgactggtagcacagtaggtttgtttacaccagcatcaccacaaacacttgagtactgagttgtgctataacatttctatgactacggcatcactaggtgataggaattgttagctccattataatctgatgggaccactgttgtatatgtggtccattgttgaccaaaatgtcgttctgcagtacatgactatattgagttaaataaaataaatggtcaaaattaattttacctgtttctttttccttttttaaaacatggtatttgagaatttaaaatgtgtggattacattatatttctgttggacattgctgggttatagcctcataggcctttcgcaaccaggatttcatgagagaattaagccttgtgcctgaaggtccattgtatgtaatgaatgtaccatctcaggagagttaagaaacagtcactcaaatcattttctgtgctctgtggttcagataagaaacttagatgagaaaggctgtagcacctgttgttactcttttttctgttgttgcatgcatttactgttcattttttattttattttattttattttatttttgagatggagtcttgctttgtcgcccaggctggagtgcagtggtgcaatctcggctcactgcaagctctgcttcccgggttcatgccattctccttcctcagcctcccgagtagctgtgactacaggtgcccgccaccatgcctggctaattttttgtatttttagtagagacagggtttcaccatgttagtcaggatggtctcgatctccagaccttgtgatccacccacctcggcctcccaaaatgctgggattacaggtgtgagcaaccgcgcctggctgctgttcattattttttattgcttactaataatattccattgtataaatgtaccacaacttgtctgtccattctgctgcttgacatttgtgtttccaggttgaggctgttatttaactttgattttaagttcaagggtgcatgtgcagggcgtgcaggtttgttatacaggtaaacatgtgtcatggggggtttgttgtttcaaatttcaattcaaattcctgtagtgtttctctcaattgtataatgagggctgttggtttgagacagatactactaagcttctaagttgtttttctcttttttaaaatctcagatgaatgttacatttttccaattaccatttcaatatctattgagaggatcatatcacttttttatcttggaattatcaatatgcttgtttgattattaacattagctgattcctgtatttcttagccaaacttgttaagtttggggatttttttttccgtcactttttgtgctgtggtataaactatttgccataagaattatgtattcttcaaaagcctgagagaactcactggtaaaaccatgtggtcttggaacctttggtttaacttttctcgtttcttgcagggtttttagcatactcatcaaatatagaaaagtttcagttagtcaaaaatagaaggcagtgcgaagattaggtcagagcctgcaccttcctgtgaagcaggtacttccaaaaatttcattttgtattcccagcaatagtcaggatgaccctgcagcacatgaggatcaacattaagaaagattgaactgtgctgagacacatgaattgcaatgggaaaagtgagcaacaagttagagattgcagaaaaccaaagtaataaattaagggacaaactacaattttcttctgaaactcagagcaaaaacaaaggaagatgaatgtgatgaattgtttctaggagatgtcatgtgtgtatatcacaggaattctaaaaaggaagggtgggcagatgtgagaaaatgtttgtaatgtattaaggacaaaagcagattataaaaccacagctatagtatgagctcagttgagagccagtgtgtgtgcatgtgtgtgcccctgcacctgtgagtgtgggcatagctaccggccatggatgtgctctgtggctgagggtccaggctccagaggcaacaggcctaggtttagtcctggctctcatattgaacacatatgaggatttgagcaaattgttgaacttctccagctatgcctctatttcttcatctgtaaaatggggcaataatagtacctatttcataggggtgttgtgagaattcagggagcaatggataaatatatgtaaaattactgacattgtgcctgacacttagaaagtgtcctcagtaaatgttattgtttttattgtcattattataaaccaaaatgtaaactttagttttctctgagtgttaaggctaataggtaatttaaattttcttcattggaggccaggcccatctgcctatagttccagttactcgggacgcttaggcaggaggattgcttgagcccaggagtttaaggccagcctaagcaatgtaataagaccctgccggccaggcttggtggctcgcagttgtaatcccagcactttgcgaggccgaggcaggtggatcacttgaggtcaagagtttgagaccagcctggccaacatggtgaaaccccgtctctactaaaaatacaaaaacttagccgggcatattggtgcacctgtaataccagctactcgggaggctgaggcaggagaattgcttgaatcctggaggtggaggttgtgagctgagatcgcaccattgcactccagcctgggcaacaaagggagactctgtctcaaaaaaaaaaaaaaaggcattcagatttttaaaaaaagttcttcattgggcttctgtatcatgcaggttttctgtaatgaacatgtattaggtccctaattaaaaaaaagaaaagtttttcttcttcttcttttttttttttttttttaaagagaacatctgaatgatgtattcggaaaaaaacatttcccaagaatatggagaaagggaattgaacataattcccagtgtaagagtggaatgagcatgtggccctgtgggcctagtcccagtttgttaatcttgtgagcagagctgctggcggctgctctcagtccgctaatcgggctctttctctgtcacgtggacaggagactgctcacagggttgcagttggctgctgccctgcgttgacagctggttctaattgtgcagagctacgtagtactagggctggagagggaaggttttgggaaatttgcatcatcttcctgaccctaagtctgtatgttttccaagcagatggtagcttgaggatttgatgaaacagtagtgactgtaaatgagttgttattctatagaaactagtatgacctgaaagctgagaaagataaattgcttctgcttattcagtgagtacatatatgtgtatactgatttcactggaggcaccatttttccacagtgatcctttccccctcttgtggtttgtctagccaggggttctggggcctcgggaggccctcatgttcatttcttccacggcccatactgcctcctccctttctccacacacacagcccttaacaggtatttatttcaaattaccaaagtgagttgctctcacataagaaaatgcaaatatcccgtgcacttaccaaacttgattctagtatagtagaaggtgcttaaagggtttgggccctctctgccgtgctctccctcatggcatcagggcaatacagcctaccaaacactccatgtgagggtttggggagccacctctgcccagtccctacgttgttttcccatcccatgcagaaaaaaaaaaaaaattgcactctttaccttcccttaaggctgggacctggcctcccacccctgtcctgtctcactgtttcttctcccactcctccccaggctccttctgctccagccatgggctaccttgctgttctcagatatctcatggtgttcctgaatcagggtcttgacccgtgcacttcacttccttctgcctgggaccctcctcccctagatacctgcagagcatgctcctttacctcattcctgtctctactccatgccagcttgtcagacaggcctgctgagacatcccctccaaatattcctaccttcatcctcattcatgctttttcgcaggagttatcatctgacttattatgatttctttagaaatctctcttctcctgtagaaggtaagcaccatgaaagtaagagcatgtttgtttgttcactgctgcatttcctaaaacatactttaattttggtgaataaatgaatgtagatgtgctttataaactgccaatcactgttgtctcttcctttttctcttccttcctcctttatggtttcatatcaactctttcccttcttcaaacaccatcatcatcatcatcatcatcaccaccaccaccatcatcgtccaagaaagaactaaagatacctcagtccactggcagctcccagaaggcttggacctaggcaatgtctattaggactgcaaccttgggaaataaagcaggaaagtccagttgtcctttgtggccttgagttgtggtaatttatgttcctgtctgtccctgctttgagcagacaccaatttcaagacccggtctgactcactgtggaacctttccagcacagtcctggcacttagatggctctctcttctttctttcccacttgcccttaatccctttattcctcctcctcccttcttttcttcaatttttcttcctctttccttgcttccttgttctttttgtctttctctccttcctgtttttctttcatgtttcactgcagctggtcttcttccagggagggcttgggacagtgcctggcagtgagttcccctccagccatgagcttttctgactccctcagtgctaacgctccctccctctgctaccaggggacctgcatgcacttgattctagccttaacagctctcctgtaggacaggtgtgtttccctaaggcccagctggtcatgattttcacatgattactccatcaaaaagtacagaaacagggctgggcgcggtggctcacgtctgtaatcccagcactttgggaggccgaggtgggtggatcatctgacgtcaggatttggagactagcctggccaacatggcaaaaccctgtctctactaaaaagtacaaaaattagccaggcatggtggcgggctcctgtaatcccagctactcgggaagctgaggcagaagaattgcttgaacctgggaggcggaggttgcagtaagctgagatcgcgccactgcactccagcctgggtgacagagtaagactctgtctcaaaaaaaaaaaaaaaaaaaggacagaagcacctagtggtcatgtgaaaactgtgtgttatttataaatgttgacactgataggttataagtaggttatgactttataaaaattaggcatattttagagtatttactcaacttcaaaatatattttttacaaggtttacaatgtgtaatatgtcatctactaaaaattattttttccaagtgatcttgtacatgataaatagtacaggaaagcttatgaagaaaaaccttcacctcagtcccctccccaaaggtacactctttaaactgttttttctgctggttacttttggaattttatttggcacaccaaagcctgaatttcttgtttcaccagctttgtgtggtatcttgtgaccgctcacttcctatgctttccctccagttctccactgcccaccttctgttgattatacttttacattgcctaattaatgagcttcaccaaactcatcacacttttccttaggtggactcttaaagttgaaaaccatcaaacaacacttattattatggctacgtaactgttacacatagtcaagccaagtactatgccaggattgtgtttcattccctagtaaccctgggccattcaaaagagaatatgcctcacaagacctgtagattttcttctcttttaatccattgattgcttgatactgggtatgtattatatgttgattcatgttatatttttaattgtttttatatttccccagaggcttcccttcagcagcactttgtcctgctccagtgtgaactagttgttttccagtcttttgcgcagctgtttttataggaccttcctttgcaatgctctatggttggactctttccttttttttccttcgtcatatttattgaggtttaattacatccagtaaaaatcacccattttagtaaacagtttggtgattgtgaagaatgagtgttctcatgtggagaccttgtctgtcaaccccaaaagttctgtgtgcccctttgtagccagtttgcctcctgttcccagtccttggcaaccaaggatctaattcctgtctctgtcatgtttaccttttccagaatgtcatgtaagtcaaatcataatactttcttgtgtggtttctttcacttagtataaaactgttgacattcgtgtacgctgatgtatgcgtcactctgtcattcgtgtttttgttgctgagtagtattggattatatggctgtaccatgatttgttcatcgcctcaccagctggtggaaatccgggttgtttctagtctggggaaatagagaatgaagttgccgtaaacatgcacatacaagttttttgtggacatatattggtattgggtaaatacctacccaatgggattgctgggcctaccagtgagattgctggggcagttgataagtgtgtgcctaacttgatgggaagctgcccacctgctttcctaaatggctgttctgatcctccatagcacctggtattgtcacttatgtgtgctttttgcgatgattgaattaaatgtggtgtccattgtcatttagtttgcatttccctactgactaatgacatagagcaccttcccctgtgtttacttgccatccacgcatcctcctggtaaagtgtatgaacaaatcttttctttcatttttttttttttgagacagtctttgttctgtcatccaggctggagtgtagtggtatgatcatggctcactgcagccttgaactcctgggctcaagcaatcctcctgcctcagcctcctgagtagctaggactgcaggcaagcacaccatgcctggctaagtgttttttgttttttttctaattttctgtagcgacagggttgcactatattgccaggctggtttcaaactcttgggctcaagcagtcctcctgcctctgcctcccaaagtgctgggattacagatgtggtttactttttaaaaaacattggtgtattagggttctctagagagacagaactaattttatctatatataggatatatatacaaaagggagtttattaagtattaactcacacgatcacagggtcccataataggctgtctgcaagctgaggagcaaggagacccagcctgagtcccaaaactgaagaacttggagttcgatgtttgagggcaggaagcatccagcatgggagaaagatgtaggctggagggctaggccagtgtagtcttttcacatttttctgcctgctttatattctagccgcattggcagctgattagatagtgcccacccagattaagggtgagtctgccttccccagcccactgactcaaatgttaatctcctttggcaacaccctcacagacacacgcaggatcaatactttgcatccttccgtccaatcaagttgacacagtattaaccatcatcacaattgggttgtttgacttctattgttgagttgtaacagtttatattttatatacaagtctcttttctatcacatatttgttttacaaaatgttttttcagtctgttgcatttccttttcttaacagtgtctaagtacgttagaggggttttttctaagtttttgtttctttttcttccaaagtcattgtcatttattaccttggttttccttccgttctgttggcttcactcatatgcctggtggcttgtaggtgttgtgacttttttcccctggcttttctcctgaggggagtctgcctgggatagccaagtggcctgggcaagacacagcaggttgcccacactgcaggatgacagggtggggactggcatgcagggtgcagttctctaactgtcagcaaaacgaggcgacctttattctgtgggttccagcatggaagcctttaattctcccatcccactttttgcccgggggtggatgctagcaggcagcgggtgggggtgctggctgagacagtgtccagtacactgacctttcatttgtcctctgtttattgttccttaatgactctgagccaggagcctttctgaggtcccccaaggcagcctgacttcaccacctctgtagccccttcctggcatagtctagcttgagactttctgttttcgtttaatcaaaatccgtgctgatctccagtaatgtgttgaaatctctcatttgacgagggtagtagtgccctccactccattctcttcctagtttaggtctatcttttacttctgtgctttgtcagaggggtcttgggagtgatgttaggcaaatgcatatgtcaggtgtcatttgaacacgcaacctgttttgaacttaatatggaaccagttgtaggtggttttgggtttgtcacagacacagatgatggaatcagcttctcccttttgaaacttgtttttaatcatggactaacttcattgttctctcacatatttcattcatggtctcattaagagttatagaaaaagatgatatttgattgtgtttacagtgaaatatatacaaatacaagcatttatattttgttaataactattaggatctgctggaactgcagattttactgaggggagaactggtggtactggatgcgacccccacccaccagtggatgaggcttccctgaaacagaccagatgcgtattctccccaattagcatatccataaactatggcacatttactgcctaaaagaaccaagaagcttctttgcttcccttagcctgctttgtagtctcagattgttgtgagttctgacttttctgacaccatgtagagcgtgggctctggaatcagactgaggtttgaatcccagttccagcacttactagccatgtgaccttagacatgtggcaatctctctgagcctcatagtctcatccatcaattggtgcctatctcatcgtcttgtttgtggattcagcaagttacagcatgtaagtcccctagcccagagtctagcaggccattttaacactcagtaaacactgattctagatatccctaagtctctgcccctggaggagctccctatgtatctgtagacattttaactctggatcctattatcccttttgtcttttaagccctgcctgtgttgccagaggcactgtgccccattctggctatggcagcccgattcctgggctggccctaactcaggtgtggtgctctcagaagcctgcccaggttctgctttggtctatgccttcatgtcacccagttctcctctaggctgcaagcctgccggagccccggctaaggcctgcagctctgttctggctgtggtgaggatgggctcccatcacttctaccatccactacctgtgtggtctggacaaattacctgcttgttacatattatttcatttagaaattggaggtcagagcagtcatatccactgtgagggttctgtgaggataaaatgagatggtctctgtggagtgtgtagcacagttcctggcacaacgtaggtgctcaataaatcttgctggtgcttccctttggctgggccttggctctcatcctggcaccattggagtcctactgtccagggactgctgtcctgtgtgcctcctccatctgattccaggggctctcctggcctggattttcagcccctgcacccactgctcagcgctgcctttcccctttgagcattatttaatttaatgagcacgttaaaaatattacaatgtatcatttttttctaagcactttgcaaatatcggcccattcaattcctataactaccttacagaggaggtgctattattaatgccatttttcagatgcagaaagtcaggcactgagagtttaagtgacttgtccagggtcacacagccagggaatcagcctggtccatgtaagtccctaactactacatgctgtggcctcttttttgtgacccttgtgcccccagagctcactcctgagaccagagccagcccctctgccagatcccaggtgggtagctttcatggaattctgttactcctgcttgggcctctagacccccaacttccacacaaggaaggtgtggacatcatgcacctttgctactgccacagcagtcagtatatatggtctcctggggtgaatatagatagagaagaatgtagacttccttgtgggtgacaaggcatggaagtccctgaaggacacgccagccattctcttttatttgcccatctccttagcccattcttaactctgtcacaagagtctaggccctgaatgccttactccccagtcagacccactctggtcaggtccccaaaactggcactgtctccctgactgccttactgggtcacctatctcccagggtgtttcagaactcctttggttaggtgtgtaattgtcccaccagttcttctgaagatgatttataaaagcaaatctggcaggtctttcctgttgtttttttttccttcctgtgagagggtaggatgggaagagtgggagaaacatggagggaggaggaagaagaaagccattgagcacagtggtgatgtgctgttggctggtgccagcctggcagtggtcctgaggtctgttgtagtgacttgcccttgaggcaatgcgttttccatgtggacacgtttgatgaacgtgatttggagatgactgcagtgagagttaggcacacgtggaagggccatgtgctgacgccagcttcctgtggcccgatggcctagatgccgtgggggtcttcagagaggacttgtcaccactccccagtctcctttcccaaggccttacgtgatggactccagacacggtcagggttgggcctgtctcagctcacctcaaggcgtctgactcccagacccctaagcacaaaaccggcagctagtggagtgagcctcatggtggggtggcccagagcagctttgcaggggcagctgaaaccagtgttgattcttgctttcacctaggaatgcttacaggtgggggtattaagactaagtttttttgcacagttagggattatttccacagtgtctttgtgataaacattcttctttgactgtcagatgaatgtctaaatgaattttttgttgttaacgtgttttttatttaaggcagctggtcagatacccctttggttctgggcccactgattttgagttgtctgtggatgccaaagaaggtatggccaggaggcacctggctatcttggacgggagctcaggagagaaacttgggctggacacagacatgtagttgaagccacaacagtcagtatatgtgatcttctagggagaaatatagaagaatgtagaagatgaccttggacaagttgaggtggagattgtgtcagaaaagaaaagagcagccggaaaataagactaagagtgaggggcccgaaaggtggggagacaacaggagaacacagtgtgcaaaggcaaggcagaggacaacaaatatggtggaggctaagagcggccggtgaaggggcgctaatttcctagttgggaagttgtcttaggggaaggaacagttacaggggagcagagagcagggaaggcaggtaggagaggggagtgagtttaagtcgttctcttgcaagggagaagagtgagcaggagctggaggggacagggtctgggagaggtgttttttattgttattaatattaatgggagaagcttaatgcatgttaaaatgctagcaggaaggagaaattggagaggaagacgtggaaggtacagggatgacagagggcatcagagtaaggtctctgagaaggcagaggggtgggatgggggcaggaagagagcgaaagaagcccctctttcattaaagccagaaggagggagaggatgcaaggacatttaagtttggtggcaggaagttttcttctcatagcatctgtttttccctgatgagcctgaggaacaccctggtgacaggaggaaggtctcagcagcacctggtaaaggactgcacaggctcttagtcccctcacatccagtcagctcagccacgtagtcagggccagggaccgtctgggcaagatgtgggcctcagcgcccatgggaagggctgtgcgacagtccctgggtagctcagtggctcaccacagacacagagctaccagggccgtactggtctcatcccaaacccttgtctcccttctagaatcagccttgtctcctctggtcaattttaactaaattacactcaaataagttccacagtgtggaccttttttaggcattagtgactggaagagttttgttctattacttcacattttcctaaacccacttaacacggatggaatctcttgtaatcctgtaagaccaaacacagaagaggaactgcgccaaagcggtcaggcccagtacttgtttagcacagacagaatggtcatacttcttctgaccttgtgataaatcttctgtgctgaatttgggaggtcttcacactgaggagtgctcatgcttcattcattaacagaggctgcttgagcatctactgccagccaggccctgtgccccgcatgtcacctcccttgtcaggctctgcctccttcagtctctgtcacaattctgtggggttagctatagcatcttcatatttagtactgaaggaactgatgctgagagaggtgatttgtctggtgtttcccaggaaataagtgacatggtgtgggattcagagcaagatattttggctcaaaatcctttgctccttccattttatcaaagtacttctcaaacataatgttttactctgctgatgtgttaattttaaatgttacatgcattctagtgcgaaagattccttaggaaattgttaaaacccaataactccacatagagtttttgaattagggtcttagaaatgttcaaaccaagtaaatgtagggaagatgtattaagtaccaactggttcttgcctgcatgatatcagcaaaatgaaagagaaataataatagattttgttaataattcaagacagtaaagagagaatggtgtgggaaaaagaagacgtttggcgttcaagctgagtctgaatactgccttgttgcttaacagcagcgtgcccctgggaagaggaaggcaggtaacctttatcaagtacctgtcacgtgctaggtgctttgcatgtcttaatctcatttaattgttataatgagcttcccagataaatatagtatcatacccactttaagatgagaaactagaagttctgagaagataagcattgtgcagctggtgtgtggccagccaggatctgaccctggggtccacactgctccctttctgggtattgtctgaagttattacggtgtggaaataagaccacagagtctgtattaaattcactcatgcacatgtgcgtgtgcacacacacacacacacacatgacttctgctatttattcgaaaattcaggaaaaatacaaagggagcaattatcagctagaaattgggcaacaaccgtgcctcagtcctgaaacatcagttttatgagttgggttttatatttggttataaacccatacttttccaggactggctttgtgattcactggggagagaggcctatgtcttcacaaacaaactttaaaagggcaataataacatatatttgcaaagtgattcaagtatgtgttttaaagagagggagatagtacatgtaactgaggtaggtcaaacatacatttgaaaccgaacatagcctgggtgcagtggctcatgcctgtaatcccagcccttttggaggccgaagcaagaagatcgcttaaggccaggaatttgagaccagcctgggcaacacagtgagacccccatctctacaaaaataaaaattaaaaaaagaaaccaagtgcaaatatatgtcatcagaacaagaagaatcatagtaaacagctgtaacttctacaacttaaagagactcatctctgcttttgaaaagaagtagagtcacaatattcatccaagagaaagaaacctctttattaaaatggatgtggtgagaattacatgagatgacataggtgaggtgccctgtccagcacctgctctgtggggaattcttgctaaatggtagcaccagtgaattctgttgtcattgctattatttgagtctaagttgtgagggtgtgaaggacatggcaggctccaggttgtttgtgttctcttgtgtgggtgaccttaaggacagaagtgaggcaccaggaggaggtgtctcggcctctggctggttcctctgtgttcctaagtccagggcattcatcttgtgaccaggagctgctgttgcctttagccaggctcccaccaagcccctgtctgtggctgattgtcaggtcctaaggtctgtttgacaggcgtggcccttcagacgtgactgctagtggccagttttgtcctgggctgttcctactgctcccctccctgctctcctaggagacccctgatctgtatctattgtagctgctgggcagctgcctctcactaaagatcttatgaaaactctaggtcaatggcaaaaaaccaatgttattagtaatactgaggcctggtaggaattaaaaggcagtcttgtaacttataggtggagaatttcagaatttgcaacctttgctacctttcctctagtctgtttcagggctccacaaggcacacactgagaatgctgggcatttggatgatggcttctccttggtccttttttgtagcaccaagtaatcccattagattgctcctattgtgtccagcttttatcccttggctaagagccagccttactgataaataaaatctagataattcagttcttcaaattataatgctaaacctagtggaaaaaaagagacaaggcctctgaacaagatattaaaggggacctttccttctgcatgcttttggttatatgagggattggaggggccaacttcaggacagaatctgaggtcataccagaagcttctctgattgcagtaggcttggactgagactttgcctcacaccaggaatggatgatgtcatgtggccagtgaaatctgagattttttaatggagccctggcatcacaactatgtggggatgagttctgctggttaaaacatttctgtgccccctcagacaatttgcattgtaagaaggacttctggtcttagagaagctggcagagtggcagtggatttcttttggcacagaaatcctgggaaacatggccagagttgttgagaaaagtaatccagttatcctcatttctggtagtcccaggctgcactgtcacctacaaacccagcccttctcttccacctagtaaagatgggaacagccaaggtgtcagccctttcccaccttcatgcatgctcatgttcccatttaatgcccctggtgtattttgcatcccaactagaatcactgttgaaattcattctgtgcttcctaggaactagccagctgtggatggagtaagaaggagaaacacagtcttgcccctaacgttgtggcctttacccggaggtttaaccaggtaagcaacaccccttgcatgtgcctatccagagagcaatctgctgctgtcccctgtaggctgcgagcccccacccaaagctgtctcccaggctcccagctggccccagatccagcttctcatatgagtcccccacctttatccagttttgtgccattatagtccattttcacagagcaggtggaactgaacatacctttcctatgcttaaatcacttcagtgacttccagtttcacttaagctaaggttcaagtaccttaatatgctttgcaaggttcagcatggtggatctcgcttctgtccactcctccagcctcatctcttttccctcctcctggccttccttctcttactgatataccttatctctctcctgtcaggccccatgtgtgtggtcttcacagcccagaatccttcctccctgttcaacttccagtcagatctcagcctaaatgtcatttctttggggagtcttccctgaatccccagcctgtgtgaggtcacatatccccacattgtaccctgtgctccctgtgatcctttactaatttgtcctcatgttgtataactctgtagtctccaccttccttgccggcctgggagccccataagcatgtctatcttgttcattactgtgtcccccaccaccttgcccaatgtcaggcatatcatagaccctcattaacaatatatggaacgaatagatgaggtgctcaggaagtaccttttaaattgaattttcttgaattcctgatggcctgatccctggccttgcactactttaaactgacttggtccaacaagaacctgtgctccaggtatgaagatctggaatgatgattggagacttggatcaactgagggaggtagggtgtcttatttctcagccagacctgcgtgatcttcaggagaaagcatgcaaacccccaaattgtactgttgtactgttgacagatttccttcattcttatttttctggtttcaaatgaggccagtagcctagaggttgcgtagtatgtatgactggccctctgggtgatggggcctggattccctttgggccctctctccagctgggccttctctctcggaaatgcttggtcttgtgcatcactgttgctcaaccctctccaggcttctccagccttgaccttccaccccaagtccagcgggatcctcagaaaggcaccagcttgtagtttgaagattgaggctcgaattagcattattattatttgatgagatatagtaggaaccaagaaagacctaggtgcatctggagtaggggctgcacactgtttgttttgaaaagagaagttccaaagtcttttgcttcttttttctttgttttgaaaaatcgtctcttttcaactgagcttagtctttaattaaaaaaaaaaagtgtgagaattttgtcagggaattcatagtttccttaacaaaactatttgactgggagccaactcagtccccacctctgaccagccacagagctcccagaggagggtctgctggggctctgatgtaatctgctttgcatgtggatgccaggtcaacttggcaaaggcgatgtggcttattctgtgaacaattgtgttgtgtccagctcagaccaagtgatgaaatgagccagaagcaaagtcacattttttttcaaacagtgctctgggaaatggtcttcctgctggcccatcagccagtcggagagccagcagcttctggacatagccctggtagctctggtttgaaaattggccagaggccaggcctggtcagccattggagctgccttctttgggatgaactcgttggcgtcccttcctggcagaattttatgtgtgagaacaagactcatcagactccaaataaaagaaagcaggtcacttacctgtctgagcctcagctttcttttctgtaactgagaataatagtagtgctctccttgcactgttgttatgaagaacaaatggaatatgaagagctttagcacaatgtctggcatgtagtaagcatccaaatgttttgggagaagaaaagagaaatgtgaagatcagctgattgggaggaggttgccagaggatttgaggcttcttgtggccaaacagaaacccagtggctagtgcttgcctgcttctccgtgggatccgagtcccttgggatttgctcatagagtggctgagatggaagagtttggccaagttcactaaaggtcttttatgagccagcctatgttacaaccccaaggaataccctgtgtagcacagaagttctcaatcttttttgggtcttgggttcttttgagaatctgacagtatcacatatgaatgttcctccagaaaactgcagagatatacaaatttgcatttaattttagggtgttcactgccttccggaagtttatgtgtggacatttatgggtctgcggacaatagactgagaagctgtgtctcagggaatcccacaggcctgggtgtgagtcttatcgcaacaacttattagctgtatgatcttgggttggcttttggcctctctcagcctggtagtcctcatttataaaacaggaagaatcattttaagtggtttttgaagactaaacaagaatcatgaatataaacgggtcaccccagtgcttgacacttagtaaacattccatgtaagcttaaacaaaggggcagagtagtaggagctatgagctgaaaggaaggttaagaccagaccaacaggcttgggcatatgtgcaaggttggccttgtatcacaaagatgctgaaaattttggaaaaggtgaagagggaattgggagaaacgtggttctagtctaggccgtgctgctaacctgctttaaggcccctcctctctttgggtctcaggacctttttccattcatggagattggacagggccaaatgtttccaacttgtctcatggacacattttatagttgctaatgactgaaaccccagctcaaactcagttaagcacaaaagagagcttcatggtttatgtataataactaaatctagggagatactgacttcaaatattgctgaatctaggcagtggggacagtaccatctgaacttggtcttgctctctccacctccaggttctgctttcctctgagctggttctacctcaggtagcctccccctgtggttgcaggatggctagcaacaattccaggcttgtatcatattccgagggcaacctcaggagaaaagacctgctgctttttcagtagctctatctgatgccctggaattgagactcagtggctcagattgccctggcttgtggcctatcttgtttgttatgatctaatcactgtgaccaggaagacatgaagctctgattggccaggtcttggaaacaggccttcctatggaggagaggcggtaggcctaggccacatggactgagaatggagaaggggtatttcctcaaggaaaatcagggtgttctggaaggaagaagctatggatgagggccagaaaggaagacagatagttatcatagaccttcttttctcttgtactcttccagtctgctctgaactttctccccaatccattctgttgataccttgtcactctcaagtcctgtctgccctctgaactcccatgctcatgagcctagtgactgaatgtttctgcttcctcttggctttaattgaaactattttaaaaacatttattgagcattaatgctgaacttattgaatcagatactatgctaagcattttacccgtgctatctaattcaattttcacgtgcctaatgagatagatattttacactcatttcatggataaagaaactgaggctctgcaaagtgaaacaacttgctcaaatttacatagctggtgaattcctctgcttaaggggccttctgtttttttctgaacacttttctaatagaaacttctgcttttccaaacctaatttatcacagggctgggagacaatgttagcattctcctttcttccacatgctatctctaaacagttactctttcctcattgtgtaatactcccttttatatgacgctcatcactctagttctattcatttatgtattcagtagtcattgactgaatatgtactaggctctgtgctggttcagggggtcaacaataaacaaattgtcgcctttgccattgtcagctcatagtcgagtgtaggaggcaaacatgatggaggcgattccagtccaggggaatctgtgctaggacggggaaaccagaggaaaggcatgtgcaggagcaagggaggccagagtggggtctgttccttcaatctgagtgagggattggagctgtaaactggctgggcacaagaaaatattagaagacaaaatgacagcccttggtgattgattggttatggagggaaatgacagagaagagtaaaagagggtcctcttttggtatttgggcagtcccatccttgagacagtgaacacaaaggaggagcagttttgagagttggagatgagttaggtttggacatgtgggatgaagtatgcaggaggtcattggatatttgagtccggaagttggggaaaggtccagcctggagatgcaaatattggagtcacctgcatttgaaggcctggggtcagtgaaatcatccaaggagaaacagaggcccaagtgagtacctgaggattgctgacatttaagggatgggcagaggagaggaggccacacaggaggcagagagagagcaacctgggagcagaacacttggtgatatggaaagggcagtatctggaaatcagtgtttcagaaatgagggaatgctacagaatgagtcttctaagacagggctaaaaaagagtcctttgattttagcagcaaggacagttttgcagggatgtagcaggttgagtggtagatgtgaggcaatgaagagagcaggtgtaagtgattcttacaacactggctccaaggggagctgagaagggagtggctggagagtggaggagtcaaaaaagtcctgggaggtggttgcatgcttttttcttctttgaagtgagcagatccttaaggatgtgaaggagccagtggacctggaaaagttaaagatgaggagagggaggaagtacttaatgaggtaaagtctcagaaaaggtggaagaagccaagacctgggtgcctcttcagtgtaagagatgagtcagcagaaaggaaaggggcagatgtagacccatttgtaggtgcaatacaaggagagtgatggcttttcttcgtcagtgaaatgggagggaaagggggaaggagtggggcgagaagattgatgggtttggggaaagcttgaaaaaagctgctacacaggaaaggagagagagctgactctggaaatacagcaagactcttgggcagtgatggtggcccagatgaaatagagattgtgattttctaagtggccccagtgcatgtaggtagtaggtggttttctctagttgcacttctcagcctaggagtaggtgcatggaagagcaaatggttagacccatccccttaggggttggcaaagcagattttttggaagggtcaagatgcaagggaagttaaactagtgtcaaagaaaaggctgaagtaggccgggcatggtggctcaagcctggaatcccagcactttgggaggccaaggcaggtggatcatctgaggtcaggagttcaagaccagcctggcctacatggcaaaatcccatctctactaaaaatacaaaaattagctgggcatggtggtgcacacctgcagtccaagctacttgggaggctgaggcaggagaatcacttgcactcgagggggcggaggttgcagtgagccgagatctcaccactgcactccagcctgggcgacagagtgaaacgctgtctcagaagaaaagaaaaggctgaagtgacaaatgataggggattggtctgcttaagaggaaaaggatgccaaggaaaagggctgccagggaatccaggacatggtgagaggaaaggtctgacacagtgggggtcaaggagagagtaaggactagaatgtttaaagattgtagccccagatggaaccgaaattttctgacatagagcaggtctgggaaatcaagaagaaagaggtggctgaggtggtagggaggtctagttgctaaagttgaagtgctcaagggatctgaggccagggtcatttgcagtgatgttgaagttgcccaaggaagaaggcaggattggtgtggaggggaagatagcaatccagatcctgatctgtttaccatctctaccgtggaatcataaacatgtagccttttcacacggacttttttcacttagcgatatgtagttaacattcatccatgtctttatattactttatatgtcttgacagctcttttgtatgtgtatattccattgtatggatttaccatccatggtttgttcatccattcacttactgaaggacatctcagttacttagttacttccagttttcacaactatgaataaagctgctacaaacatttgtgtgtgtgtgtgtgtgtgtgtgtgtgtgtgtgtatgtactaaagttttctttctttctttctttttttttatccccgaggtggagtcttgctctgttgcccaggctggagtgcagtggcgtgatctcagatcactgcaacctccgcctcctggatttaagcgattctcctacctcagcttctggaatagctaggattacaggtgcatgccaccacacccagctaatttttgtatttttagtagagacggggtttcaccatgttcgccaggttggtctcgaactcctgacctcgtgatctgcctacctcggcctcctgaagtgctgggattccaggcctgagccaccgcactcggctagattttcagatcagctgggtatatacctaggaacacaagctagattgtgtttgtcccattttgtattctcaccagcaatgaatgagtgtgtggcttcaatccttgccagcaactgatattgtcagctattttgtgttttaggcattctagtatgtgtgtagtaatcttgcttttctcagctttatccagaccactcttggacagttacgtctggttctgggtgcctcacgtgaggggtgagggtgggaattatcacacaggagtggcatgtaagtattacagtgactagaagagtaggggaaggaaaacatgttatacagggataggtggaggatctgtgagtgagaagactcagggagaaggtcatcaaggttttcaagcaattgaggagttcttaatggggaagctggattcaacataatctatggggcctggtcaataagtgcagggcccaagggatggaaacggggaggcagttggcctcctcctaatataaggaagtttcttaaccatgaaggctgaggcagagaccagacaagggctttattactgtagaacaccatgcagctgtcagggcagggagtagatgggacctctaagatgctttcaaactcttggtttctaagaaaactgtgaatggacttaggagaaatttgtggcaaaagtagatttttcataagaaatagtagtatttttaaacctggatttttcttgttgtttttctttgttttattctttgattgtttttttcatggttggttaactgaataaagttgtgtccataactattctgtttttttataattccgccgtggcatgtcccagatatcatagtcctcagtagctaaatgccagtgctagctataccactataacaataatagtgttaataataggttatgtgtattaaaagtttattagcaccatgacccactggggttatgctccgggtgtgtttggctccttcagcaattggaaatcaattaatgtaatccactgtacaataggctagggtagaaaaatcatattattatatcatttgacctgaaaaagcatctcacaaagtccagtactcattcataattaaaaaaaaaatctcagccaattaggaatagaacagaacttcttcaacttgataaagaacatctacaaaagtccttcagccaacatcatacataatggtaagacactgaatactttccccctaagactgggaacaaggcaaggatgtgctctcttatccgttctgtacaacatcttactgcaagtcctggctagtacagtaagacaagaaaataaataaataaaatgtatacagattggaaaggaagaagtaaaacaacctttatacataggtgacgtgattatctagatagaaaattccaaagaaatctccaaaaatactcctggaactaagaagtgagtaagcagagttgcaggacacaggccagtatacaagagtcaattgatttcctctagaccagcaatgaggaactgcaatttgaagttaacaaacaataccatttacaatatcaccaagaaaaccataaaacttagatatacctctaacaaaatatgtacaggttctgttaatatggaaacctcaaaaactgataaaagaaatcaaagtggagctaaataaatagagaaatactccatcttcatggaatggaagactcaatactgttaagatgtcagttcttcccaacttgatcaatagatccagtgcaatcccaatcaaaatcctagaaagctgttttacaaatatcaacacaatactgaaaaagaataaaattggaagactcactctacctgatttcagcacttactgtaaagctacagttatcaagacagcatggtattggcgaaagaattggccccataggtcgatggagctgataaatagacctacacaaatatggtcagctgatctttgataaaggtacaagggcattcagcggagaaaggacaagtggtgctggaagaatttaaatatttgtgtgtatatgcaaaaaaaaaaaaaaatgaacctagacacagaccttagacctttcctaaaaattaattgaaaatggatcataggcctaaaggtaaaagacaaaactataaaacttttaggagaaaacgtagaagaaaacctgtatgaccttggatttgttaatgagttatcagataaaacaccaaaagcagaattcatgaaagaaaaaataagttggaactttatgaaaattaaatttttttcactctgcaaaacacatggtaaagagaattaaaagacttaccacagattgggagaaaatatttgcaaaacacatatatgataaaggagttgtatccaaaatttactcttgaaactcaacaataagaaaatagcccaattaaaaaatgggcaaaagatctgaagaaagctcaccaaagaagatatgcagatggcaaataaacatatgacaagatgctcaacattatttgtcattagggaaacacaaaacactacatacctattagaatgtctacataaaacaaacaaaaaaccctgataacaccaattgccgtcaaagatctgaagcaacacaaactcttattcattgctggtgggaatgtgaaatgagacactcaatccagcaattgcaatcctaggtatttacctagctgatctgaaaacttatatccacacacaaaaaacagcacacaaatgtttatagcagctttattcatagttgttgaaaatcagaagtaaccaagatatcatccttcattaggtaaggtaaatggataataaaccatggtaaatccatacagtggaatagcattcttccaaaaaagggagaatgagctatcaagtcatataaagacatggatgaatctttttttttttctttttttgagacagagtttcactcttgttgcccaggctggagtgcagtggcgtgatctcagctcactgcatcctccgcctcctgggttcaagcaattctcctgccccagcctcctgagtagctgggattacaggcatacgccaccatacctggctaattttgtatttttagtagggatggggtttctccatgttgctcaggctggtctggaactcctgacctcaggtgatctgccctcctcggcctcccaaagtgttgggattacaggcatgagtcacagtgcccggcccgaatcttttttttaaaaaaataatttcatgttttattttaaattcagggtacctgtgcaggtttgttacatgagtatattgcatgatgctgaggttttggagtatgaatgatcttgtcacccaggtagtgagcatagtacccaataataggtagtttctcagcctttgccacactctctctccttcctctaatagtccccagtgtgtgttgttcccatctttatgttgtggatgaatcttaagtgcatattgccaagtgaaaaaagccagtcttgaaaggttgcatatggaggatgccttttctcttttcttcctcctcctgaatcattattgttggtttattacaaagcaaagaaaatgttcttgctagcataaatcaagttatcaacatgattatacttctacatttatatttccttttttgacattctggaaaaggtaaagctatagagatgataaacaaatcagtgtttgtcagggctttggaaaggggagagggctgaataggtgaagcctgggtttttatttatttatttttttaaggcagtgaaactatatgatattgtcatgttggatacatgacacagtgcatttgtgaactttatagcaccaagaggaaaccttaatatatgcaaatttttaaaattcaacttgagggatcagtgtaacactttgttacattttgttacgtataatattacaaaatgttatagcagaatgtaataaaagaatctattataaatgtatgaacaacctcactgaggacagggagagaaaactttgctgacctaagtaaatttgtaatagagtggagcctataaggctaaagacaaaggaactgtatataaacaccatactccatttgataaagttgtttcccaagggggatgggtaacaattctgaaaccattatccctgtgtactggaatcaaacaatataagaaatagatgaatataagagagtataatgaaatggatggcagatggtgggaaccaagtttctcactgttggagtgggaaattacagataagccaggtgtgaggaggctagaacgacccacgtggtaatggattacggttggagacatcagtatgaactcatgtttagcttaatacagatatagatggttacatatagaaatctttacagatatgtgtataggcatgggttagtacacacacacacacacacacacacacacacatacacacacacacacacacacacacacacacacacaatttcttggctctgccagctgagaggacctagaaacgatgataccccagtagcagcaagcatacttcatacctgttttgtgctaatcttggtttctaatactgttatttgataaaaggaaccagcgttccttggagaaatgactaattttaagactaaggcaagaaatataaaagatgagcctgttgcatattgtattgccagaaggtaaggaagtgctcaaactaacaaaccaaaacaatacaggggttgtgtcaaagggatgcaggagccaactgaaagaactctcaaaggccaaagctggaacaatttgagcagcatataaataatagtattggattgtaacccaaagtataaaataaatatccacaaatctatactgatataaataaatgtggaagaatcgacaaatctctcatgcagaaaatttcaaataatctatgtagattagatctcaagaaggtagaatgtaacttcccacttgttaaatattggctgagcttagtgacttccttgcagagtttgaagtggtagtgtaaattgtgtaaccaattccctatcaatgggcttttaaaaattgtagatagtgcttcaatgaaaccttgtgtatctgtgtttctatatttctgtatttttgtaaggtaaatattctagggagactataccttaaacatcttgaaagatatgttcaagttgttcttcaaaatgttattgatttcgattcctccaaacaatgtataagagtaccaatgtctacatgctcttggtacaatatatgactcacaacatgtatttttatttgatatacaaagagcttttatcaatcaataataagagaaaacctgctttggtgacatagtgagaccccatccatacaaaaaaaaaaaaaaaaaaaaagccaggtgtggtgatgcatgcctgtagtttcagctacttgacaggctgaggtgggaggatactcaagcccaggagtttgaggttggaaggacagatgtcccagtagaaagatagttcttcacaaggacctgtgcaggcagttcagaaggcaaataatacaaatgacctataaatatttggaacaaaaaaagttaactgaaaaaaagcaaaacaaacaaacaaaaaacacctgaatagtcatgaaagaaatgtgaaattgaaactgtgaaataccatttttttccatcgaattagttaaaaaaaaaaaaactgatagtaactggtattggcctgtgtatggcaacatggatctgcttcaacttgttgatgggtaaacaaatagaccttttggaggccactttttttacatatacttttgaaaacaggtacacacgcttttattcactccactttacatgaatttatctgaggaccttaataaaaagtgtacaaacatatgtataaagatgttcatctcagcattattacaacaaaattagaaataacctattcaacagtagagggttatttaagaaaatgatgatacttctctatgatgaaatacttggaagctgctaaaaattgtagaagaatattcacttataaaaatcttgtgatatatgattaatatacaccaatttagttttaagagacaaacatgttctatatagagaaaaaaaagatggccgggcatggtggctcatgcctgtaatcccagcactttgggaggccgaggcaggtggatcacctgaggtcaggagttcgagatcagcctggccaatacggtgaaaccccatctctactaaaaatacaaaaattagccaggtgtggtggtgcatgcctgtaatcccagctactaaggaggctgaggcaggagaatcgcttgatcccaggtggcggaggttgcagtgagcagagatcgtgccactgcactccagcctcggtgacagagcgagacgccctctcaaaaaaaaaaaaaaaggaaaaaaagactagaaggatgcataccacagtgtttatgatgttggtctatatgtgagactgagatttgtctttttgtacttatctcttacgacttacttttgtacttatctcttattccttgttttcttcatcaaacttctgaagttaaaaacttaagttttgtagttagaaaagaaaataaaataaaaaagtgtttacaactatgctgattctacctttgtaatgtcttccttatctccctcttcttcccatgtccttcagcatggcactggctcagacctcctcatctctcactgagaccattgcatcagttttctaatgggtgtctctatccttgcaaaggatctcatctatcaccctgctcagaagcctctgaaagtccctgtgtagcatagtgttttagctccttcctctcaccttgttgcaccagtcctcccctcctcaccacacacccaatctggtctttttctccctccccaccctcatcgtcactcacaacccccacccacagcactcctgcaacaccagtgctttcagcctatccagccgtccctggtcatggaacatatggccacacttcagtcttctcttgtttaaagtctacccatctttcaaggcctatcttcttcgagaagccttcctctgtcattacctctctcatactttggtttactgtttgaacttcttccatggccactattaccagctgccttctaatacagcgattccttaaggattctgcctcctcctttggtcacctcaatttcaggaaggtctgggctcccagtgcctggagcccacacaccgaaggggcttcatggaactctgctgaatcgagttgttgactcagagttgcctctgcacaacatggactgcagttccagagtcaatgcttccatgttccgtaatatgccataaacgtgtgattctttgacatgcaggaatctactaaattgtacatgtaaactatcacacttgagtgtgataatatgccataaaaatgtacacatattaaaatataaggtttatgggcatcccatttggtatttagaaaaacttttttctgtaactggctagtaaatatttgagtctgagcttaattgtgggcaattccttggaaaaaaatgattctatggaaacccagtcatgtcctggaggcaaccacagataattacactgagaaaacatttctataatactcctgcttaatataaaaagcacattgttgattcttggtttctctttctttgctttctatttgaaaagtgatggtatttcaataacgagaatacattttattgcagcagtaagcttgttttattagctctggaatatccttaactatatttttccctataaagtttaggggttttagatgccttgccttctttttaattctccctatgccccgtgctttgcctggctctccacctttctttgcagtgctgtcattgcactcttgggcatccgtgtttcacatagaactgttgttacagaagtgaaacataaacaggaagagctagccacttcccagcatttcttggcatgagtctcttccgttgcattgaggtgccatgtgagtcagctccactctggtagatgactttcctgttccaccatcagacacaggggttcaggctgttgcagtatgtgagaggtcaagcatgaatgggcttctgaaccaaagctaccatcataccctttttggtgcatgctgtctccgggaaaacatgccctgtaacatgcattgctttatggaactttgaaagagatacttccatatcatttacattatgggatgggcctctcccaaaaaattaaatttgttaaaattgtgcaaatattgatgaatcctccttatcttagggctggctggggatatggacctcacaagtgttcctaccaatatacatgtccctttggctctttgtccatctgtccctccatccacccatcatctatgatctccccacaactgggatccttctgagcaggaattcagtctgattcatctcaggattcccagcaactcttctcgagactcgtgtcacggaggcccagcgctccctgggatgacgaggaaagtgctgctttctcttggcactgcagtgtgcactggagacagggtgctgagaacacggcccatttgcagggttgggtgctgtagaggaactctttaactcatgtgaccccaggctatcctctcccagtttcctgacctcttggaaatcccataacagcggtgggcaagggggacacgggtggtccagcaattaacaacttttctggtgtgtatgtgtgtatgtgtgtgtatttgactctacaggtcagtttttgggttgtacgagaaattctaacagcacagactttaaaaataagggcagaaatcctcagccattttgtgaaaatagccaaggtaagctttttattattatttttccttcctttccctcttctctcccacacctcctccccaaaaatatgtttcctcagtactttgggagctgctttgctgtgggcctgccaggcacagttcaaacagggtgctgtggcttgacttccctaggcagagccagctgttagacctgcctgggtgctcactagccccctagcaccttgtgcgcaaattggcagcgtgccccacaccctataattttagtggccagccattctccttacctgggctttcacagtctctccgcaaggcaggacccagaggctgcccctggaatccattcattctcctactttagatttagccagttctgggggttgatggattttagttagcatcaatgctcaatgcttgtgatatcattacatcctgcacaatattgtcagcagtcagcacaccccacccacctcccactgagcttcaggtctgggccagatgactctgcagccccccatccccacctcctgcccccggcctgataggttctgtccttgttgggaatcaccttttcccttcttttcccttatctctaggaatgctatgccatcccgtgggccatcctggagtactgtcacgcccagtagctcctccccatacactggtttcaaccacccaggcttgcctgactctcagccgcagcatcgtgctggctgtttcgctgcttgcttcatgtgtgcatgtgttgtcttcccacccaggtcctaggaaagctgccctttacgagccaggcaccatgctgtggtcacctgctttactgacctcatcatattcagtgctcacatgattattattccatttgcagaggaaggagaacttagagaggtgaagtgtccatgctcagggccccatagccagtcagtggtgggcaggaatcggagtcgtgcctctctgccttcagggaagctgctctactggccctcatgggcgggttaagtgcatcatctatttatgttaagagcaatggccacatttacttcctatgcattctcctgaagtacttggaactggtgctgggcttaatgatatttgttgctgtcaatcagttctgttctgggccacaagagaaagtaggatgtggttccattcctcctgggctgtcagtttggaaatgtgtttatggtgcccacccatggaattcaaaatgatccctccttaatctctgccattttctgtgtggcagactgtcatgctggctctgtgccctgggtctttccttgtgcaagccccttcctttctctgggccttggttttcccatctataaaatgaaaggggtgggttagataatttccagagctgtgggttagataatttccagagccctttcagctctaaaaagaagttctgtgacaggcataacaatgcagatacatagaatgaaattcagttcacttagagaatctattcttacacacaggaaacaattagagaatgttacgagatgtatgaaatgaagtatttagctcatgtggtgagagagaaatttccaagtaggaacagagttgtgaggactaagtataagggcttttcctttctttatgcatttcactaggccctacaatgtgctgggcactgtactgggtaccagagacaccatggtagacaaaactttgtccctgctctcgggaaacacacagtccagggtgagagagaggcaagtaaaaagcaagtacaatccagtgtgctacagatatgcatggacttctgtggggacacagtcaggaaagacatattagaggaaggggcaactgagcttggaaatacttaagtgacaggggtgggcaaagacaaggctgagactcatattgtactgagctcctgccctgggaccagccactggtctaggcagttgatatgtactgtctcatgtagcagaagtgccgtgattgccttctgcactttaaggatgaggacatcaaggctcagaaggattaggacacacaagtagtgggagctgggattggaaccaggtcttttgattccatagagcgtgcctaataacccaaacttcattgactcccaagaaagagaaatggcacccccgtcctgttagcaggtttctcttagcataaaaccaggaacagagcagtcgcatttttctgcacttacactcgactgtgtctcattctgtttccctccatggtaagaaacttgtctgagactgaattgaatccaaatgttctcactaatttggggtctggttcaaaggaacatggtcaagtgatggggaagcccgagcattgccttcccagctgagagggattatgcagattggtaccatctttccttggcctctgtctccttctggtgttaagataatcatagaagacccacattgatgctgttggcacagtcggggttttagtttacaaaagcctgctgggacagtattcagatttgtctaaagaaagaacgtaatgcacactatcaaaccttaccccgtgccacgtttctgtccagactagtcagactcacgttttagatgcagactcaccttttgacaatttaagaggaaaaaagcatatggtttctatgaaatccttagaactatgttttccacatgagatatttttaagtgtaattgaatttcataaatatgacatttggtaacacttgagcatgtttttgttctgttgtttatagcagcaaaataatctattccatatctttttttcagaaacttctagaactcaacaaccttcattctctcatgtctgtggtatcagcattacaaagtgctcccatcttcaggctgacaaaaacctgggctgtaagttaatctccctaagtctatctaattttggctatcatttcattggtgaagttcttcattccacaagccccagcctttctcttactgtctatactttgccaacaacagagttactatgagttgatgacagttctgtaggcatcctcactccgtcagtgaccccagccccattttggcaccagggaatggtgaaggtgctgacgtggctggggtcagaagcccccagagtggatcttcctggacaccacgatgtcatgagtgatgaccgggtcagcggcatgacttctgccctccacttggctggaatttttctctggcaggctccaaactgtccttgggaaggtctctgggctgatggttcgcagctgccctgggtcactagccataccgctaagtttctctggagaaacctgtgacccccgtgtaggaaaaaacggatttttttcctaaggccctggataatttcagctcagaggtggagtctgatagttacataattgagtctgtaggaaagtttttctgctgtaaaaatactttaaaaatatctcagacctctttatgctccttcgcttggcatagtgcctgacatgggggaagtaattgctatttccatagctcattagcattcacctcctggcctgcctgatctggggtctctcacagccacacagcgcaagccttttaagacctgtttatatcccacggaactgacaaaaactgtatggaattgtcagatgtgcttctgcaactcatttccgaactgctttctgccagtctgtggggctgggctctgtttcctacttggctggttcaagggcttttaaaatactcagggattatgttgtaggtgatcgaaaatgagccttgtttctttaaattgctgtttccatagatctagtcctcgcaaagtagagtgagaagttttagcccagtgtcagaaaactgggtttgcattcaggtgccattcagagcatgacttctgtgcgacttattttctcatatcaactcggggaggttggcctagattcttggttttccatcagtgcttcgtggagtcccaggggttccttagagttgccttgggtgccgccaggggctgagagagtggagagatgctgccaagcaggcagtttgggcactatttccaccagagcagctctgtttgtatcagttttatgtactggacttctgggtgaatttcaactgagcaatggctttggaggtcgaaagcaagtttggaagccaccggtcttagcagttgctgccagccctgtgattccaagtccatctgaccagtgaggctttttttcaaaagttgcttggagattctttttcaaatgaattttccatcacttagatgctgttattgttttttggactgccgggagctatgtgaggacccagcaggatgatttttgaatcttctcatgatgcctagactttactgtcagtaatattgtaactctcaacaatccctataagctgtacagttggtggaggcagagatagttaatacagagggctgggtgtctaagggtcttgcgcagagatacggtccactcagtgatagggccaggcccatggatgaagcgatggtgtcctccaggggatgctgtgtactgccaggacagtgggcagcagcaggtcacagcagtatccaggaccactctgtttggcttgacaggccctactcaaggtggctgggtcttcactcctgttgatggttctttgctgtaatgaaaataaacctccaggccaggtgcagtgactcactcctgtaatcccagtactttgggaagctgggggtgggaggatcgcttaaggccaggagtttgagaccagcctagacaacatagcaagacctcatctctgcaaatattcacaaaattagctgggcatggtaatgtgcacctgtgtcacagctacgcaggagactgaggcaggaaggtcccttgagcccaggaattcaaggcagcagtgaactatgattatgccactgccctccaggttgggtgacaaagaccccatctctgaaaaagagagagagattgattgagagagagagagagagagagagagagagagagagagagagagaagaaatctccttggggagcctggaatggaatttgcacccaggacccattcaaaggtgtgggcatattcacctagctcccttccaggccatctgggttgtgttcttcctcacacatatgccaagataaaagcatgtggcaggcactgccctaaatgctttttctatctatctatctgtctgtctgtctgtctgtctgtctgacaaggtctcactctgtcacccagctggagtgcagtggcctgaacacagctcactgtagcctcagcctcttgggctcaagcaatcctcccacctcagcctcctgagtagttgggactacaggccataccaccacatccaactaatttttaagttttctgtagagatggtgccttgctatgttgcccaggctggtctcaaacttctgggctcaagcagtcctcctgcttcagcctcccaaactgttaggattacaggtgtcagcttttatacctggcccctaaacactttacatatattaaccattttgttctgacagctacccattgagataggcactgttactattgtcatttatagatgaggaaacagacacagaaaggtagagtggtttatgcagggtcccacagctaagtggcagggctaggatcaaacctaagcagcctggctccagaatccatgctcttaaccaccataccccactgaacaaaaaagacaattccagcttactccctgtcagccaaaacaagagaggggtcttatttttttatttttgtttttgttttcccttttgtaacataagtattgcattaggaacttgaaaataaggttggtagactaccagtgcctcccaggcctttgggtctctgtcttgggtgtggctgctgctggcctggcacctggttgctggagtgcagcagaaagagcagtcagaggagggcctgtcagggaggggatgtgcagccaatgagccagagagctgcagcaggactttgaaggctgccctgcaaatgccttctggccactgattccttggattgattgtttataccatggcttctgttgctcctctacttccctgggttggctcctgtctttgcacctcagttggcatttagctggtggggaagaggaagatgccagggaactaagattacatgtcaccttgctggggactcagggaaacaacatgtccctgttcctattctgagaaacctccctattgtgtcctaagggctgagccagggctctttccctggttacagagagccacttaccagagcaaaaggtgggtagatgcagcatcccaggaaataagaatggcaactgccacagtattgtgtcagggagagaggaggtgatacacactgtgtggattacagcatgaggtctccaaggtcacttgtggggtagctgcttgttcttggtgaacccactattcagcctttgttttagatcagactctcccctctcactcactcacatgtcttgttaatccaaggactacatttggcatagaacatttaggaaacagagggggccaaactcatcatctttttctttcatccaaatcacccccagccccagtggaatggcagactccactgtctgtattcttgatgcacctgtctggtaacagcacgcagggtggagcatgcaccgactctgcagttttgtttataggtctgcctcccccttttgactgcattcctcatcgatgatgttgatttttctctgtatccttggtgcccagccactatacatttgttgtttgaattgtatgtgttgtcctgagttgcattgcatccttcttttgctgttaatttctggtatgagatggccatagaaatgttgcccaaagagagctgtttcctctctgctcacttgtcctttgagttgggactggggagacctcatgtgccacagagtagggaggtgcaggtggcattggaagaaccagccataacatccccaaaggtcagtgctatgatagtttttgttttgtagaggaggaaactgaggtttgaagagatagaatgacttgttcaagatccagagctggtgagtgacagaaccagcatgacacagccttgtcctgctggaatccacagtccgtcttcttggcgggtatgctggatggcttgctaatggcaagaacctgtgagagaatcaggctgggcacagggcagggacaaatagacacctacactgcttgggaaatggggctagagaaatgcagctagcacacagggcctggggacagggcaggccagctctctgtgccatccctgtgggttgcactgaaagcctgaatatctgggaaacctggtggaagggagttacaggtgtgggaggatacctgccacttggctgcatcacggatgacttccagagaattggccattaagctagggcagggcgtcctgttggcctctccatgggtggctgctaagtgctagctgctgggtgagctgcacaggaccgactgacactgaacataggcctgtacacagtaggcccttaataaatgccatctgcatacacaaacaggaagactaccatagctggcctggaaaaatgcagatgggtaatgatttatcccagcactgggaccactttggaatattggctcccttaaagccatgaaacctaagcaagaagttgtagcagccatttctgatttcctgagtacacatcaccgtgtggctgttattcattctgcaaatcaaacatttctcaaatgtcaggccctgaagccatagtcaaggcccctgtcctcatgggctttcatgttggggagaataaacatgtgcctagtctggctggcacaagaagtgatcaataaatgtttattgaatacatgaagtgatcagcaaagagctgtcaaattggaagaaaagcgatgcagaatacatgacagagaatgactgagtgtctgctttagtgtggtgttagagaaggccttgcttccctagtgtcatgctaaagtacaggcctaacgtagattcaggccatgtactttcagtcaaggcctgaatgacaaaaaagaaccagtcgtgccaagatgaggggatgagtgttccaggcagaggagatggctggtgcaaagccctgcacaggaatcagcttgctgtgagcaaggaactcagaggtcagtgtggccagagctcagcgtgccaggaggagatggatgtgagaggcagtgactgggcagcggggccaatcatgtagggctcaaagcctgagagaggagttagattctattccaagtgcactgaaggattttaaacaggaggcggacacaatctggcttccagttgctctttggtttttgtgtttttaattactgttgctactgtgtggaaaacaaactgggtgggggatggggaccaagagtggaaactgggggcctactcagcaggttagggcagaattcaggagcaaggggatgttggcaggatcagggtatggctggggatatgagaacagcaggctgatatcggatatgttggggagagctgacagattgtgtgctggatgagatgtcgagatgaagagaagagaatgaggggtgagtcctaggttttgggcctgagcaactgagaagctaatgaaaccttttctttgattagagtgatctcaagaggagactgactgctttgtgagtgatctaagggtatggaattcctagcatatggatgagtcactcattatagtaattacagtcaggtgctagacatgccacgtgtgcgcatgtacataaacacacacataccccacacgtgtgcacacatacgtacattctcttcttgctctgtgcatgttcccagagtgatttgctctttcctactgaattgatccaaagagtttgactcatttgcagcagcattgtgaaaattgaaattcttggcaggcaggaaatcatagctgatgggtcaggagacctggtctggagggtggtgacctgggaggggaactatcctgggagtggggctcttactcctagatatctggggacacagtcattgagctctgcaattcagagaattgctccttgtaccaaaagaactaaggccactttgcaaatatcacaggacggcagatgtatgacattcagatactttggagttcaaagtctttcatccaggaagtgccctttgccccctttgactgatgcagtgcctcagtagccaccctctgatgttgttgagaaggtggtgataggcctgagctgctttttggaggcatttctgagcatttggtcaggtgggaggtgagtcagatgaggcgataaggagatagatgcagaggaaaccaacatttgtagccctcactcacacatcctcatcattcctcatagcctggcttggaactgcttctcagaagatctcagtcaaatctgctgacatttgcaccctcatcttccttgacattgctacaacaatggacactgttcataactcccttcttgaaaaatctcttttcccttggcttaattttcttcctcttgacttcttttgttgctatggatgtggatgttctgcaaggctgtgacctctccaccttccctgatccatttgctatcccttggtggtctcatctgcttggggagcttcaagtgtcacctcctgtaccccagtgatggctggcttttcagttatagccctgatctctctcctgcaccctagaaccctgttccagctgtctgctgcatagatccctctgcttgcatgttcctttgacagctcacacttggcatgtctgaaatcaaactttggtttccaggaagatgatggtgagtgccagaagactctcttaacagactgtgttttaggctcttaggcagtatggtagactgagaaataagcctctccctcccagtctcctgcttcaaacacacaaacacaagttctggataaaatacaaccaaattaaaaaaccaacaagcaaagctaaattagaagccaagaaagggaagtcaccatgtgttaaaaataaagtgctctcagagtcaaaacagtgagcagagttcagagaaactgctgtgtataagcctttgcagctgggagctagggttgtaatgcctgcacagagaggagagtccggctgcccacacatggggggctgtaattcagctacccgtagaaatcagagagacacgtcaggtattgctgcatcaaaaagtccctctccagcctaggagagccccaagggagcatgagtggaaaaactcatctgtgagaaattgtcaccctagcctgaacctcatgcagcgaagggatctgaatacatgttacatatgacctgcatttgtgtggggacctcagaccaagaaatgaggggcatggagattgagagcatagcctcttaaatcagacacctgggttgagccctgggcttacctcttacaatgaggattaaatgagtaaatacatgaaaaaatgtttagaactatgcctgactcatattgaggggttggtaagtattacctgttgttgttgttgttgttgttgttgttgttgttattaatattttcaactcttcttgactattctcgaatgggttggcagaggcttccatccttgtatgacagggccttttacttatggcctgaactgtcatcctctttcagctggtcccattgctttgggacttgctgtctctgggccaccctcacaccgttactggagtgatctctccaaaacataccttcaaggttttcacatccctggttaaagatagtttttagtgttctccctcaacccctcgtccaccttgctaggatgggggctgtgtgccatcgctccttcagagcagcattgtgctcagatacaaccattccgacaccagtttttctttttgatctgccatttgagcatttatttcaccttcagttttatgataataatattttgtcagccagtctttaaccatcatgtggatttccaaccctgtatttcagtgatgcctctgagtgaaggaaagagactgagctagaatgagagagagaattggtctgtcctcgtgagtgtttctgagagagacttgcatctagggatgtggcacatgatgaaagctggtggctgctgagtgtcttgcagagtgctgaggacataatagacgcattttgacattggcagcaaacaccagaagatttcatacctacttcctgaccctaaaaaacaaaccatacacctttcagctgtggccagcagtgcatctgctaccaccagcagcacagcaactcagagccccaagtcatgtgtgcaagagatgctagagttggcctgaggaattttctgttaaaacatggccataatcaactcattcttttcgatttgctgttcatgcttagcagtttgtgattggtaccctgtttgcaagttgagctgaagtatctggaaaagtagaataagcagtcaaaatggtgttcacatgcctatggcatccaaatggccaagtcaaaaccacactttgtccaaaggtgagtttccatctctccagtcttttctagtcttacgcaaagcaacacttacctccactttagccaaactactgtttccttgaacatcccttgtatgcccacctccaggcccgtgctcatgccttttgtggcctcgggtcctctccagccccatctgtgcttgttgaaatccctctagacttgttttcaggactacctcttcctgcagttccttctttgggtaatagagtttgttcttcccctagagagccctttcctatgtagtgttcctgattcttccttgctaaaccaggttgaacaaatgagatgtatatttggtgcctgactctctgcccaccgccagaccagatctggaccctgaatgggcccttggcaaacttatatcaggggatcgatctcaacctcccagctctctactcttgggtctttgtgggaatatctgctgggttgccatggttggaataaaaaaattaacaacattattagaaataaatgagaaaattatcctacaggattgtgtatgtatgtgcatatgcatgtgattggatacatgtatgtatatgtgtgtgtgtgtaactgtttaaggatttttttgttgtttttttttgttttgagacggagtctcgctctgtcacccaggctggagtgcagtggcgcgatcttgactcactgcaagctccgcctcccaggttcacaccattctcttgcctcagcctctcaagtagctgggactacaggcgcccaccaccatgcccggctaattttttgtattttttagtagagacggggtttcaccgtgtttgccaggatggtctcgatctcctgaccttgtgatccacccacctcagcctcccaaagtgctgggattagaggtgtgagctgccgcgcccggccaaggatgattttttaaaaagataaaatcatgactcatacaaatataagatgaatacttgtcaaaggttttatttaactcattgattaagagagaaccagtaagatattacaaccgtatcaaaagagaagctagagtactacacttttataatcaggtaaggaaggctaaaatcacatttaaaattggtatgaaattagtcagtattcccatggtgataatcagtagcattttatgaggcataatttgcctttccgtagacaggaattatttatattactacattttctacaaattaacttctgtctgtacagggtttaaaatagctttagtcaaagacaaacatggacagctagccagcacaccactaaatttcagttacagtttttccttgtgttacatgcgatagtctccattgcatctaatattttatattaggtatgtgactttgtagttttttatttttcagaaatgggtattttgcatccagagaagtaaaaaattattttaaaaattccagttcatttccttactgattccataccttagtctgctgaatccattggtccatagattatccacaacactaaaaattctttgcatatcaacagtagacactggaattgaaatggaattttgagccaattttaacatatttggagcaacagtctctttgctaaaaaatatttccatgtatcaagaaatattattctctcgaggcaagggaacaagacaccaaagtcctcataaagaaaatttggagaaatttttttctcctccatggagacaacttccagatttgaactgctttactagaaaggggagtggtggtatgatcagtcaaatacaagtgccacatacaaggtactcagagcatgatgggaaatttccaaaagccacccacttcttcagatatttctccaagatttgtgaccttcctggcttttgacctcgtggtttgtgagtcccatttaccctttctaccatgaaaatgattcaaaattaataagcagggactttgtttttaccttataaattaattcattttgcatatgtggttatagcccctttctcagtcctatgttgtatatttttgctttttattagaaattttacctattttattgatattttataaaaattagctcttagatttagttatcatttctataggtttgatatttagctttttttagtttgatggtttgttttttaacatgccaattttgtcattgatttctttctccagttttcccactattttcttagcttgttgagttgaatatttagttcatttatattagttcttgtttaataataaatgagtttaaagccacaaattttcctcctaatgtgcttttggcctcatcacatagtttaacgtatagtattctaattatgtacggcttgtaaatagtccattatcttggcttttatttggtcttttgcccaagaattatttgaatattcaaaattttccaagtaattgggtttttcagttattattgttatttttctcattattcttttatgcagcaaatattttggcagtgtttcctctgtgtcaggaatcataccagatgcagggaacagtagagtggatgcagccagcatggtcagcctcctcctggagtccataatttgttgagggagacagaaatgttatcatacaggcaagcacaatcatgatcagtattatggaagaaaatcccagggtgccccaagacttctaaactttactagaagtgaagctagacttagtgaaatgttctttaaccttactttcttatctcttttcttgaacaagaatggttttagtatctgtttgactctgggtaagcagacaatttactttcttctatgtagttctgatggtttcttcctgaggcttcccataaactccaaaatctaagggaccctcaagttcagatgaggtttgcagtttatagttcttgtaatgaaagcttaaaacatgtgagtaaatgctgttattttctgagtaaacaaaccctatatttaaaaaattaaacctaaaaaacttattatcagcattacatgcacgtgaattttaaaaatcactaagtactgaaaggtttagtgaaacaactaacattcgtcactcatctctccacaccccaattattccccagaggcaaccactttcagtttattggcttcttctagtagtttctgccatatacttaccaatgtgcttttgctacagtttcttgacccatctgctttagacagcatctggtgacttctttgtatggtagatgttggtttagttttcctgaaccaccttcccttgttcctcaaacacattcatcattatagtgaaatcacttttgttaaatgaatatttggtgttttaatgattaggaatgagtaaatatgcgtcactatatagtcaagtagtaaactatgaataacatgtccttccttgaatattttgtcatttccctggatttatttatttttttgttttgtttttggttttggttttgtttgttttgttcttgttttgttttggtttgtttggttttgtttgtttgttttttgtttttttgttttgggtctttctattgcccaggctggagtgtaatagctcatagctcactgcaaccttgaactcctgggctcaagcaatcctcccgccacagcctcctgaatagctgggactacaagtgtgcaccaccatgcccagctaatttttttaattattattatttttttgagacagagtctcactctgtggcctagactagaatgcagtggcccacccttggctcactgcaaccttcgcatcccgggttcaaggaattctcctgcctcagccttctgagtagctgggattacaggcgcacaccaccaggcctggctaatttttgtatttttagtaaagatggggtttcaccatgttggtcaggctggtctcagactcctgacctcatgatctgcccacctcaacctcccaaattgctgggattacaggcgtgagccactgtgcccggccttaaaatatttttgtagaaatgacatcttgctatgttgcccaggctggtatcaaactcctggcctcccaaagtagtgaaatgatagttgtaagctaccatgccctacctatttttctggaatttctaattgccttaaaaaactttttcttatcctatctaccagatatctaagtaatcctaaaattattttatgtttattttttattatatataataaatatgtctatcccctcccctccatgtgccatcatgtcaggtttttaatcaagccttctttttctctggggacatctcttccagggctgatccagtgtgcaccagttgttcttaaggcctgctattcattggtcatcctggaatctccctttgctactcctggattggatccacaatttcctgtttcccatgtcttactaattcctggcttattcctgcatttatctagaggaaattctcagttttcaaatacatcatcggaaatacatgtttagggttttctgatgtcttctagtgacttatgcactattcttgagaaatctgatactgtctgagtctcatttgtaggcacagaagggagcagatgagtaaagttaactagatttagcccttctgaatgtctgtgtgagtgtgtggggcaagttggggatgaggcatagaagataggctgatcagctctgaggtgctgtccatacaggcacttgacaggctgggcaggtaggctgggcatggcagggaacatgggcagtcccccagctgagaccagagaaccagtggcctgagccctgggagccagcttggcccaggcacagtgtgtgtgaggaggacatccagatttgtttaatggctggcattgccaaacaagtaaggggttctaggttgtattaataaagaatgacctcctgaataaggggcgtgagtggtcggcttaacaacggagcagttctttggccgggcatggtggctcatgcctgtaatcccaacactttgggaggccaaggctggcggatcagctgagatcaggagttcgagactggactggccaacatggtgaaaccccgtctctactagaaatacaaaaattagctgggcttggtgtcatatgcctgtaatcctagctacttgggaggctgagacacgataattgcttgaacccaggagtcaggggttgcagtgagctgagattgcaccactcctttccagtctgggagacagagtgagactccgtctccacaaagacaaaacaaaacaaaccacaatggagctgttttccagtaggtatgtggttctggtctgagtatatattgttcattggcaaatttctcatccttaagtgttcatttcaaatgctgcctctctatatagctttccttgacacttccttttcccataattcatttataataataataattattttacagacagggtcttgctctgtcacccaggctggagtacggtggcgcaatcaagactcactacagactcactacagcctcaacctcctggacttaagcaatcttcctgcttcagtctcccaagtagctcatttattatttgtctgggttatcagtctctgtttacttaccacattgctatactatatctctctcctgtgttgaatcaagttccccaaagatatttggaaaagttacttaatacttgtgattatgaactggaaatggaggtaaaagtccttgctccatttttaccactgggctttgtgaagattagatgagttatatattacagtgtcttacaaacagcaagtagaagatggtgtttttccctgtccattttagcagaccagttaagcagccattgtcctgagcatctgtgtagcatccccacactgagatgtcctgaattccctagtgggaaaagaaaagttcacttttattcttcaacttcttcagcaccagaaccttcctttcagcatattcttctgcctctccttaccgaagttcgtaagctatcactgctcctgtgcaagtgggctgtcttatggctgcatcctctgtggtcccagaggctgaagatgaaggaaccaggcagggcctgcccaaagcagcccagggctccctaatgcaccagacatggcctgagtttgggaattgcagaccaggtctcaggaactgcactgcttccccaggtgctaggcagtcattttcccactcctctccattgcacaatggggcttttgaacactggcctacgtcagtctgatggacatggtgggtctcttgttctaggttcttgcacagagcatcaaggtctgaagaacttggccaaagggactccaaccctggggcttctgtttattcatgctcttgggcttagccattgacctccaatcccagaagcactaggccctggcagctagactcacaggtgctgccagcatcagcctcatgctttgcctcagccacccctccccgaactcctccttttaagcctggcctttctgcctagacttctttccttaaagccacgtttagtcagccatgttgccattttctggcactgggccttgacttgggactttcaggttaaccacagcctgagtccttagcataaagtcttgaaaaccaggagttctggtttctgttcctttcttttgagaaggcttcaaatgcacattgagccgccatttacataccagagatctcagtcacaaaggatttgcttctctaatctctgactagggatacctgttcatcctgtatttgcttaactaagttgccccttcgatgactgcatgtagaaaagaaggttatcttcttttgattaaaattaccacacccagtgtaaatatgacacagttgactgtaggggatctggaggatatagcctggattcgagtggtggcttggctttgtatacatgggcatgtgaattgtgtggaacttactgggactttcagccctggagatggtgaggagagcaaatagctgtggatgcagggaaagagacctggtgtagctgtgaaataactcttcaggtgaccctgagcagtctgcttttctacctcagcaccttgctgttgtaggctctctgcacccacaaattgctgttatgtgggggattctgacatcatgtagaacagtgggccaggtcgctttgggggataacttccaagtgtgagattctgtgacaatgacaagattgaagctttccatctctgtgatgtagggaaggcaaaccctaaaattggtgcttagccctggagggttcttggctttgcccaggagagaattcaagggtgagctggtggtgttagacaacagcttttattgaagtggcactgtatagcagcagcagcagagatgttgcttcttgtggtatggggcttatcccataggcattgtgcccagagtagcagctcagaggcaggtcatatttatatatgtttttagttacatgcaaatcaaggtgcagattatgcagaaatttctagaaaaagggtggtaactttcaggccattgccatggaaaggggtggtaacatccaggtgctgctatggcaatggtaaactgacgtggcacactggtggacgtgtcttatagaaagctgcttctgcctcgtccctgttttagctagtcctcaatttggtccagtgtccaagccccacctctggagtcgagtcctgcctccttcttcatatgcacgaaacagccttttaaaatccttagttctgtccaggattcggcacaccatagatatgtcacttaggattttcccttttagtcttcatccacagttatccactctttagcttcttctggtttacttattttgctatattttcttctcattctagcttttaaatcgaaaagacaagactacctttgagaaattggactacctgatgtcgaaagaagataattacaagcggacacgggaatatatccgaagcctgaagatggttccaagtattccctatctaggtaggagtttgaattggcttatttttttttaagaaacctactcggtgccaaataagatgtttttacagtttctacctgaaaaatttccaggaagcgacatggcccgtagataaagaggcaattggttggctctttgggttggaacaggctgttggtacttcccaaggttggaaacctggattagggtgatatacaagtgatgttctgctttttatataaaagacctgtgggccccagggttccccaggctgcagcccagatgggtcacaatgagagtgataagactcgtactggttcatccacatcctcctgaactggggcatgtcaggcacaaaccctctgttctggttctctgggcattattagtatatttcatatttgtacaaataaaattatagtaatgtttatttttctggttagaaaataatgcatgttaattgtaaggaattagagaaaaaagttaatatcttttgttatctcacctaaagatatttgcttcatatcttattgatttgggcatatctaaaatatgtatgcttactctatcctaaaaatgttatttttatcttaaaaattttatctacttttcgatgctatgactcattcccatcagatggatttgtcaaactcgaatctgctctccaatattgaccatttaaggcagcagccctcaacctttttggcaccagggaccagtttcctggaagacagtttttccacggatggagagtgggcttaggagagtggtttcaggatgaagctgttccacctcagatgattactctgaggaggagcacacaacctggatccctcacatgtgcagttcacagtagggttcgcgctcctatgagaatctaatgctgccactgatctgacagtgggtggagctcaggcagtaatgcttgctagcccatcgctcacctcttgctgtatggcccagttcctaataaggagttgggaacccctgatttaaggtatttctacatttttgctattaaaatgtctcaatgaacgtccttattgcaaaaactttctacatgtagttatgattattaccttgtgataaattcctagaagtgtgcacagcttcaaaacgtatgcaaaaacgtatgccttttcatgtatatttccaaaatgcactccagagaagttgtgtcaatttgtactttcatcagaaggggatgaaattgcctgtttctcccacattacaaatactatgctttttcatggttttccttttcctttttctttctttcttttttgtctttgccaatttgataggtgaaaaatacttcttgtagtttggatgtcagggttttgccagttttatgaaaaaatcttttgatcttttatgatctaaaataattctaataacaagggaaaccaacattatgtagaagtgactcctgatatttgcaagggatctagtgcaattttttgaagttacatttttgacaattttaaaatttctttcatgagcattgtttatttagattttctttcttttaattaaaaattaattagaatatttaattcttttaaagccaacttggaaaatttgttttttagtagaaaattgtccatttgttccagattttcaatattactagcatagtttttttcttatttaattttttgacaatataatattctcttataaatttgaatctctctctctctctctatatatatatacactaaatactaaagcaagtataactaaaaatatactaaaactaaaaaatactaaagcaaacatatatatatatatatatggttatatttgctttagtatttctaatagtttagtatttctcatactttgtattttttgttttctttcttttttaaaatttacctccttgccagaggtttgtctattggtctttccaaagattaaattttggatttgttttcagtcacactgtctttctgctttttagtttactgtattttatcaatcaaggatgtgcattttctttccacattttaacacttctgaaattgggatacatcttgcaattgataacaaagcattgtgacattttttaattggcagcagtttttcttagtgatacataaaaaaagacacacctgataaaaggtgacatcttaaacataatgaaatatggactttccatgtttgtctcttatgattcatctctcctgttttccttaagttgtttcaccatttctgttaactactagagttgaattactggtttatttgtgtatatgtttttttttcactttaatatagaaaacagttaaggctatacattttcctctaattactgcttttgttgcatcctacgtgttttggtgtgtaatagtctcagtgatattctttaaatactccctatagttttaatttttcttttatgcaaatattatttaagacagtgtttttttcattttcaagggcttaggcttttgtttttatttttaaaacagtttactgaaatataattaatacataatccatttaaagtgtacaattcactggtttttagtaataatcacagttgtgcaaaccatcaccatgatcagttttaaagcatttttatcactccataaagaaaccccacgcccatgagcagtcattcgcatttccctctagctaaccctcctctcccaccttcagccttaggcaactattaatctactttgtgtctccacacattttcctattctagaaatttcatataaatccaatcatacaatatgctgtctttatgactggcttctttctcatagcatcatgttttcaaggttcatccatgctagagcatgagtagtacttcattccttcttattgccaaataatattccattgtaccgatgcaccacgtttaatttatccatttgtttttttagacagggtctggctcttttgcccaggctggagtgcagtagcatgatcttggctcactgcagcctgaaactcctgggttgaagtgatcctcccgcctcagcctcccaagtagctgggactacaggtgcacgccaccacgtccagctaatttttttgtattttttgtagagacgaggtttcgccatgttgcctaggctggtctcaaatccctgagctcaagcaatctgcctgccttggcctcccgatatccatttatttgataaacatttgaattgtgtccattctttgactattatgagtaatgcttctatgaatggcttaggtttttaaaaacatagttttctctaatttttgagatttgttttgtggcttaatgtaagatcggtttttatacatgtttcatggtgcatgctggaaaagaaggtgtaatgtctcaaattaatctataattgcgttgtaatgttcaaattataaatttttgacaacttggtctatccagaaagaaatatatgttacagtccccttatatttctagtagtttctgccttacatatttaatatatagaaatttgtaacagttgtagattcattgtgaagtactccgtacaaagttatcttggttccatttgttacttgcttttacttctattgtctgatattaattgtgtgacatctattttatttttcatttggatttttttgccaagtgaagacattatttgtattgatagataatattttacatatttaagggtcacgtggtattttgttacattcatagaatgtataataatcaagtcagggtatttgggggtatccagcaccttgagtattcatcatttctgtgtgttgggaacatttcatgtcctctcttttagctacttcaaaatacacaatacagtgttaaccataatcaccctactctgctattgaacattggaacttataccttctctctaactatgtttgtatccattaaccaacctctctttattcctccttcccacccacacacacttcccagcctctggtatctatcattctactctctgcctccataagatcagcttttttagctagcacatatgagtgagaacatgtgatagttgtctttctgtgcctggcttatttcacttaacatagtgacctccagctgcatccatattgctgcaaatgacaggatttcattctttttatggccaagtagtacaccattgtgtgtgtgtgtgtgtgtctgtgtgtgtgtgtgtgtgtgtataatattttctttatccatttatctgctgataaacacttaggtttattccatatcttgggtaaggtgaatactgctgcaataaacatacaagtacagtactggtttcttttcctttggataaatacccagtgggattgctggattgtatggtagctctatttttagtttttcaagcaatcgctatactgttttctgcagtggctgtactaacatacattcccaccaacagtgtgtagttcccttttctccacattcttgccagcatgttattttttgtctttttaataataaccattgtggctggcccaagacgatatctcattgtggttttgattcatttgcatttattttataaatctttggctatagtttagattttaattttttattttattattattatttttttgagactcagtttcacccttgttgcccaggctggagtgcagtggcgccgtctcggctcactgcaacctctgcctcccgggttcaagcaattctccttcctcagccttccgagtagctgggattacaggtgcctgccaccatgccccgctaagttttgtatttttggtagagacggggtttcaccatgttggccaggctggtctcgaactcctgacctcaggtgatctgcctgcctcagcctcccaaagttctgggattacaggcatgagccatggtgcctggccgagattttaatattttaagttgccttgatttagtcatgattcttgcaaacagcatttagttggaccgtgcatgagaagccttgccttttagtaggggaatataccactttcatatttgtttcaccttatgccatagattgaattctatttatttctttttttcatgcttttgcatctttccttgttttcttctttggcttaccataaactgcagtgtctttctacttggttactggcaaatccccatctcaggtctgcagatggaaggcatgttgctgtgcagagctcccaagtccatttccatcacacctgaggctcatcaattgagagacaacgttgatggtactaccgtgagggtagcctagtgcagcccacgggttccactagcagaggtgttccagggtcattaaggatggcctcttttctcgaataaggatgatcatgagagctgctgtgcattgtttgctttctctgtgcctagcactttgctaggcatttgaatgcatcatttcactgaatgcgcacaatagcccagtgaataagcaggcagtgagaggttgcctaaggtcacataactggaaagtaacagagccaggactgggcccagatggcctggctataagccctaagctcttgacactgccctctcctgattccccaccctattcaggttattattttcctacacacccttgtggttaccacctgtgtcctctggctatttatgacttgtgggtggcccccatcaggcactgtgtgaagggtataaattattgctcctgtttcttgtgacattccctattgtgggaccacaaagcagtgcagtcttgggcttccaagggcattggtcagcctgtgccagccttcaggcctcttgcccctcagagtttctagacagatgcagccccccatgtccttgatcacctcatctcagctgctgcttcctggcaggtgcttcccaagaggctccatggaggcctccatcctcctgcattcttcctgcttctgactctaagcgagtccagctgaactgctgtggtcttatcccttcagccttatgattattttcctctccctttaaaccaggtggactacatttcttatgttgcatctgacatatacaagtcagagggagagaagaggaggtgactgccacctgctctctgttcttgggatagtgtatgagggtttaccatggggtgccgtagtttgcttaaaaaagaatgaagcaagacctcctgaggcagctgggagttccacctgcatgcatgtctggttgccttggacataccctacccaaatccaggttgtgtattcttctcaaaaatgcaacctgtcccagggacagatttgtttatttaaagaggaatagttatataattcctggaaagtacaacataggaaaaaatatctgaaaccatttgttttttctctggcaaagtcctcactataggtcttttcccccttggggtgagaggaggctgtttttctgggaggaactgtaggtcagtccctgatacttcaagctgctttgttacttctgttgcttgagaccgtgaatgctgcttcagcagttatttgtctctaatagcaattatgggctttatttttgtaacaattcttttaaccctctgtggaagattctatatgctaactggtctcctgtgactattcacatatgtgtctctttgttccatgtaaagatgcctttatgtagtactagcctttgttactaaccacatgggtgtgattctgactccttttaatgcaaattgtagagccagttggctgtactttggtgtagtgagttcctgatgaaacataattttaaaaatactgagggaaaaatgtattacatttataaaataagactctttgaatcaaaaagtttcttgcagattacttcaaagtgtgaaaacagtgttgagaaatagttcaattatttgcagctgattttatctgatagcagctccttgcaaatacccggttagattggaatgataacaaaagcaagcaaagagctttgaagaatgtctacatcatttgcttataaatagctgtattgatttagggggtgttttgttcttactacttatttccttcaggaaataactaaattagaaatgtgatggatcttaaatggtttagagctgattctaaaagtaaccatagcagtgtggaaaattatgatctctcaaggaacaaaaattaggtattctaacacttctggatagtaagaaaacatttggagacattcttagtaaatttacccagacttctaacatgtgaagtaaatttctagaacgtaagttattccttcaaacaagcaaacctttccatttttcaaaaagtaagactttatttgcaaatataaattctaaagtttaaaatcaagacaaatttttccaaatataaaatcaacagggctaaactgttggatatctaaaagggctttcaaaaagaagtgatcattggtcaaaaaaagtgtttactctgatgccccaaagcctcccagtcagacaccacccctgccctcatggagctcacagtccagttgtgatcaccagcactggacaagaaactgcaagtgagctgagcattttgaaggaaaaggcaaaggagcaaaccaagggggccccagctagtctgggggaaccaggaagggctttctggagggaagtagagtcctgaaggatgaataagctgggtgaagaggtgggaagtgagcattttacacgaagatgacagcttgtgcaagaaccctaaagtgaggaaaaacatgtttgttagaaaaactggccggagagtagtgaatgagggggaaggtgtcatgtggagcagctgcagtggaagggaggggaagattgcttagggcctagacatgggagtcaggagggagtggggagcccaggctctgaccaacctagaagcaggagggagccatgaaagggttttaagcaagggcatgctgggttggatttgcattgaacacacctcaccttggctgcagcaagtggctttgaggaggtcaggctggaggagtgaaggccagttaggggatcctgtagaagcctgtgatgagtcactgtatttcagaaatttccagggagggggaaggctctttaaaagcagttcattttagagcaaagccttggagagacctaaaacagttgtcagagagtatatcccttatacctgatgaagacacatagcatgtccttgtactctggttttgagaatccatttgtgcgtttcagctgtgggaccccttaaagcagagaggaaagagcaagcaagggtgggatcaagccaaggatgcggcagagctgctgcttccctgaacagggatatgagtggtggccgttgcccccttgatgggggccaccaccctaggaccaaggtgcagtagttcccttgtcaggattagcaataatgttaactggctgtccctaggttggccagcttttaatgcccaactgaaaaaattccattccacatgcaggaaatccagcctttttttcatttcccctccccacgtttccaaggttccccaaggagcactcatttgttccacagatccatcctggttgttgcttggtgcctcagccagctgcctggccccagacttctgagccctcccgctggtcccctcctgcatttcccagttggacctgtgtggaaccaggctgcttccttagctggaaaaggaggtatctgtcagtccacaaagcaaagcttaaggctggattctggtctgcctgcccatggagcaatagaccttgttcctttttctattctgccctgatggccacatgctacaggggccaacttgctgccctccccacccccagcccaggaagcctttgaacaaatctccccttccctaaatctaggcattcaaccctctctgggatccagcaagcaaggaaaagcttccctcgaccccaggctcaaacatacttcccagtcaacagaatgatctcaaagacgctatcccatccaaaatgaaggaaactatttccatgattttgaagagtggttagctacattttgtttcaaatctctcccttccagaagggaagagattgcctttacttttgcaatctccggatttgttaccttaaaattcacattttttctgggactctgtagtctttctcatttgttacaaaaggccagtggatgttattaaaacccattttatgaatgaagaaaaaaaacatagcttgactcatgacttacccaacatcatatcccaggcggataccaagtttaactcaagatctcatgcttactgctgaggttccacccagccttaacttacgcatcctccttttaatatctccgtctccatggaaataaacagtagaaggaaaacatgtgggggccaagaaaggagcactaggtggaaagtcttgttttccgaatgctttgctgcccagagcgggagaaccttgtcccatttgtcccttctggggcaaagggaggatctgcagtcagcttttctctgggtcaagaagttgtgtctgaccctgcaaaacgaggtatgagcataagcccattttgtgcaagaaaaagtgttttcatggtaggaatctttatactcattaggatgactattcctctttgacttcctttagttttttggatttcgaattagaaactaacactaattacaaaaactcatgtttactgttttactatgtgattgcactgcattatctcatttaatcctctcaacactccttcctctgagggaggcattatttttgtcttatttgctagctgcaaaatatgaacaagattcacattaaagtttacacactagtaaatggtgagatcagtgcttgtatccaggtctgactccagtgccccaaccactaacctcaaaatatgccatgtgttcaccagaacaggcctttaacctctgggtaaaaccacacctgagaaggaaagtacttctagggactcttcctgtgtggaacaaggagacttcctggtgggaggtcctggagaagcacattgactcatgggtggggacagagtggattgagtggacactggtcttctactgacgcattcttattgtcctcttgtacctgggctggccctaataaagaaaaggattgggacaaaggaaagactggggagcttctgcatcctcaagaccaacctggagccattgggatgtttcatgtagtagacagctcttcagatggcccccgatgatttctgttccctagtatttgtatccttgtataatctcttccccttgagtgtaggcagaacatagtgatttgcttctaacaaatatgacagaaataatgggatgtcccttccaagattagatcattaaagactatccctttatgttgagtgcttgccctttctactctcttttggatcattcatcctggaggaatccagctgctctgtgtttggcagtcgtgtgaagaggcccgtgtggcacgggattgagacctgccaacaaccatgtgagggagtttggaagaagattctgctaaaaaggcgagccttcagatgagactgcagccccagccaatagcttgactgaagtctcatcacagaccttaaaccagagacacccagctaagacatgcccaaattcccaatccacagaaactgcaagacaataaatgtttattgtaagatgctaagtttcagaataatttgtcacacagcaatggataacgagcacattgcacaacctttatcactactccacatttattactttgttgaccaatctgtactgggacaaaatcaactgtaaaactcaacacataaaggactacaacactggcctctagggcaacaggacgtgctggactcctctcgaaagctagttttgaggtggggggattcgataggctagagaaagtggttgctgctttgagaggtgatgagttcttgcagttctatgagaaagatgggtgcctggggatgactgattagggtctgagagggcctggaatgttacccttaggaagcctgttgttccctgatggagtatacagtgggctcctgagtactcaagggaaacaaagatatatccttttttgtgaccatccagaaaggcatttggtgcccactcattcttttaaaaacttaaatattacaaaagtaacacattgcttgttgtaaaaattattcacactgaaaagaagtttataaagtaaaaagtgaatgtgccattcttcttctcccactttccagaggcagccagtgtttgcagtgggtatgtgttcttccagacattcttatccacaaatacaaaaggacatgcctgtggaggggcacatatgatattgtgctttttaaccaaagtgggaacattttatatgtgttgttttgcacatataaactatcatagatattgtacagtggcagcaaatctagaactcccctgttctttctggtagctctttgacacccacagatgtatgggcaacgtgttggatatcgcctggatgagtgctgatttgtctagctgtgtcccaactgataaatatttagactgtttctagtttttcccttttacatatacaagttgaatatccctaatctgaaaatccaaaatctaaaacattttgagagtcaacatgatgctcaaagaaaagcctcactggaatattgtggatttcagattttcagattaggtttgctcaacaggtaagtataatgcagatattccaaaatctgaaaaagtctgaaatctggaacatttctggtcccaagcattttggataagggatgctcagcctgtagtgcagtggggagcatccttatctgtgtgtctttatcctcctgttaaagtacttctgaaacactgagtgctggaagtggaattgctggggcaaaaactctttgcaactttacagtgcctactgctggaatgccctctgaaatgcttgcagttatatttctgcaaacaggatatgagtatgcctattttttccactcttaccaacactagatattatccaccgtgttttatttatgctaaaatgataggcacaaaatggcatttttttttaaatatacatttctctgcccaccaattctcttgggctctaagataggtagccaggccttcaggcctcctacccaactgatcagccaccctctgcccttgcctctgcttcctgaatatctatccttattccatctccctgtgttcctaccacaggcctgcactgccctgattgatgaggaaaggctgccttgctgttgggttcctgtggagaggaggctgacctaaatccatgccctgcacacttgcctgggcattagtcaaccttccaggcttggagaaggctgtgtgcttcttttaatcgttttcccttgttgagatgacgagggcgtaggcctctgtcatcacatggccccagaagggaattctaattccactccctccacattaactatccttctaggctctgggccattcccagctctgttgaggctcagggcaaatgtggcctgtctttcctcctccaaggagccctctcctggtactgtgagcccttcagcttcaggatgtgctgcagcagtggggagggaacattccttgaccagcccttggagctggatttattaatatcatgaccatcagcaagcacagcatgggacaggcagatggcccacccacctaggaggtgccgcatgtggcagcgctgtgggaatgccacgcagatgggagagattgtctgcgtctgggctcccagtgtgggctgagctggcccaggatggccattcaggagagacacggatatttgaatgtctcagggatggctggtattgaaacatcatgtccacagaggcagaatcccagactagggctggttcaggcctgactctgaggtttgagagagacctgtaagcaagtgccaggcctggaagcatggatatgggaggtgagccaccactactggaacccagttaccagataatgaggaccaaggcttgaaccaggtagatttggtcatctggtgactgccagagcatccacaagtaggatgttcggagtagcaaagcaggggggctgatgagtctgtaagctgtaggacagttggcaagaagaggagctgcagcctggcaaaggattggtagcccagggagctgtggaacattctccagcactgccccttgttactccgtgtccattgtttgagataaattaggcagacagctatggactggcttcctgacatctagggaccttctggtatcaagctgctgctgctgcataggcaggctggctggctacctgacatatccactcctgctgtgggcaggaggctccatatcaccgtgattctcagatgtattactgagtgatacggggtgacataggagctgtagtgtgatctcacttcctccctgggtatagtgatcgatgctgtagaggcaggagctcaggaatcagactgactcgagttcacattctgagtgtcaggctgcatgcacttgggcagctcacttacctctttgatgtaagttttctgttacgttgaagagagagtaattatagaatccacctcgtagagttgttgtgagaatttaaagagccatgcatactgcctggcacatggaaagcaccctatagatgatggctagtattagtgctatccacatgaaaatacagctaagaagaccctatcagtgagaaccctgttgccccctgtatccctattgagaaacacagcatacccaggaagggcagcgtacccaggaagaggcccatctgggcacagccaggtgtcatgttagttagccacctgggcttagaagggttggatgtgatttccgggatagtgcaggggtcagcagcaggaagggctggggaataggatcccatctgatgagtaatgtctggctggcaaaatatggtcctggagaggatggggaccaataacatctggagtgtagtctagacacctttttggatagacacccagcctgtgacccctccttctctgggaacctacttccgctgcttctcccttggcactgcacgccagcagcagtgttccttccacctagctctgctccacgggcagagcccatagagttggggtggatacccagcctgaactgggccagttggatcctctatctgggagccagcattggaacatagatatgctggcactcagatcaggaggacgtgaactgaaaaatgccatctggtgccatgtgccaggacaactgcagagaatagtccacagatggatgcttgatgagaagcagagaaagagaccctgcaggaaagggaaaaggaaagagcaagggagaggggctgagaaagttgctgccttgcatcttgaaggctttccaggcaatttctggttcctggcccttgtgaggcccagctgtgtccctgcccatggacttggggagatacctcgtgtccttatgtaaccagcttattaaatgagctggactcaatcaggtgtaagaagaaaccaaactcattttttccccagtgtccttttgagcctactctgtggacttttcttttcccagtcaaagctgagaacttagcaggtcctttggtctttgaggtgctaggcatgaagcagcccaatccattctaacacttcctcattccagacagtccagtgtagtaattgcaagtctggactcctaaagctgaccagctgtggaggtctggagtgggggaagacagatggtcagcttgtttgtttgtttgtttgttttgagacagggtctcatttttttttgcccaggcctggagtgtggtggcatgatcttggctcactgcagcctctgcctcctgggctgaagtgagcctcccacctcagcttcccgagtagctaggaccacaggtacatgccatcttgccaagctaattgtttaattaattaattaattaattttggtagagatggggttctcaccatgttgcctaggctggtttcaaactcctgggcttgagcagtcctcccacctcgacctcccaaagttctgggaggcgtgagccacagcacctggctgacacgcagtccacttcttcgctggatcccggccagtcccactgcctccccaacctgttcactgaagtttctggcccgtggcaacaggggaggaagaagggagagagaacggcccatctttcatagctgttggtaactcagagctcgtgctccctccctggagtaatgtatagctccctccctggctcctgtacttcctgccctgcccctacccccaccatccaggcagccctctggtcctaggaagcctgaatttgtgcctcggtgggctggccttgtgctgtcaatgtgggcccctcttcccactgctctttgtgcccctgggcctgagtcagacaggagtgcttatgctgtcccatgccaggctgtgggaatggtcccttgaagtccctctcacttgactgaaggtggatgaaaacacccctcttccttgtggtagtggggacacgtgaaggacagttcattctcccctctccaggaccttctttctatacttctcacacagtgtcagggaagccatcaactaatgctggagagccagtgcggggccatgccctttgcagggatgatcttgcagcttttatcttgtccttagcctttgaagtctcagataaaagtgaggcagaaagagcgccttttagacatgttgttacacttaaaagcttccctttttggcttaatctagtcatgtgggtttctcttactataaccagagtcttgacaagtctgtgtgaaacagatgagggggtcttgggagatcagagaggacaccttgaacctcctaagagtgtctgtgaactgtgagcatggtacactcccattaccattgttttcagtaatgtgaaggtttctctttcagtcttgctcaaattggcaagattacggggagggggtctttttcagtgtcacttgctcagaaaacatcactgtcttctggccctgttcacacaagcccagcaggtgggtgccgcttgtcacccaagagaccaaggtattggctaaaactgggatgcaggggtttggctggggcaggagaaagtctgggcttcattgacttccttctgggtctgcaaatgcagtgcaaccaccatggcgaacttagtaatagtaggactcctgtgattgtagtccttaaaaggtcactgatgggataggagaggatggtctggttggcaagaccccaggatgctgactggctgtctttgctggcaggtagagcagttcactgggtacccaggctagggtgcttggacagagccctcctgccccatgctcttcttccatgccaccagcttagtgaactgacccctacctttcattttctccacatctctgatgagctttttccttcctctccttctatatagcctgggtgtggtttgattaagattcagtcttgggtattgagatggggtttgggagaaatagctggtatcatgacctgctttcatttgaatcctaactagtttagaaaaaggatggctctgcagtgtccagcaatggctttccagagctctctgtttggggttttggagccaagaccagtgaccagtaaggttgggccttgttttcctttgctcttgttccctatgtcccacacactccactccagatgtgtgtggaggggtgactatagtctgggccaagattaagatattttcctcaaatagcattcagattccactgtgatcccaacaactgactaggggcttaggagaagggagttgagaactcttaattgatgcctgacacccagcaccttctggattaattgctgccggggtattcttaccagcagtctgacttcaagcctcatttccgcctcttttgtaaactgagaataatgatccctccttcacagagcttctgtgaaggtgacgtaaaatgcacacgcgcacacggacacacacacacgcctgtttctaatcacatggtaggcttcagtgcgtatcagtgcatctctctctaactgcagctttactagaaaaagctatcatatggttatgccacttggtcattaggtagaaggattgctggggcccagggtataagtgcatttacaattttgatatatacactggcaagttactcttcaacaatatggagtcaatttatatgtccatccatagtgcacacatctgtccattcccttgtcaacatggagattgacatttttttcatctctgccaatctgacaggccacacgtcatggtttatccttcacttatagcacctctctgattactactgaggttgacatcttgtttactggccatttgtgagtcttctcatgtgtacatgtactttgccaagttttctgttacaggatttgcatctttcttaatttgaaagaggttttagcatagcacgaatattctgtatttgctatatatgtttcaaatatgtttctcttgttcaatatttgccttttaatcttggtcatgttttatttttttgctttgttttttggaaagcagaaaatttgagttctgaaaaaagttgtatcttttagtcttttcctttaggttttggggtttcctgtcatgcctagaatcacttcccaacccacagatttgttttacaaggagacagttctagcagctagggtggaaattggactggaatgagggagatggagactcctggtctggagcctggtgcagtagttgaagggagaggagataagatcctacgctaatgcaggcaagatggcttggcgtggagggatggattgtccttggcaggggaagggagaggtccttgtttttgatctgagcaattgagtacctggtgccatttggtgaaaagggaccagacctggaagaaaggtacgtcaggtgttaagtgcactgcccgtgaggtgcttggaggatatctggtggagacatccaggacacagctggatgtggggaagtggagctccagagagccatcttggcctgaagtactactgtggtacttctgagggtataggtggtaaccagagatagggtgggtgtgatttaaatgattctggtgtgtgtcctggtgccgaatctcttcctggttttacttaaagaggctctgatatgggaggccccaggaaggcattctaaaacagtaacacagagtgtagatacatccaaatagcactgatggcttttattgcagattcgtgtcattacaaggataatctgggaatatatttttaaaaaaaccctcccttttatatacacaaaacatgctacatggtacactttgtgagaaatgctgaggtaataggcacacacccagacatggacagtaccaaacatccaacatctcacacagcctggcccacgtgcccaccgggaagggtctcaccttcttgactcatcccttgccccttcttggcaatagtcccgggagtgctgaggctgacacttggtggccaacaggactcagaaagccaccatgctgcagtgcatcaaccaaggggtccggtgacccctgattattcaactcctgagaagtggcctgttttcatttttgtggcacttgttctccagggaagtgtagtttggagatgagatgcggactctagtcagcctgagagcgtggaatctctggtctgtagccatctgggggctctgatgatctgatgacttctgttctgagataattctcctggccagataggttattatttgtgtgaagactcaaatgacctgtaggttaaagtatgaatggaagatacaaaactgcgagtacattatctatacggccggtggagcttttggcctggccttcccttcccaaccagaaacctggagcccggagtgtttcctactcagaagctgaggaatctcgcctggaaagaaggggctgtgcgacagaaaaggcaaggagtaggtaggcgaggagtacagcagagcggaaagggggccttgaactgcagtgagtggccagggactgacacacagaaggcacttaatgaatggtgtcaaatgaagggataagtgggtgatggatggtgaaaagtcctgagaatggggaaaagtatgaaaatgtggggggagggattttgaaatttgattaggtgccaaaaggggttcttaagaagctgggaacctctatgtgagagattagcattgtagacattctggaagaatccaggcacacagatgccaagggtgatcctttcagttgagaccacacagtctgtgatctacccttagactcaagtaatacaacactaatgaaatgcttttctcctaagagcaaagctgctggtgacagcttcaacatctgagaactgaatatatgtgtatttaggtatctaaggcaaacctatatatggatctagatatatcacatgtgatgtatatctaaatgcatatatatgtggtatacacatacgtgcacaagggaggctcatacacatgtatattatgaaggtactttgcagttgtgtttttattgtagagacttaatttatttaaagaaagagttgtctgtagtcctgtcctgtcctggagacatgaggggctgtctggtgtgaaggaaagtaggagggacagaaaacaccgtatcgattcagttccatcatccgctgcagtgacttcggaaaacagaatccagcatcccggtcctcccagcctcaggatgaactggtgaggagttgttctttgtgctgtggccagcgtgaccagggtgggctcctggcaatggccacgagaggtcaggagggggagctggcttagtggaaggtgttggggttcggtcggatcatcatcaccactttcttgagtgagtaagagcctcctcggaactcagcccagtagactccgtcctggtagcggctccggtaatggcccccgcggtaccagaccccgttgaggttggagtgggcacaggcgttataccaccagcctcccttctggtagtgggcacagtttcctgcaagagagaaggcagtgagagggtgtctgggaggaggccattctacttgcgtccatagtgctcagggctttcggcaaagccctctctgggaggcatctggagcaagaacgcttgaaaggtggacccgtctccatgggtggtgagaggccatgcttcaggcccgcctttgaggctcagctttgtaactaactagctgtgtgatctcagacaagtgacttgacctctcccagccactgtatcctcatctgtaaaatgagaataaaaatgacgcctgccgcacagggcggctctgaggattgaatgaggatgcgtacttgacacctagcccagggctgggtgcaaaggaggccccaagggaactccacaccttgtgttctgataggaaatggagatggcctgaggtgggcggggagggagaaaagctttttcttaggaatttttgagttgaaactgttggatcaggagtctttaaagaatgacaaagaaagtgtttaagaagaaatgctcctccagtcctccccagcttgtattccatccaaacaattttttgtattacttcacaaaggaaagatatttccataaaactcttggcattatcacatcatgctgaattttgctgccaaggacaagcagttcagaacaacagtaaaaactgtgggaaggtgtgcgcgggcatgcaggggcagtgcactctgtggcaggaggacagggggccactatctgccagcattgctcttagtgaaggggggtccccactttcctgactgggcctggcaaggggaccccgtactcaggggaggggctgctccagtcagaattgtgggttggagggcccaacagagcaggtggccgaggccgtgggatgaggtgaggaggtcgcactcagtctgaggcagaaagcaagaggggaggtggagccaggttttcccagagtttttctgggggtccctctgggccatgattccaggccacagggaccaagtggcagtgttggactggtatagcagggagatccttgggcacgccataaccagcctcctctttgccagcggaggtcccacacacctccagggacaaggaccttgccagctactgattttgctgctggctagatctgagtttggatcatagaatacactttccgctccctaaggaggtggccctccagaaaggctgtagcagcccctgtgtcccagggtctgaccagctctgaaggttatccttctgccctgctcttctagaagcctcggcagcccctactgcttcagaatgagggcctgttcctcttccagggccccttcgggccaggccagttcagtgtcagtgggcggacagaggtgtctgtgtgatacagggatgggcaggtcatgtccctcctgtcccctgatgttgggagaattacccttcagaatgtggctgctatggggacctggcatgaggatcccctccaccttagtatgtaggttccagggcctgcctgaagtacaggccatttgtaggacagtcttgagagctcgcttctcaagtgggagggagtagccttctgaccaagaccacataggaaatggaggcaggaggggactgggtttgcccttgagagcagacagcctgagcctggaggcagcatcggccgtcaggtggtgccagcctcagggaggagcatggcagactgagaggccttcatctcaagaaactgggtgttggccctggggaggcattaactgtgtgggaggctgatatctggactcagggccagaccatatctctgtttcttctgattttctgtttttttctcttgttttttgtttaataaagacttcttagtaaagacctagatttgaagcatgtgatcttagacaaatcactttctctctcctatctgctttcctcttaatagcttcctctcagcactgcactagcattacatgcagtaacagtgaccatgaagaaagccagtttgtatggagccctcgctatgtgccaaatcctagacaaagcactttaggtacattctctctacccttctccctactctgcaatgtagttcttgtccttacttccagatgcagaaactgagacccacggagatttagcagtatgcccaaggacacatggctggtaggaggtggggccagcactggagcccaggtgtgtggcccagagcctacgcagttggttagctctataccaggtgcctgggacagaagtggtgaggccacagcccaacacatgtctttctgcattggccccagctggccctggtacgtgtgatttgtatacctctttatgtctcgccccatcccattttttttttcttaatttgtaaatgccactgtgacccagctttgtgaaggggacctgtgggcaggagaagggaccctcagggggtggtaacagggtcaggcagcttggcccagctgcttctcaccctgggatcttcccgtttccaagccctggagtcaggggctctggctctggttgacctcttttccctaccctgcacctgggtttgactccacttttcctacctgtgtagacatcatgatctctgtccagggtggtgaactgcttgccgttgtgccatgtaaaggagtcacccgcattgccatggtagcgccccagccgcagcttataatactcgctctcaggttccaggcggaaactggcgtattctgcaaagactttgcggccggaccagtcctccatggtcaccaggagtttgtagttgccttggttcgtcagccagtaaatgttctccaggcccagccagtattcgccgtcaatgttcccaaacccttgctggggaaaacccaggagagtgttaatgtggagcctgcagcacctgcagccagcaggcttggctgtcagacactcagccctggatagaggggcctgggaaacaagcagagcatgaagcagacctggttcagacccctactccacctcttaatctctccatgactcacacattattcaaaaatatgtagagtgcctaccctgtgccaggcatcatgtgaaccccagattccttgttcttacatcagggaggctatattaccttccccacaggcttgctgcaggaacacgtgtgctgtggcaggtggagggcctggcactaagtaggcacgcagcaggcattcctcagacaaatctctgaccttcactgagcttcacctccttctctggagatgagctgtgtgtgagggtcacgtgtaagctgtaacgcaccagacgggtgtgagctgtgacgcatgtgtcccatccaccggcgctcccctctaggtctaaaacccagtggttttgtggttattgtttttttttgcatgtggttttggggtcagcagctgagttacggccactaaagtcttgggaatcggtgattcattaatacaataattatttagtattgagcgcttgtgatgtgctggcactgttttaagaactttacataggttgttttactaatcctcatgtcaactcgaagaactaagtgctatcattatcctccctagtatggatgaactgaggcccagagaggctcagggtctcagaatgcctgagggtgaaccaggatttgaaccaagaacccagtcttaatcattgcactgtattgcctctaagaaaggaggagtctcccgctcctaatgtaggtggaagaggagaaaaaagcagagacacaggctgttcaggaggtggggtgggggacaaccaggacaggagactcaagaaggggcatggcagagccatgtgtgcaaggcatcatggcttcaggtagtttgtgagcttcagtgtcagaggcctcagctgcagtcactactgggccaattcctggctttgcaaccctgagcaaattactccacactttcatctgtaagctgggtccataacagaacctccctcaggaggttgatacgagattaaacaaaataatgcacgaaagcccttagcatggtgctggcacgggttgggcactcagcaaacagagccactcttgccttccttagtactacctctgtttagagggggaagaacgatgtatgactgagtcctggcaactttccctgctacacagatgagcatttcaactccctgggaaccagggagcccagaggatgagcctggaattaggacttgagcattgccacaactccctaccaggactttttgggggattctcccaggaactgggagcctcttgggacttgcgccttctgggctttgagagcgggtctttccccatggaaaccccacttgggagtgaaatgctcctcacccctgggcccccataccagcgtttctaaactctcaccctgtcctgtggggctgtggtggtctggtctactgactcttgtcctgcagcagtttctagcagcaggcagaggaggcgctggtcctcactacccctggtgggtttgcaaaatggccctgtctgcatccttctcgcctcaggtatatgtgttgttggggccgcacaggcctgggcttggtcagcatgtacctctgagtgggctcttctattggttgctcaggcctctcttggggtgggccagtcaccttgtgggcagcacagacatcccctgccgagtctcaccttgtacgtctcccagttcctgaagaagttaacagagccatccaggcgtctctggatgacggtccagcccccggggtcgtgtctctggtcgcaccacacctgcatgaggcggttggtgttctccggcttcaccaggtagatggagctggtgtcgtggccatcctccagggcctgcaggcagtctctccatgggcctggggacacagacatgcatatacatcacagacctgcctgtcaccaggccgcacccccagctgcaccccaagcaggcacaacctctgttgaggctccagctgggagccacaggcccacggtctgaggtaaccaatttttgttttgcgagtttaataagtaattataaagacaagagcctcggaccaggggtcaggatgcccatactccaagctcactttctcctctcacccgcctcacagtttgacttttggcagacttcttcattctcccagcccccagtttcttctgattgtagaaggaagatcagatttccctcatatagtgttgtcaggattactgagatcatttgggggaagttgctggagtgatctttttcgtgttcattatattaggaaaaagagatgtggacctactaaacgtggcaacatcagtcagtgcctgcaggctctgatggctttgcttctgcaaggaaactcagttccactggattactgtttctgggggccaagtacagttggcacccttcaattctgactccacgtctgcccttccagtgacagtgcttcgtgatgactgctgcagcttttactaaatgaacttccacagtcacaggggcctaggccatgcccagaatttggccatgtagccagagactttgggatatttctgcaattcattcactgctcttcaagtgtgtttttagggggccaggttccctttcagctgaatctgtgtgttttccaaaggaagctcagtgagggccagatgcttggcactcacgcattctgaggtcctccttgcaggctcataaacttaaaggatgatgtccaggatacagcccaatccatggctctcttctgaaactgagaccagagggttctgtgattctttgtgactgcactgagcttgggcagcccagtcagaaggaatgggtgttataccactggtcttttagccctccccacccctgcccatcaactctgccctccccaggcagtttcttatgttccattgttggtcacatcagcaagaaggtacaaacttgagtcaccaagggtctggacaggctggggcctttctcattgatctgaggaagctttagaaggtcaaggcctagccattcagatgaaaatggctgaaagaaagaaaatcacattttgcttcagtctcttcaaaatattcctcatagggccgggcacggtggctcacgcctgtaatcccagcactttgggaggctgaggcaggcagatcacaaagtcaggagatcgagaccatcctggctaacatggtgaaaccctgtctctactaaaaatacaaaaaattagccgtgtgtggtggcacgcacctgtgatcccagctacccgggagggtgaggcaggagaatcccttgaatccaggaggtggaggttgcagtgagctgagatggccccactgcactccagcctgagtggcagagcaagacaagactccgtctcaaaaaaataaataaataaaaatccccacaatgagactggttaaggacaaaagtgctaagaaagtaccattgtatgttttctatcaatttgtatgtttattcaacaactgtgtattgagtcccagcctctgcagatgcggtgctgggcagcggaagctcagggcagggtggggccgctctgacgccctgcaagggaggagctgacctcactacctcctccccacttgaattcctgtagactcctgtcctttctctttctgtgtgagttgaagggaggtgcccatcagtgacaggtatactcagcttttctggtacaggtcacacttctcagattccttcctggctggtgtttgggctcaactagttcacacgtaatagttataaaccagaaagatttaggtttctggtctctgttagacatctcaggtgggctgttcctgaggaagaagccttgtgtttgagcattcatccacctagaacctgacgggaaggcaggggctgtcttgctcattccttgcttcccactgcccagtattgccccgataagaaagattggtttgggtgctgacacttaactcaggggcttctcccttcatcttctggggaggaaggatcttctcacccatttacctttttgccaggcctcttctctaagggatggggcaggacccaatgctccccaccccagggtagcagatggggcacaagcagctgcttcctttgccagtgccacttcctgcctttcccccaccactccctcagtatccttcccagggaaggggaggctagacctccagaaagagcatttgtgaaggagaaaaaggttttggttgtgtttagctgaagccccagggatggaggcagagaatgggagtctgtccccaacagctggagcagagcgccggtgggcgtgggaggcctcccagctccttaccaagtcagcagcacaggagaggccgttcgatgtgaatgctggtgacggaagatccggcagaagcctgcaaaataacgcccactgagagcgagcagcccagcctcttactgcacagctgccaggactgctgcagaattgtcagaggtaaaggctgcctttgaaggaggcgccacgtagggagaggctgtggaggctgctgggagagtggcagttggcctcgtggctccagctggggctgcctttgtgggcgccatgaatgatctcagttttacctttggcatttccaccaagggctctttttaaaggcaagtgtttttaaatgttttggggctactagtccctttaagaatttggggatggttctagatcctttattcagaaaaatgcacagactcacacaattctgtatacagtttcagaaggtaatggattcccaaagtcccaggttataaactccttgctctaagagtagtgactgaagtagtaataataatagccagtgtgtactgagcatttcctatggtcctagccacgtatttccacaggtgaccctcctgacactcctgtgaggtaggaaagcagaccctgtggtcattagaggagcccctcaaggttacctggtgggtaaaggacacagcaggtgtatgcacccagggggtgtgcagagctcacacactacttcttttcccccaaccagaacgaactcaagaatgagggatccatgctgacttagctctgtgtccttagaactaatgttaatctttgccagtcagccagcgaaaaaaataaaacataaaaatttacagttctttgtcgaggtgtaaaacttttaaaaatctttaatgatttttttcttccgtatttaccttttggtgttctttgcccatttttcaacgattgtagtgtctgttatgatgtagaagaagtttttctttttttaaaaaaggcaaacggggtaattcttttaaggctttctagaataatcgagtaggtatcaaattgtgtagaaatgtttagtattttctgctgttacaaaaaatgtgcatatgtgtctgtacacggaatttcacatgacaatcaggccccattagcttccatcaaaaacacaaattcaaacacaatttcccttagaacccttagtagacctctgtgaaatctcctgcattcaaacacatttccttttcacacattaaaggcaccagtggcaaaggtcagaaacatcactgatggatgaaaattagtcagaaaaagagttaacattgaaaaattgtcagcagtaaaattatgtggctcctttaaaatagcagagacaaaacatcctactttgatgagaaatccacaactgtaacatataaataatactgtgaaaaatctatagctgttccatataaataatgccctcgtagggggccaggcaagggtctggcctcgatggaggaagacctggctgaggaagcgagggctggagggagactccacacttggagtcaggagcccttggctccaatctcgatggcctcacctatgcacagtgtgactttgggcagtgtcctcattgagcctcaatttcttcttctgtgaaatgggaagagaccatagctattctgaggatgtcatgaacccaagagcggccagcatgggagccagctggggcaggtgctctgtgaagattatccctttctgtttcctttgatagatgaaagctgacatttttgaagttgttcacccccccaactaattcctcctccacacacgttactatatttgcttttcaatacaagactaaatgtaagatatttaccagtagatgttttccatgtatttttaagtcagaatttcagtggagaaggccacaaagatatattgacatgaagaatggaaatcttttttgtcaatgaaactgagttttcaacgtgcagtgggcaaagcgctccctttggaccagtgcagagtacctagcggtgtttaacttggcgccccttctgagagggcagctctgcccagagcatcaggccaacactaactcggcagcacctgggctcagagtggagcgagtgctgcgacctcatctctataaagaccacatttacattcttgggggagctgtggccaaatgttccacgtgaagagaaatgcagccccgtggctgagccgagtctgtgtggttccctgaagaagcaacaaggatgggtaggcacacagggtctggggtcaggaggcctccagaggagggacatcagcaagtaggggagtaccaagtacacaggtctcagcccggaccccactgccataccctggtaagtgttggaggtgatcagctttgggtgcttccttcctcctctctggggttcttgacagggattaggcacacaaggaccatggcctcccaggaaaccaggacccacttgattgatggctgatacagtgcttgctactcccaacacagggcctttctggtcaagctgagttagaaccggcacctaggccaggcaagcataacttcctatttccagttctctctctgtgggtctggggcagaccagcatcagcctgatttacccgtccaggccctagtggagaaatgggctcacaaactgcatcagctctcagtgcagtgcccctcttactaggaaaacatggctccgtgaatatctgaccttgaggctgggagctaagcagtgaggcctccgtgggcaagagggatgcctcttctctctgacgtgcctgaggtgtggggggaggagcagagtccttcctgcccacagcgggactggaccccatggctggccagcagcctgacagtcctttttatcccctgagtccagccccaggtgtcagaatttgaccaccttaggccactcagaggaccctgtggcctgtgggaaatgttctggggggctcttggttctgggaagttgctcctgtgaatattttagtccatacgcaggcactagggagaggcttctgtgatatcactaagatgcagtctgcttttcatgagaactgtatgctgttttcagttactctcactgatggtctgtctccaaaaagtcttcttaccactccctgaaacatttttctaacaggagaaatgactaactgttgaaattggatctgcaatttcctacccaaattaatgcatctgagtgccacggcacgtggcctgcttaggtgagagtcccacccaggccagcatcaggactcactgggcaccccatgagggcaggagaacagacacacagggtcgggggatggggtgtgaggggtggctacagtgagaagcagttattgggggtcttcgaatctcatttatccagaggcttggcaaaataagattctggttatggatgtatatatattctatgtcaatcactgcttttcagcgaaccagagtacaaaacaataacctaaacacaggaatagcttgtatggtcccaaaggcatttcagttcctgcagaacctcagagttgatatcacacatgtcatttctgatcattccagggaaaaggtccaaatgcttgtgcctgctttcaggccgctttagccctcaaacgatgggcatggtgcctggggccaatgagtgtttcaggagttgatgaaaatgtttgaggcctaaaaagacttactggctctaaaatatgaaaagaaaactgcaaaatcaaaatttattgtatgtaattaaattactacaaagtgtgacatcttgtcaagttcattaattgttaaattttgtcttcatgaaaatgttactacttttgaaaacaacttgtaggttagatttttttcacttcccaagaattcctgaatatgcttgatgtttactgagaaatgagatccaaccataaattaattgagttactcttagccaaataattttaaaagcaaaagtattaaatcctttcaaaattgttccagtaaaaattctattaaatgtgtgaggtaggtcatttcaatgcatgtgatacagcctgaggcctctcaagtaagagctcttagggcccagaaagggcttataaaggtcctgtttctgctcatttgacctcgggagaaacagacattgcagcactactttccagaggccactgtccaaagcattgcgtcgctcttaggtttccaccagcgctgttgggcaggaggagaaacaggggctttaaagacattttaaaaaagagtttagaaggggctttagtggtctcactgtgtacagaggtgagcagctcaccttggctccctgggggcagtggccagttgtacccaaggcttcctgggtgagggaggtctctgatgtagaggtgggcagtgccccagggttccacaggcacactaatgagagtggccatggctctgtcagagactgtggtgctgtcctgcaggcacatcatggaagaacttatcagacccatgactacaatccacagatatggacaggtagcagtcccatagttggcgagtgtattaaccctttccaaggaagggatcagcttcattggtttcttctttaagaacctatgtcggctttcattggtgaccttttaatcttccaaatgctcacgaaccctttgtgtactcttttctataattttactggggcttcaccacaagccagttgtatgtgatttctggtatgcattctttttctgaaagcaggacatttgtctggcaccaagacttgtcttcatgatttcttgactatcactggtggtggttctgagagcaccacaaggcccttaccttcctcatcacctccttcaggaagctttccccaaccccaggaaagctactttatccttttcagtgttcccaaaatgctttgtatatttatctctactggaataaggtaagaatggtgatgatcatgtatctagagcctttcacctgccatgtgctttgcacaccgtttcatttcatcctcataagcccctgcacctgtgagaaagccagggctcaagaggatcacatgactggaaagtggaggatctgggattagaactcaggtccaccttctgtgctgcagttatcacaccacattaggattgttggggatctgtgtccccataagactgtgggctcctttcaggcaggaacccttgcaggctcactccatgagtccctcaatgctctgtgtgcctccctccatccttcaatcctctatccttgaccctccatccttcaccctccatccttcaccatcctgagctgcatcccctttgctaccttcattctgtgctttccagctgagaaccaataataataaatccatctggaaagagagaccccacaacagatgataatccacatccagaccaaaccctggcaaaggaaacctgctttgtgggaaagcctggacagtttgtagtggtctctctgcacattatgtctgggatggtgccagatgagtggattttttgttcatttggaccctactctagacataccatctaagatacttaatttcaacatttaggagctgttgcatttataacgtaaacaaattgtcttagcaagatttttctctgtgtgtatagtagttttgacttactgtattcaaaaatatcagggaaaagtaacttatttttttttaaacaaaggatcacataaatactccaggccctgtagttccacaggctcatcttgagatataagatgaggaccatcaggcttattttcagcataatctttgaccagattcatgccagggagagccgaagttgaggcagtggtgatgcggggatagtaggaaagatcatctccagtgttcccatcaagaggtctctgctgcctgcatccttcactgatgtgggtataaaccactggaagtatatacttcattacttttacaagactgaacatagtccattttctgctgctataacagaatagcatagactgggtaatttataaagaaaggaagtttatttggctcacagttatggaggctgagaagtccaggagcatggtgccagcatttgtatgaggctaacttaatactactttatttattttttttgtgggggtgggggtggagggggacagcatctcaggattaatactatacaagttcaccacaacaatccatttgtatgaccagttagctggccacagatgcctgatctctagggttttctagatttctttcagtttgccaagtaccaatcttgggattttcaggcatcaagatcccagatctcaagatttttttaacagtaacaagttgatagtttatctcctatgactgtaaataccctgagcatttagccaagtgtcatctttggaaaactgcctgaggaatggaggggtagctttccatcaccctcaaaaggctctttgtgatcagttccccaaggtaccagaagaggaggaagagaaagcaaagcaataagggagctggccctcctggaaccatcatccaggtgggccatcttcctagagtagattttgtttaggaagaagctagcaaagagtgctctttgagaaatcactggattatgtagtttgtactgaatttgaaatcttattttgtttaacaaaaccttttagaataaaagaaagtattgtacagtggaaacagcacacgctctggaggcaggagacctgtgtgggcttttccctcagcctctgtgaccttgaaggctgactcaggatgggcagagtcaccctcactcgccaccatcaccacacacaccctgtgcttctccacctctctgcagtgcttgggcctggatgcccagcctactgaagctgacccagccacacatgggttgacaccttttcacctggttgcttgcttgacctccagaaagaatgggagctacaacatcatatatttctctgttttaaaacataccattgtgctggggaaccacaatcgtgtacgtatttcctaccttatagggtggaataaaatacaggtggaaaatccatctaggaaaacactcttgttcaagttgtccatgccatcctggccatagcccaatagcccatctgttgtgagatggggtggcttcctgctagcactcttgtcagtgaagcaatgtggggacctcctcatgtggtcccaagggaaggtcatgtctactgacatttatacagtcagggctaacatttaaagaaatcagaacttcacacttagctatatgttgaaagacttagctatacattgaaatgctgagtagaaggaaccccagaggatatgtccagatttgataaaaattaaaaattagacttcagttgggtccatttgctgggagtcaggtgcacgttgtactttctactggggagcttggctggttcctgctaggcctagggagggggagcatgatgttggtgggttggtagcgacagtgttttgtgtcattggaaccatgttctaataacaaatctaccacctttgttcccagagctcattttaaggaactgtttggaacgtggtaccaggaagtagagctagaaggtcaggaagtagagatagaaggtcaggtccctgtggcagctggggccaaatcagacattcacggggtgatttttacaccagttcccctccagccttcccgtggaagtgtgcaatatccagagtagttaaaacatactttggtttgagccttggccaagccacttactagctgtgtacccttggctaagttacttgacctctatgaacctcaatatcctgcaaggtacaagtcccagggtcgatctctgctctgccaccaacaggctctgttacaggaaggccatgctaggggatctgagaggcccctaatagttccagtatttcatggttttatggccccttcttcttcactcattgagaaataaagtgaactggttgtattctctttctcaggagagaaaacagctaaaagtgctcactccttttggtctttaaagattagtttctgacaaagcccgtctgtggcagctgctgttggcgctgtcctttcctccctgatcagtctctgggatgggcactgtgcaggagggctggcaaatgtgtggctctgccttgggtggcctgagaaacagtaccaggcctcccagaacccaggtgcctgctctatcctttgcctcttagagaatgacccctggagccttcctcttctaatagcagcagcaggataggtggggcagaggaccacagatagggccatttggcccaggcctcatcacagaatcatcctaatcaaaatgcctttgggtctggccagacctgagagacacaggacaaagcccaggtgaggagccagggaagccaggagctgcctgtgcctcctcactcaggctctcagtaggccatcctggcctgggaccaccctgttactgtctcagtaaggctgggaacaggcttgtggtacagcttcagataagcagccatggctcccttagtcccctggggaagggcatgctgtgggcagacgaagaaaagagcacatggctctgaggctgctgagtgaaaggtttggaagctgccaaggctcggatgcaaaggtgtttaattgcaaaggtatttctggctaagtgatgtccctaagaacaaaggatctgttgggtaagagcacagaagagtgttttgtcttccaggataagaacctgccccaagctctctgaacagacctgataagaatgttctctgctcattggatgccctgactgttccgtgcagagagaccatctgttttttcctcccagtttagtcctcaacaccaggagagggcaggaccctcccccagctgctctcttcctgggctctgtctacccattcatcttccacagctaggcactcaatcccagctggcagcgccttgtgtgggagctcagtggtgagatgggtcacaagaaatctactggtaatgagcaagtaccaacatttggggatccttgcgtaacaaagaaggataaattctaatgcattccagttatctctgtgatgaaatcactgccattccctcccatgacggcgtgctttcttaagtgggagacaaaagacgggcgagtgcaggacacttggatacacacagcccacactgggttgtgaacacaaagaagcaggagattgaaccatttgaggtgccaggaatagaactgtgcccctgggcccttgcacagactcatctccatcagggacccactagtcacttgggttcccaactcccaggtctgcctggtaaaatcttacaaatccttcaagatgcaacaaagaagtgccacgtctatctaatctctcccttccctctaggcagaattagtcatgccaccttactgtcccccagggcacttagcacaccagggtatcaccacagtgatcagacagcccagttttcactgcattcctgattttagaaattttggcctcgacggatactccctcccagagaaatccattgtcagatctgatgtgctgatgttagggactagaaatcatgggcattggacggatcccagatgcattcatgcacctgccgtctaccccagactgagtttctggaggtcagggaccacaattgtcacctacttccccaagtctagtgctgcgactagcatgtagtaggggctcagcaaatgttggctttactacatgacataatgtttcatgcttgattgtattgtatccacagcataacactgtgaggttatgacccttgtccccattttacagaggagaaaattgaggctcagaagagttaaataactatctcatgagcgaacagctaaccaaggggtagagcatggatgcaaacccaggtcttattcctatactatgtatctgccagcttagttcaagcccaggaatgtcctgaaatgttttgagttagaaaccagagacacttaggccagaggagatctgttgagtaaccattgagtccagcctgtctccagtcagggttataacaacattcaactgagcctttgtttggtgcccaagggcacgttttaccctctcggtattctatcaagacaaattaacacaccctgccctctctttcagagcttctgatttaaagcagacacgtgtacagatggaacgccagagctaaaaaagggactgtttatttcagtctccttgttttaagatgaaaagacctagatcaaaggaggcttgtagtttaccgtggacccagcattgtgctaaacatgttttttgcagtatttcgtttcctaaagtgacaggcactattttaatctatcctcaattaacagatgaggaaaccgagcctcagggggacaaagtgacttgcctaatgtcccagagctaatcagtggtggaaaccggatttaaatccaagccagcctactccaaagcgcctgctctcaatcctgcacccaggccaggtctttcctttgaggtgctgcagtggatgctcactttgcatttagctcacctcacccaccccatctgaaaacaatgctgcccttgtcctctgcactggccaccctcctgcactcaggttcagcccctctttggaattagcaagaagctgctattcccagtactggtggttatttttaaaagtgtgaaataagtgtaaagcaggatattttcagtaaaaatctctccctgcctatacaatgaaatggtaccgaaagcactgacttggagtagatacatggttcatttatgcagagatgaatatagttctcatatggcagcccactgggaaggctcaggtgttctggatgaacaaggggctgagcttcaggggactggatgtgtgctgacattctgacaggggagcctctggcctgcttcttccagaaatgatgattcctagagtcctagagcatagagaagtcagccagagatttaaagtgaaaagacctgaatgcaaatctagcctgaacatcctaagcctattagcaagttattcatcctgtccgcaaggagctccaggagttaattatgtaacatacatggaaatgtccggtgccagtatcttggttaagctttaaaacctgccagcaatcccattcctcccccataacggtattcggagaattgctgtattttaagatgaaacgtgtatgtaagagcatatggaagcatcattgaaaattctagacagcagcagactctaggaagtgtgtgggctttaggaaggactccttcccatgcccagcccctacaatgtgtttatcatattcttaacatgggtaatactttcttttcttttggcccattgtttatttggtgaacatttacagaaggccaaccctgtgccaggcacagtgcatgagctgcaggagagacattctcttctatctgccaacacacgggatctcatgcagagcctagaaaactacaggctctgggttctttcctgtcagaaaccagagagtgtttgccctcttctgaaactccattttttggtaatatctttgaggatccatctaaggaatgtggttcccctgccacccgtcaccctgctggctccagcagctcagcccaagggattgctgggggattgtgcatgtctttggcctggcttcaactggccatggcttttccccatttgtggacacagccaagggaagcctggtgcctggctctgagacccacatgtaacacgatcccagaagcacttacccgacggcttgtcggtggaagatgggaggctggtgagagtgggcatagtgggcagagggggtggcagcaccttcaggttctggtcactctggatctcgttggtagagatctggttgatgatgcggttgtaggtgggtggttggtagacccggggcggggcagcggggggtggctgggggacgggcctggccgagggcaccctctggcagtgctcctcaagctgcgcgatgatctctgattggttgtgggccagtgtggccaggtgctggtacttgtgctccaggtccttgtacttgctggccagctgcagcatgtcggctgtctggttcaggatcctgttctccagctgggagagctccaacgcgttgtcccgcttgcggatgatctcgtgcaggagctgcatgtagagctgcgtgacccgcgagttcatgttgcggctctccttgcgcagcagcttcacctcgctcacaatgccgccgtccacctccaccagctgctgcagcgtctcgatctgccgcttctgcttgagcagctcattgttgagcagctctagctcctgcttatgcactcggttctccagaagcacctcaggctccttggagttgacgcagatggcacccgtgacccgctgctggggcacaatgaaggtgtaggtgcacttgtcctgggactcgcccgcccgcttgtacctgtttaggtaaatgaactctcttggcgagccctcctcagtgccctcaaaaccgtcctcctggcctgcaacagctcccatggcagccagcagtccgagccaccagcatgtcacgcacagtggcctcatggtccttgcaaaatggtggttattctttgtgaatagaatctatgaaagcctgaaagtaaacagaggggagaatcagtgatggtcccaccactgtcagtgccctgtgccatcagtgatcccagccttctcgccaggcaggcagagctttccaaaaactctgcttcaggatgctgggttatattctcttggagtcagagaacaggcagccattctggaagcaagaggagacaggcaagccccagcagaggtagaagggaagagggagggtctcagggcatctgaaggcaggaggccatggccctgctactcccagagccagctccaatgcccgcagcccccttgctgaactcctggcctagagcctgagaatcgtatccaggcagcttcaggctggggaggggaggcagagggagggttttctggtctctctcttctgctacctttggttcctcagactgttgagtctccctattctatactttcacaccccctgaactttccccttgtaatacccatcaccgctgtgctgaatagcagttctgtttgatcttctctgttggattctaactccatgagggcatgtcgtctgtctgattcaaccctgtattcccaggatattgcactttgggcaaatatttgataaacaaatgaatcgttagacatgttatggaatacattcagggtttagtggacaatatcagtggaaggatgtgtccagttacgtggctctggtcactgtgttagctaagctacagagccaaaacaggaacaaacaactgagctcttctgaatccaaatatttgcagtagccagtgacagcacagtcctgaccactgcaacgtgattaagttagaagggagcagaacacagaatgtgtctccagatttgcttcacttctattcttggaccattcatcctttcaccagatgttgattgaacacctgtgatttgctggacagcatgctagtggctagggatacagctaccaacaggatggagccagtccctgccctcatggggctttcacatcattatgccattcccaaatgccagaaagcacaactgtcacatgctgtaaaggagtattacagggaattgacctagagggtcaggaatgcttccctgagaaagtgccctttacactgacccttgaggaatgagtaggagttaaatgggccaagagggaggggaggacacgtgctagatcccttctcttgcccactcgagggccttgctccagcagtcctcaccgtctccccaacatcaggatggttttcctataatcatacggttttttctctcaacttaaaaccctctcttgacctcacatcccctctgcagctcttgttgcatttctctgctcccctttttagcaaagcctccaaagagatgcctgcactcaccatttccagaaagttcctctcttcctggtctctcttgagcccaccctcatcaggctttgcccgctccccttcattctaggttgccctagacaggatcccctgtctgtttgccagatggaagggctggttcttgatcctcattaatattttccctctcacactgtgggatacagttgggctcccttcttgaccttcctttccagagcgccaccctgcctcctgtcttgccggctgttcctcctcagagcctgtgctggttcatcctcatattcctgtcctttctctactgttgaggggacccaaaactcagtcctcagaattttctttaccttagtcatctcatccagaggtcacgttggtgatcaccctcaagtactgattacatccgcatttatttctggaactctccccaggactctagactcatacatacagctgcttttttgacatttccacttgactatctgctaggtatctcaactcatccagaaatgaactcgtttttccccgtatctccaacccaacctgttcatcccagtttttcctgtgttcataaatgtccactctggttgctcaggccgaaagtcttgaagtcatcctagacgcctttctttctttcataccccacatctaattcaccgccaaattacgatgccagaaatattcttagagtcctgtgtctccccacctccctgccaccaccctgttgcaacccacctgcatcatttacctggactattggagtaatttcctaactagcctccctgccccagccttgcccatcctaccttctgtcctcaacttcacagccagagtggtcctttttaaaaagtcaaacggggtcactcttctattcaaaaccccccagtggctcaccatcttggaggaaaagctagtgggtctccaaggcactctatgatctggcccccacttcctccctggtctcatctctgacccctctcccctacgatcatctcctccaaccacctggttgaccttttggttgtctgtcaagtgttctaagcacagttaggactcagggcctttatacttgctggtccctgcccccttcttcgttgtttgttcccttacctctttcaatctttgctgaaataccaccttctcagttagaccctccctgctgatttaagattgtgacctcaccacattccccctccagtgtccttatcaccataagatacacgctgtctcctccccgttcccttgaatgcaagctgcatgatggtagggaggtgtttgtgttggtcactgctccatgtgcagtgcctaccacgtggcctgaaatacataggagctcaataaatatttgttgatggaatgacaagacacacctgccaacagctgctgagcagctgggagtgctggaaagagggatagattggggcagggatcccatggacaagtgactgcctgaggaggtcagagctgcgcagaggagggcctatgtgtgtatttattaataacatccattgaccaaggtccgctatatacctgaccctggactaaacattttgcaagtgttttccagtttcccgtgttctcataatctccttttaaggtagatactgttgctgtttacattttacaggtgaggaaactgagactcagtgaggctgagtgacttgcccaaaatcagaaagctagaaggtggcagaaccagggctcaaccctggtctgctggattggaacctgctaactcttaacgatgacacaggcatgtatttaatctggtttttactagtaaaagggtattagcatcactactttctgatttcacattaatctgtgctaaaataacaagtatgacacaggacctaaagattttgtcctccctgaacccctttgggggcttctccagtgaggaccctgggtctgggctccaccttggaccagccagtgagcagttacaaaagagaccctgtgctccctggggccttgctgagctgttttccacttaaatgacaaagcccaagcatgattcctatggcctgctcaggcctctctgaggctaggcagagaaaggtgtgtgggagcttctggtttgggctctgctaggaggtggggctgcagtgacgtcagtggaaacccagctgagtttggaagtgtttgcctcgtttccaacggtgctttggctgcccctgtgctagtggtcacacccaccccagaacaatggggaggagccgcccccgaccctgggctagggcaggcctgctgggccaacgccttcttcaggctgctcacctgaggcagtgggtgacagacacctctctgtgcccatgtgggcgcagggctccactgtggccaagaaactgccagaggcccaggaggcaacctggctgcaagacaaggttggtttccaagccttcctggacctccagatttgatttgcactatttatggttgagttctatcctctcccaaacatgggctctcacagctccccgacagagttcttgccattgcacttgagacctcaaaggctgagtcttttctgtgaaatgggatgatccaacccaccttgcacactaggtgagcagcatggaagtgcatcagaagcgggagattggaataatgtgttagcaatacgatagcaagaacaacaaagctgaaacaaaaccaacaacagtgaggatgctgggtgtgggccaggcagtgtgccaagcactcacaccatctccttgactaatgcttgcacagggctttagggcttccagacccttcacatcaacattctctcatctaatcattccaacactcagagtgacttactagtgttatgcccatttctaggctgaggaaactgaagctcaaaaaggtgtaggggtagctgactttgaggtcatgttgcgagcagtgggacctcttgtaactacattgattctgagtcctactgttacacctctgtggggcctaggcttagtgggggtgactcagaactgattgggttacaggaaggaagggaaggaacagggcactgtgctgggcgcctgacatacattgtcccaggtaatccggtgggttgttattcacccctgttttatcaacggagacattgcaacccaaacaggctcagtgatttgcccaggaacacacggcagataacagccaaaggtgactgagcctaggacttgggtcaacctgataccaagggccatgctccttgggcttctctttgagcctcagagtcatttattttccttggagtccaagactccaaccccaattcctcccctccccccagcagttttttgccagtttggcggctcttaatgggcagtaataagtttgtttacttttgctctcttgatatttattcaactcattgtatctcaagagaagtaacaccccccacccccaccccggcattccagccatcttaggactgaagaagaactcaactccaatcaaagtgatgctcctcacttttttcctgtgtccaacaaagaaaagcaaatccaactgttttccttggcttcagaattaaaataaaaacgattcttaaaattgcttttccacattgtattgtgaggagtttccatcacgcatgggttttccctccccacaagtgaggctggtgtgactgtgccacgtgacagcctttgtacactgggaggcagcctctccagggcttgggtcccacccagtctccggtgggctgcctctgaatgtccccgcttggcctgatgtggtggggccacacatcatgtgtccgcatccctctcaccactgtggtgccacagcccaagcaaggggccactttgtgggaagagctgtcattttcatcagatggagctgtgtgttctgccctgcagcagaagctgccggcctgggatcctcttttgagttcaccccaaaggttagaaatgagaaaagttccagcaattaaaagaataacaacaataaattgtcactatggctcaagcactttatatacattatctcacttaatcttcccaacagccctcggaaggcggcctgttatttgagggccgccatgcatggtggccccacttgagcactgtgctactctaggggacacaactcacattcatagtctttatgttttttatatttatattgtagcaattttctgatgcccacaaagatacttttaaggctaacagcaaagctgacatttatccctatttgcagttgaggaaactattgagatttgaggatcgtgagtcatttgcccaaatcacaaattaataagtagtagagccactaacagatcccaaaataacccccaaagataccatactgtgaataaagagaaaccaaagtgccaaagtgactggaaacccaaaagaggttgttctctgaccctctaggcaggacgacgacaggagtgctcttgccgtcattaggcctgcagatcccagggaagcctccaaattaaatccggatctcaggagttgattcatcatcagtccaggttgtagtcctgcctggaggacttacagaaccaccccctcaccacccgtcctctggtcagcactgcccattggtctgtgatcacagatgaaggccaataatgggtccacgccataagaggcatcccagcactgcaggaggcctgagaagcgggcctctgccaaggcagtcagggaatctggaactgccagctggcccctgacgtcggggttctgggaagctagaagcctgagctgtgcttgagtgagtctggtggacctgagcatgaatcaagtttgtgaaactatcatcaggacagaagacagatgaaaacatcaacattagctagcaggtgttcctactaagctgttgaaatgtatggtgtgctggtagggaagtatccaaaccagttggtaatccaagatgtgggagggatccagatgaaggaaaaggcccagctgatcaggtgaccagtagtattgctaataatggctgtcgtttgttgtgaatttgggtgcccagctgtactctatctcattggctcttaatagctctatgagtaggggaccatacatcctggttggccccagttgaggtctgttgtcttacgtaattattattattattattattattttgagatggagtttcgctcttgtcacccaggctggagtgcaatggcaccatctcagctcactgcaacctctgcctcccgctttcaagcagttctcctgcctcaacctcctgagcagctaggattacaggtgcctgtcaccacacctggctaatttttgtatttttagtagagacagggtttcgccatgctggttgcggtcttatgtagttattaatagcacccccttttcactctcaatattgtcctgactgagcaacaaactatatgatcccattacctaagagaaaggtattatatctgcatttggcagtagaggaaacccaagtctagaaaggttaggtcgcttgttcaagatcacttggaagtaaatatcacaactgggatttagctgtcaactgctaggtccaaaccctgccttgcatcaagattgtctcttcaaccagtatgaataaaaggtgcttgtttgtttaatggctgagatgcagcttgcatgttactcactgttgactgaataagtagaaatagctttcaggtcagcacaagggtgtgttttgttggatgttggaaagagctgcttgatcacgcaagtggtaagaccccaaaatgggcatctgggatgagcagtgacaccctcaccttggagaacctggtgaaaggactgtgcattgtttgtcctggatgattcaccatcagcccggaggccagggagggcatatccagatctccagctgccctcccctcctggctgaggatgctatgaatgattccccaccagaaggcacctggggagtctggagtcaattcccaaacccttctagttcagctctcataagaccattgaatgaaccatttatccatccatccagccctccatcacccacccatttagccttcccatgcagctagccattgtgcattgctactacctgtcatgggtgatgggagccatgagtcagagaagcagggtaagacagatttgcctggaggagtagcactgggggttcgaatctgcctgatgctttgggctcttgtgctcctgccattggtgaattgctggctccaggaagagttcatggaggaggcgggttgtggtcacaccatgagatcatagggtagagggggatgtggttagggagtgggggagctggttgccttttccgggggacaaggacactgctgttactttttcacagtgcgttatttgggaaccattttgagattcccccaaagtctgtgcactgaggcctctgtgccaggagccttggccaacagagcagaggcggggaagagtctgcagaagccatttcagagtccagcttctgagttggctgctgcatttccggcagtgcctagtgtgctctggagccctacaactgggaaagccctagacaagagggagaagtcaagggctgggtggacagcactgccccagggtgactttcttgggaagtccaggccttgcctggggctgcttttctggaccaggctgagaagttggcaccagggccaccttggctgtttggatggacttgttcctcaaacactgggacaaccaatgtttgtgtctgcctcactgatcccggtagctctttgaggcaggggctatgactatcctcatttcacagatgagcaaacaaaggtaagggatgaagccacttgtccaggggcacagtgctaccaagtggtggagctgggcccagtaacagatttgtctaacccagggccaggtttcttacccacacaatcctaattggcctccctgcctttgggtgctctctcccctgcagtctacactgcatgcagctccagggctgtctgtctgacacccacatctgatcatgtcagcgtcctgcttaaaaacagaccttgtgttgtcatgcctccctgcctttgcatgtgctgtgcttcctgcctcgagtaccttcccccactgtcctggctgatgcctgcctgtcttcctaagttgacctcaccatgaagccatccattcagtgaggtcttccctccctccttcagctcacaagtgcagctgtggctgcttccaactcaacacccaagactcagattgcagtcatctggttatctccctcctgactacagcttctttaaaaagcagggccagggcagattcctcctctgactactgagtatccaggatggcacctaggttactaaataggaattcaagaacttcatttgtataatgtatttcccaataagttctcctcttccagccactgtgccagcggctggaggtagaacaggaacaaggtgggtgaggtccttaccctcaaggggtccacggtagtaggtgagacagagactaggcatttgtaatgcaaagagatccatgcccagatagggaaacttggggggctgtggggcacctgacctagcctcagaaaagcccttggctggacaacagagagaggaatggtgtggcaccctggggtagagaagcttgtttgcttgagagcctgggcctgaggcttgcttcattgattcattcattccacagatatcttttctacctggccctgagtgggtattagagattcggcagtaactgagacagacacagcctttccctcatggaggttggagtgggaccacctcaggcaggactttaaggattcttggagctgggcaggtcctcaggcatctcttgaagataagaacagagtccattctgggcttttccttggtggtcttggtactgcctgtctggacaactaggcagcagggggttgctgaggctctggggctgctggccccagacaggctgatttcagcagagaatggactgacacaatagttcagttgtgagaggcctggctccccacacccaacattttattttttatttttgagatggagtcttgctctatcaccagactggagtgcagtggcgcgatctcagctcactgcaacctccgcctcccgggttcaagggattctcctgccacacccaacattttaacattcctgggaccaaaatgtggcttgtgattgatgtgtacatgtgacaggccatcgtaacgttgtaacccccaacactgttatgaactcagtcatatggctcacagtccatgtgaaagaacacagttttgtcatagaaactacccccagaatgaggcttctgacgtgaccagtgtatcaccacaaactccaagctgcctgtggctgaataactcttctatttggggtgttttatataaattcacaaaaaagaaatgctattcaatgaattgattctttcttgagatttccacagtgtggttgtccaggatggcagcaggctggggtggaaccagcacaggtctgggtttcaatctttgctttttggcccatgcatggagagaccgtgggagaggtgctgcaccctgacccccagtttccacttctgtaagacggggacagcaccacccaccttgaggaccctcttagctccttgtgccacctctttacagctttcacacagttgtgtgtttgtgtgattatttactgtctgcccagtcctgctgggctgtgggctctatgaagcagagcccctcccccatctgcctgctgtcagttgagaccattccagattaaatgggctgtgattcagagaggccagttgctgaatgtacctgctttggcagggctgctgtctgttatgtttgttctattgtagctacccattgccatctccctgatgttttctcagaaattgctcgtgtgtggcccagtgtgggtgatgaggacctgagctctgattcttcagtcctaaaggagcctccaagtacggatgtagaaagcgcatcaatagtatcttagtcacatggaccagtgtttccctgaggctctgcccccactgagctggggacagagtttcctggtgctgatgtggtgagacagtatcgcagagcacccaggcacgtggaacaagtcagccaacctggtttcgaagctcagttcctcttgtcactgaccatattaccacataacaggtaccctcataactgtgctgaggctcatctctaagagtaacagtcatgcctattttgcctcagaagtaggcttccatgaagagcaagggatgcgctaaagttgagtaagtccatggttttcagaggggttggtgcagcattcgataggacagcaaccaaagcagatgtggctactgacgacactgggcagggacccagtgacagtcaggataagagaagttgaggtgtctaaacaaggcactgaagtgagaggaagtcaggggctttggagccagacagagctgggttccagtcccacataatcacataactgtgtgactttgggcaagttaacctctcgagacttagttttcccatctgtaaaatgggatgctaaaactagaacctaccttctagggttgtggtgaggatgaaatgacataatgtatatgccttatttagcccagtgggtacttcctaaatcactgggggatggagggccagatggaggaacagcttatttgctctgcccgtgagcttcagcaataacatgtagtcccctgctggaccatgtgcgttacacatttttgtctgttccacccagactgcctcattagtagtaagtagtcccattttttttgccaagctcatgaagtcagtcagagcctctgctcatcctaagctgcccagagaagacagtgagccaccatggttccaggctggagcagggaaacctgtggcttcagtagccccagaggccttgtgctagagaagcaaatacttgatgtcaccttttcaaaatgcttccaagcgtgcagggagcccactggaacctcagggggccacagcacagaagctcctctcctgggctaagatgtatcagtgttgtctggtgtaagatccaccagacatggccaccatagtgccagacttggtgatggccattccttgcctcttcctctgcaactccggggcaaacctgactatggatcctcctgattttgtgagcttcccacagcactaaggtagctgcattttcttatccactatggttctgctggggagatcaataggcagacaggcagtgcccatgtgggaagcaggatgcccttcctcctgtaaggttggtattagatccttttgttaatatgtctgcactttttcttagtatggacttctaggatgcaggcatgctgcaggtggccccaaacccaaaccccagacataaagcccccctctcctcaggctcctggaaagccctccagtgtgggcagtgatagtagccacagtattatctctgtctcgtgggattttctgaaaaccctagcaggatatgtccagaacagggaaagaatttgggtctctggccgggtgcagtggctcacgcctgcaatcccagcacttcgggaggccgaggtgggcggatcacgaggtcaggagatcgagaccatcctggctaacgtggtgaaacccgtctctactgaaaatacacacacacaaaattagctgggcgtggtggtgggcacctgtagccccagctactcgggaggctgaggcaggagaatggcgtgaacccagcaggcggagtttgcagtgagccgagatcatgccactgcactccagcctgggtgacagagcgagactccatctcaaaaaaaaaaaaaaagaattcgtgtctctgctcttcccttccctctgtgccagtcctgattgttgtggtttgtaatcatcagtgaccaaggtttgctcagggtttgctgtgcaccaggcactaagccaaggccttcctaggcatgggcgcctagctttctcctagaaagcagtagggtgtggttgagtggctccggagccacaccactgggttcaagtcctggtcctggcacttactagccatgtagccatgggcacattactttacctcagtttcctcacctataaaacagggatgaataataatgcctgtgctatagggtggtcatgaggattctacaagttgagtctggcatagagtaagtgcaatataagtgttagctgttactctctggccattgttaccacctgggcagtattatcccatttcacagataagaaaactgaggtttagaaaggctaagtgttctgccagagccattggctagtaggtagaagagctgggatttgaagccagctcatgaggactgccctactctgcctccatttggaaaaatacatgtggggagcatttggccggctttggaagtggcattctcaattttccccagagagtggggtgaaaggagatgcttttccaagtaactgaactggcctctgggagctctcataatcctacagcagaggcaagagctgacccatgacacacatatcatagaaggagaagggaaggatcagtgaagaatttgtttggaaatgttatctaatactgagtgctttcaggcgacttggtatgtggagcccctgctgtccccttgcgggggtaccagggaagccgcatcctccctgtatcttggccacatccactcagttggagacccggggtaccatccagtgcagcagcccctgggtgatgcgtccgttcccgtgctgggtgcctctgctctcctcgccagctggagggtgtgagcagaggcagcccagctcctgtaactctccgagcaggggctcccagcgcctcagcacagcgcttgcctttgcctcacattgtcccggcctgggggcataggaatccaaagcttcaaagtgactacccaagtccttgggccacccctgccttctgcagctcttcagtacgctgccctctaagcacacacctacacacacgcacactcccagctgctctgccgtgccgggagctgccggccggcaccccaaaggctctttgtccaaaagaggagagtgaggcttactcatgaagtcctcgagatgccagcccatgatcatgtgcccccaaacaccaccaaatgtccacaggttctgccccggacatgcctcgtttggctccaagcgatagcagggagtgaccctctgagatccagcagcacacacccccagctggagggtcagggttctggaagccctagccacggggccagcggctgcctctcgcccctgcctctcatggccgcagagctggccccttacctcttccctcctgcttggctccggggcggctcctcacatgcttcaccctggccgtcagcggggcagcctgtccatggcctctggaggggttcctgagttgcaggccggtggctgccaagcagccctgcctcactgggctccactggctctgcctccacagagggctccggcagaggctggggccagggctggccaggggtcctgcggggctgctcacaaccttctttccctcacagtagcgtcagccgctgcctcagtgccacgctcggcaggtccagggcttggggtccatcctcaggccgtccgcagcagcctcatttgaactcccaactcctttgtggagcctttacatgccgccagaggaaactgtgagcacagcctgaccctggttggctgcaggcgcttctctccacccaccagtgcaagaggatcccccaggccccagaaaggctccgggcctcccctcagccccagacagaggcgggccgcccggtgatgtcacacgagctccggccccagctggcctggcccctcccgcccagcccgctttggcggcctcggcaggccccctccttccttggcacgggcagcctggccagctctgctccctggcccgccctctccccaaagctcaggcagctcccgcgtgctgcgaggcggagcgcttcccctttgactcagggaatgggtttagatccgctccagctgtgcgtgcagccgcgtgcgagcagcaggcagcgggtcctccccctggatgcctcgttgggcactgccccactgagccccaggctggcgggcggggcagctcagcccagagcgcctctccccatcagccgcccttcgtggaggcctcattctcatctctaaaccctggggaaaggagtccaaggctgtccacacagaagctgtggcatcggagctgctcgaagttagcaggaggcagtggcttaggacagtggaaataccacaggctgagggtggaggcagccctggaggaaagctctgtgacttcacacctgagtggctttgattaattcacttcacctctctgggcatcccttccatgcatcggtaaatgagctaattaatactagtaatctacctgcaacagctgcagcgaggactctgtgaggtcacgtgggaaggagcttggcacagtgtcaaggacgcctccttgaactgagcttaggactctggagatgggtggatcaagggtctcctgctcccagaacctctgctttgtgatcctctttagcctgtgttttcatcaaaatgtgacctcctattgggctcttctaggaacaaacactggaactgcatcagagtcctcagcatggagccagccgcataggtggagctctgtgaatgttgatagaatcagagtaagaaaggagaggatggcactggaccccatgatgcaagcatcctccagacacgtcagcactggcagcctgggagaaggtacagtcagtgcaggaggacaggcctgctgccgggcaccctgcggggatacagagagtaggaggatggcaggcaccaggaagggagccccagggtacaagtttgcccctctgcttggacaagaacatgtgaaatattggtggtatctttgcttttttaaaaaggtgttagtgatgatggtggtgatgatgtttgggaacaaattgggagaaaaactttaatgggactctccctgcccctaggcatcctccctactaccaggcacccgtcccaaccctgtggcagattcctctttcagagatggcccaagcaatctctcccagtccccaaggagaccctgacacttcacccatggagcggtgaggtccctgctcctcgccttgaacccgagagggtttgtgacttgcttgtgaccagaggaatgtggtggaagtggcaccacctgacttctgaggctgggagaggaaaggcagcgcagtctctaccctgttcaccagggcactctcttttgaagccccgagctaagctggagcctaagaagtccagctagaggccacacacagtgtaggtcccagctgacaggagcatcagccgcagacacgtgagcaaggaaagatgcctgtagatgatcccagcccttagccacagagtcaccccagatgctgcatcactgtcagctgtagagtcttcctgttgaggccccacacactggggagcagagagagccattctactgtttcatctccaaattcctgacccacaggccccatgcgtataataagatggtggttttaggccgctaaattttggtggtaatttgttacacagcattagtaactgggatagactcgggcaagagcagttggagggagccctttagaggagctgagagaagtacattgtggctgaggagagaagatggggtcttgttagagaggtggaactttattccaaagacagtaaggagccactgaaaggttttgagcaagacagtgttgagacttggttttattttttaaaggctacattagttattgagtggagactggattaatgtgagctacagacaaagtgtcctaggactttcccaccctctggtaacaggtccagcacaagccccttggttactgaaagaaagttgttttcactattcaaagttcttaggatcccctcagtggagaaggagcaccagggtgtcttgccccatccgtctttgcacacctcccgccccactggtggcattgggcagtcaaaattggtggcattgggcactggggagctcaggagtcagattctagttctaccatttggttgctctgaccctcactttcctcatctgtaaaatggggatgatatgaggatctccctcacagggctgtgggctgttgagaaaatgaaataagatgtgatacattaagtgtaacacacactgcctagtacaaggctcaacaaaaagctcttgtagtttctgttgcttccttcgttgggctgtgagtcccctgaggcaggggtgtgtgcgggccatgtagcgccctcctttcgtgtagcccagtacagaggagtgaataaacgaactgctggctggaggaggatgaagagccatggctcaaagtctaagggacctgtgctcaaatcccagctctctcactaatctcgggcaactttcttattctctccgaagctctgtttcctcacttgtaaaaaggggatgctactactcccagggttactgtgaggattgagtaagatgatggggctgaagcattcggccctgcgcccggctgcagcatttagcggttgctcaggaaattgctgctgttgcttctgctcctgccctcagacttctccccactcccaccctgatcctctccagcatgcttctaacttggtgactcctggatctccgtgtccccctgacctccttgagcaccgttcccacatttccacttgtctgtcagacagaagcatcatgtgactaaagcatttgaggagaagggaatcttcctttcctttttatagtttttatcatttaatgtgtgactttttaaaattttatcagtaaatgcgtgacatttacatggtggtagaatacaaagattcttcatgtaaatgacacaattcgtaagaatgatttcgtgtcttaccaccttcctgacagttgcaggtttttttctgttggaaacagcgggatggtccactgggagactgcgtatatatgaggagcggtgggtcaggggatgcaggtatactgtgttcttagaggggtgtacttgggagggggcagttttgctgtatcttgcattctcagagtgccaccattatttgaagcttcacacatcccaaactgactctttcccataccccaccccacccctacccccaactccctgctaccttcagtactttttaaatgtctttctgttgtcttctgaccaacattgtttctgttgagaagtcaactgccttccttattgttgttcctgtatacataatggatcttctgttttctggcttcttttaagattttctctttatctttgattttttagcagtttgaccatgatgtgactaagtgtggttttctttgcctttattccatgtgggtttactgagcttcttggacctatatgtttttactaaatttggggatatggggagaatttttagccattatttcttaattttttatgctcaattatctctcccctctccttctagaaccccatttacacacttgttcttccacaggtcactgaagctttatttgtttatcttttcttgtctcatgcttcagtttggatcacttctccttcctgtcttcacatttgctaaccttttgtctacagcatttaatcggctgttaatttcgtctaaagtattttatgtcagatactacaatgtttggttctagaattttcacttggtttatttttataattcccatttctgggattccatatccactgattcattctatctttcatgttctcaaaatcctgtgcatgtttataatagccatttaaaaatccttgcctactaattccaacatctggctcattagtgagtttgattttactgcttttttttcttgattatgggtcatattgtcctgcttcttcacatgtctataattttttattgtatactggacattgtggatgatacatgaaagacattctgtattttcttgtcttcctctaaagaatgttgggttgtgttctagcaggcagttaaattactttgccttctgttgtgctccttggagtctctctacttgtatacagtttaggagttagctaaggatttgaagggaattggtgtagtaattttggggctttctcttctgtagttgtgtcttttctggcatttccccactaactttccaccctcaaagtccaacctctttcccatcttcccagacagtagactgctgctttctgtttcagattcattcttctgtgtgtcaccgtgaactgggaaatgctctagtatgctttccttctccactgatttcaagcaggtctttttaaatttttttaatatttttggtccagagtttgtaattgttattgaccagagtagttgttcaaaacagtccactcctccatttcaggaactggaactccatatcccaatgaatttgttttctcacccaaaccttctgtacccgttctgctgttggtgctctgccatgagcctagttggttggttgtccttcatccagttgtctgtcctccctgcttctgatcatagtctgttgggaaatgtcaaccccaagatcccaggttggtacatctcagtgtaccacctgagcactagaaggtgaaagagatgtactgtcctcacaagccctgttggagcaccttatgtagctacttgtgatgtgctagacattgagctcaacatttataggtatcacttcattttaaaaccatatgagtgaaatattactattctattttactaacaaaaagattgagacttagcaaagtgaggttccttgtaccaggccacacagctaggaaataatgggactgggaataaaatctgcatcaaagctaggaggaacacgattgtcctgaaaaaaaaaaaattttgcttgtttttattgttattatactttaagttctggggtatatgtgcacaacgtgcaggttttttacataggtatacatgtgctgtgttggtttgctgcacctgtcaactcgtcatttacattaggtatttctcctaatgctatccctcccccagccccccacccccctctctgtgtccatgtgttctcattgttcagctcccacttatgaatgagaacatgtggtgtttggttttctcttcttgtgttactttgttgagaatgatggttttcagtttcatccatgtccctgcaaaggacatgaactcatcctttttatggctgcatagtattccatggtgtatatgtgccacattttctttatctagtctatcattgatgggcatttggattgcatctaagactttgctattgtgaacagtgctaaaagttgctcttgtttaataccagcatgctgcttcttgttttaaggtctctgaccaatcaagatgcttctcaccatcagtggtgtgtcatagtctaattggcagcactttttctttcctagtagaatgtgatgctttttacagttgatgacttgtcagattcaaggaagtgtggcagttttagtcatcaaggccccagtgaggttggcctgtggctgaggagccaaaaggcagagcccctcctctcctggtcagctggccttggaaaggtcttggggagtgtccaggcatcaagaagcctgtggaactgccagaagcctccatcagtccagatttaataaaacagctgccactagactgagtgtgagccagctggtcccctcctctcttgaaggcgcgtggtcaggtcctgtgactctccgcaccatgccgggtgggggaaccacatgttccctggctctggtgaggagaagttaggagacttggacttgtgggacgattctaaggtggtgctactgtccagtgtcacaaaggatatccaggcaccgtgcaaagccctttgaggacactgtgactgttaaatgctggccaaacaagtatatccaaaagtcataacaggatgcatgcttgggtacaaagcagctttgagagcctgttgttagctcacgtgtgacttctcaactcacttgccaggggaccgtgaggacaacacctctcctcaagtgtgggtgtcacctaacagccaacaaatattcgttttaagctccatctgagcaccagagttgggctctaggtcaatttgcccaaagacaatttgctgagaattttagctgactggttttcattttgtttcgtaacagtattttaaggcgtgtccagctctctcataccatagctggtgcatggccccatccccaagagaggagactgaggactggcaagagtagagatttaattttcatttgctggtttgctttgtttcttcatagcgaaaaattcatagacactttccaaagctgtttaaaataattcccatccaatataaattttttaaaaatattgtcacttctggaacattgtctgtgccagacaggacctatatcccaaacaggagacaaggtactgaggacagctttatagtcagtggggggggattccaacccccttacacaggtacctgctgaaattcccattccaaagaccagccaagctgttgctgaccttgtttatctttcctgggacccaaggaggcagctgattagataaacgagggcttctggcaaaagactgatagagtgagcctctcaggaatgagagcagggtggtgtcaccccagatggaggtgctggtgctggacaacaggggctgctggcagcgacctttctgactagtaggtctgatgttgggggtttcaggggcacccacataggccctgcagggagtaaaggcagccagtgcaggaggcttgcttcagtcctgccagcctccagactaccccaccgccttctctcttccctccctgggctgggctgggtaatcctggctcagaggcctgcaaccctggagggcagggatctgtttttcctgtctgctcaatattcttcatctgctcccaggatctgctctttggcaccctgccctgtgcccagatgctggctgacctgtggggattgcctctatgggctctcttaccttctggatttgggttagggctggcctgtggcaggtgcccacaggaagtgagaagataggaagcgagtgaggacacgtgtgtcaccagctccctccctgttggaccataggtgacttggtcgagtcgataggagtcagctaggcttgggtttgaattccacctccaccccttattagccctgtaacttatgaaatttacctatcctccctgagtctcagtttcctcatttaagaactggagatagtaatatcaccttcccaagatggccgggagtaaaaagtgagacattgtgagtacagatgtcctagtgcaatattggagacatagcaggtgctcagtaaatgctggctttcttcatttagtaatttggagccttgttatcttgggtttctaatacacttgggtcctctgaaggtcatcagtcattttgtatctctccggacagctttcctttaagttgtccctttttggtttgcacatctgtcactgtccccagaaccactgccatagagcctgactactaatagtcctttagtcaaagaagtatttctctgccttttcctttgcctgcagcctgtatatgaagtctgcttaaccaaagaaaagaatccttttaacatagtggaaagcaagcttatggaaagacagtgcatgtattgacatccaaaaataattcataatattcactgagcacttattgatccttgcaacaaccttatgagctacggtagattcttttattattccccagttttcagatgaagaaactgaggctcaagttaatggacttgtccagggtcacacaatgggccagtgttgacctttggccagtctggcacccagaagcctgccctttcaacctcttcgttatctgcctatgtgatggagaaggctcagctctccaggccctggggaccatgtcattttagacaattgaattggctagaaagctacagggttatctctttcaacatacagtgttttaaaatttgtatttattcttgttatgtttctgcacagacccacacatgcatatgtgcactcgcctccataaacttggctaattacactattggccgctccttggtgactcagtcgtcttgaatagactagcttgactgtgggctgtgggggtggagggcaatgttgacaggagccctgtaagccccaggcagccgtgtttgttggtactttcctagcagcctctcatccctctcctgatttgttgcttctcacccagctgagattccagaaagctgacaagagttatttgtaaataaaaataactggtcactaaactagtctaaagggctctcctgtgagtaaagtaactgagactcactgcctggacttgattacatcaatattgggtactcacaggcctttgaagcttgcaagacctctgttcttatgtaacagccaacagccgccatctgttacacactcaccacatgcctggcactggggaggcctcctgtgtggattacgtcattgagttctcaaaaacggagcctctcaggagaagttctctttgtccgtcttccattttaactgatgaggtagctcaggctcagagtggtgagggagtctacatctacgcagccagtaagcagcgaagtcaggattagacatgggcctgtttgacccggagtccacactcttaacagacttcagtctctacagcttcccagcagtgtgaggttgggcaacttagggaggctcctgaccctcgtgtcttcatctgtaggatcatcctgtttatgtccagaactattgtgaaggttcctggaggtgtgtgcttgagatatgcatagcaggcacccagtcagtggtgggtccttgtgctcaccacttcagcccatcctaggtcagtggttctcgagcttttgcgcttcaagatcaactgagggcttgttaaaagtttgctgggccccacccccagtttctgattcagtaaatctggggcccgggaatttgcatttctaacaagttcacatgaggcccttgctgtgggaaccactcctcgagatagaggagtttgccatgaaggagagtcaggactgggctggcagtgaccataacctgcatctgagagctgtttggtgagtgcagatgctggttacgtatcatgcaggaaaaatgcggtttggcttttttcaggcatttcctgggagctggctgtcttgccctttcactcttctgagtgtcattgaccctgggaaaatgtagcatttaagccacattgtgatgtctgaatgtgaaacaaacttcattcgactgatttcattaacacgtccctgatttccaattgctttcctgatacagaaaaggaaataaagggtacgttaaaaaaaggttcctataaatcgtcttgcagaaattacttctgtgaattatctaccaccaccacaacaaaacacctgaagcatggctcagactaggtatacttctgcttcgccttggaattttaggttcattgacacgatggtgtgatcagtgttcttccctccccagcacgctgtaagggtggagcagccacctcattgcctttgggtctccagtgcccagcacagtgcttgacacacaccagggggtgctcagtcagcattgctgtcacacaaatgagtgaagggtgcagcaccgggtactagagtcagagggacctgggtttgaaccctgggcctgcccttcccagctgaatggccctgagcaagtaacttaacatgggcctcatttctccttttctaaattggggattataaaaataatacccatatttcataaggttgccatgagaattaaatgacataaaatatccaaagtgcctgccatatagtaagtacctaattttttcttcataatcatcatcaacatcttcatcctcatcctcaccctgccaggaaggccagtgtactggtatagactgtgggctctggaaccagacttttaggtccaaatcccagccccactgcatgctagctgtgtgcccttattcatgtcacttctctatgcttcagtgtcctcatctgcaaagcagggatgaaaaagcacctacttcatagagttctcgtgaccattgaggacatgtacatgttaggtgcatgactgcatggctggcacatggtaagcgttaactctttccccaccaccttcacagaggggcagggaaggagcctgtggagagagcggcgtggccccatggggagggaatgggaggaggaggcaccgtgcaccctggggaggctgccctgcccggtgccccggaccctcagccccagtccccaaggggagagaagggcagcctagcagagagtgagagtgggtaaagaaagatcctcaggcttctgacactggaaaccccctcttcctggcagcccttggaagcgcagctcagtcttcactgtgagttgacagactcagctggttttgtttactcagcgagcttgagagcatgccgaggtggcgtccccgtctgcagagccgcctttgcctgcaaatatcaccccctttctgctacctgccagccagggctgtgggtggggtggacccagtagggacaagccccaccctgccacccactcacccaccggcctgcccttgcctttcttcctctgccaggctctttctgggcagccccaggtttggccctccttcccggcattgtcagagaagcttccaacacctcaaaatccaccctagggggaccctctccattttctttaacatggaaccaaaactctcctggtttctatgtgtgcagaaacgtttggtaaacagaatgcttaagccgtgacttgctggaaggggcaaatcccagctgacaccccagacactcggcctattttgggcctggtctctgtggtcagagtgtttatctttgggcccccagcacccactgtgggtgtcagatgctcctttcctgactgagtgttggccctgcctggtcccctgcccctgcctcctaggctgctccggataatgcccagtatccccttagtaaatgctcttgtcctcgctcccccccccgtgaatgctgtgattcagcacacacagagaggagcttcacgtaagaaagaaaatattcacggccgccatccagctgcagcaggcgccgggagacagctgccggctcctgcctggccacgatgggatggctgcccaccctccacacacagggggggtctctcctcctttgtttttttaaagacccacagtctcttttggttgctacactaaatgcaatttaaatctgtattccgaacacctctgataagcagcagataaatagaatcctggaatttggaggacatcacccattccacaaaatacatgttacaggcctgctgtgtgcctggcactgtgctaggttcctctgcagagctgggagcagcctggaggacactgagccagtggcttggatcctttccccacctaagacccctttcattacctcttcttagctctgggttttgaaaaaatctatcagtaataatagcagccatgctactgtgaagttgagtatgatgtgaagctctttgttaattcatttcttcctgtccatcatgcctcaccataggtatgatgattctaatctccactatacagatgaggaaaccgagccctagaaaagagaaaaatcttgccagggttacagagcaaggtcttgctccctaaactgactcagatcttcattttgtttttgttgttgttgttgttttttactgttgcaatgtatacagtctctgtgaaacatgctgcttatattaaataaaaataaatgtcttacccctttatttttaaaaactcatagctcactgttcagagcttctgaacagctgagagtaatcattataatgtctgtcagagtaaaaccaaagtaatggttccctgcccaacacccatgctcaattccttctccaccccctctccggcccagtgagtccaagatgggcactgtggggaagagagagggtcctagacttgcagcaagtgtagtgctgagaggagacagcactcatctctgctgcctgggacacttgaatgtgcctgggacagactgctgcctgggacacttgaatgtgatgagctatagaccttcggcccaccaaggagcatggaagaagaggggctgtgtcctttcagtcctctctccctctttggggagggagattgacacgtagcccctggagtttgggtcacattgaacatagaaactggtggctgtttctagtatagagatgtctgaaagcagaaactcatggggtcacaaggccttggaaggacttgagtatctgggaagaagtgggctccaccctctcattcctgtctctgtggcccttgcaagatgggcccacatggagccaagaagttactgtggttcatgtgaaggggcacagaggctggagaggggctggagctatggctagccaggtggctgctgtaccaagcaagggacaaccagcccagagcaggggccagggacatgtgcccctgtggcagggaaagatttgagtgccctttggcaatggaggagccagggcaaagccaaagacaaccttaggagacccatatcaccacctctgtggggaccggcttgacaggagccacctacttctgagggaaccagactaggggccctccccaccactgatggacaacccctgtgggagcagatcttgcttgagagggtgggtcccaagccaggctctgctagagtctgtgaaggcggtaggggaggaagtttacaaagacaaaggcaaggggacttggtaaagagcagaactctatcctacctcctcccagctcccagagccgtaaataactgtggggaaggggcatgcaaggagaacaaagatgaactttgaattgcatttgagtcaagttttcaaataaagagaaccaagtgttaaatcctgaaatgagactattctaataatggaaagtgactgcaaagttacagaatctggcccagatttcatttagggacttgctgcccaaaattggaaaggggaggcaacatagcatagtcggggagtgggtgttggagagaacgaaagcattttgtgtttatacccctggtggatccagattcctcaataaagtagtaacgacttcagccatccagtgaccccaggttgtgagtctgtggtctggccacctgaacctccacaaatgcccgaaggcccagggttacccaaggagtctctgcacactctctgagagaagtggcaggaaggggcagaagcaccccctgagctccagctggctgcagcccaaaggggaacccaaatgcattagacctgccggcactgccagccagggagggggaggcctgtggcagcagagatgatttggtgaagtgagagagtgggaaagaagaaagcaggagctgagccagagagccttttgagcattgtggagcacccaccctcttcccgggaccctgctgggagctcccagaggcttcctcctccaccactcactcgctgcagaagtggagtttgcatgccagctccctgcatgggactgtgtgccttgggagagctcttcagcctctctgagcctccctgtccaggtctatggaacagcaattaaaacagtctgctcctagggttgtcatcaggatacagtgagcagaagcacgtggagtcctgagctcagccctggcccccccagaggcattccacacttgcaagctctccccaccatcacctcaccttcatcatctcctcattgtgatcacgcaggacctggtgcatacctggttttctgggtgggatgcctttgtcttagtgattaagggtcagggactagattcaggtctgcctcactccaaacccaagctcttttctgcctctgaccgcatggagtcagtgggtgctaacactgctctagattctcatcaccccaggctctgttcttgtcagcagggactcaagacatgggaaccggtagactcaagtgtagagacaacctcactggtggctaggaacagatggccacaggaatgacccatgtcagagattttaacctcagccttgggagaggggtatatttttaactaccccacaattaataggaattgagtttgacaaaaagctgaaagtatacatgggtaactgagataatggcctgtttgacaaggttgcctaaggggatggctgttctttttgcccatctgccacctgattgtagagaagggcatgcaacccagctaccccagccacggcctcagactagtgtcccacccgggccacagtgtatcctgtccctccaccctccagactagtggcccactctaggccagttggagtccttgtctggattgtttggtttttctgaagccaggggagagagaatctcctttccttgattgtagaactgtcaggatgacaccacagctgcctgtagctgacctgagccacatggagaggctgagtgactggggggaagtcactccctgagaggggcagcaatgaagagtggtgagagcaagatttgcaggcagcaggccgccagctctacccccaactccaccctgccagtggggctgtcctgggacacagctgcagcctttggtcccatgagccatttcaggattcttgccgtccttttcccttttgaagctggttccagttgagtttctatcactggaaaccaaaagattctgacttatacatctttttcccccttctttcatttaagaagtattactgaggtggggcagagcctgtgctgggcactggggagatacatggcgtgagcagatcaggtgtgggctctgaccctgctggacctgcagcctggtgggggcatgtgttgagcaagcagcgtgtagaggctaaggggttagatggatatggccatttgaccttgaacaagttgtttgatatctctgagcccaggtccctcatctgtaaatggggtccagggagataatacatgttgagctcacacgtagccctcagagaatggaagccactaatatcagtatgattagagtccttcaagtataaagtggctgattatcacaaaggagcagccaaggacctatgagaacctcaaatgggagagctaaccatgtcagaaggcaggagggctcggctctgcagggatgctgtaggccacggccgaagaatgaggaggcctccccgggtagcgaacatgtgttcatttccacagacttaatgctctgtgtggtatagcattccaatctctggaatcaaaatgttctcgaatgttagagctgtaagttccaaccccatcgtttatcagtgaggaaactaagccacagagaaaggcagcaatttgtccgtggctgcattgtcagtaaggaagagctgggaagagaggccagaatgccaggtcctgctcagcctggtaagtgcttattgagcactgtggccatcaagccaccagtgagaatgaggagtgctccagggttcccagagtttggatgacagagggcaaatgggcttcactaaccacagtgacagtgcaagaggcagaaccctgaaccatcctgggcacacactactccagggaataggtgttgggcaagctcacaattgctgcacatactctatagaagaaactcctggaaagaaaaggctctcggtgccagtcatcagccctgcagagccacagaatcctgtggaggtcagccacggaaggacagagagtctaggtccacatctccacacaccctgggtagttgtgtgacctcaggtgtccccgagtctcagtgcccacatctaggaagtgcctgcctcagagagctgcgtgaggactccatggagctcattaatgcaggaaaagcctgatgtgacatccattaggagctcagctcatggtagccattctcactagtttattattaatacactagggttaccgttactgggggataggtagctctctaattggcagtaatttttagttcacactgaatcagaattcttcacattcctgttctggtcctgtcagagatggggattcctggtttgagatttacctgattcttctatctctccctgtaatttgctgccctgtaatttggcccctgcacctcagctctgtccttagaagggatggaagatgatcctggaagccagggacagacctcagggccaacagtgtgttgtctgggctcgccctgcctcagaggaaggtttggccagaaggtgggtcacgtagtcctgtgctgacacacggcagacctagtgaggtatgagttgacaagtcacccatgttcccatcttcagaagctgctgacctgccattcctgggtcactctgactagtgaggcttcaggaagttgtgagtgccaggtccgaggcagactccccaggtcaggccaccccatcttctcctcttcaggaatggggcctcttgttctgcagtggcacaaacattcatgaacccaacccaccttgtgcccagctgtgccagctgagatgcccagacaaacaggaccagtagtggaagcttgtcaggagatggtgcccaatgactagtggcatgacccagcgcttggagcgtctgccttgggctctgtgcatagcagctggggtgggggtgtcagcatcaagggcaaggggaggagaagcagaaccctcctttgcagggccctgggccagtggaggtccacctctgacaagacaggcctgggccctcatcccagtcaccaccagtcaggcgtgtggtgtgggtggtctccctgtgcctcggcctccatgtaggtagaacagctgctgagaggagtcagtgaggtaacacagtgttttcccagacctcaggcatctgtgaccacctttgccatttctattaactttcttgctcagtttttctcttgaagtctattttattcatagtctgagttcaggggtttgatgtgccgtagtttttctaatgcttgttaagaatagatacaaatccctattcccgtgccacccgcccatgccagccgccatccgctcatggcatgtgtccaccctttgggaaacgcagagatgacatgtgttgatggcttgtcacaatgcttggcatccagggagttctcaacactggtcagcttttgtatattattattattgttgtcacccttatcacagcagtgagactgtgggaggaaagaaaaagggagctttggctgtcttgttagggccaactcctcttctttaccaaggaagccagtccttttccttttaccacttttcctcctgccttgagagttgactttggggcaccctggaaggcagtgcaacaggtcagtctctggctgacggatcagatggacgtgctgtggctgcccattcccagaccccagagccgtccgggcacttgtgtaaaatgatagctctgattatttgcagtcaagaaagtcctgaacgggatgtacccaggggccaacagcccctgtctaccccttagatcgtcatgaaaggcctctgggggcacccagcacttgagacagtgccttggtgcccacctgggctggaatcctttccacttccactgaaggatgaatcccctggggtcttccaccaacagaacattccaccaggaccacctggcagcatgtgattagcttgtacaggtgtgtatgtttatgtggaggacacacctaaatcctaagagcagttacttcacagtgatgggattataggcagttatacttctcattatacctttctatattctctagaatgaccataaatgcccttttaattgaaaaaaaaagttttaacctccccccaaaaaaatctggtagagacatttaagatacacagaacagcatggggcagccatggagtccacgctggaagagacttgggcgagggtggaacatggaggtgatggacagcctggctgtgctgcagaggcaggccctggagagatggaagggtggaaaccctggcagatcaataagggggcaggggcaggcagctaaggtcattcatttaggagtcaaggtgcctacagggctgaatagcagggagttgggggtaggcagctgctgggaaagaccaggcaccaaagggagtaggagaggacccaggtgggtgacgtggagagggctgtccagggagtggagggatggcctttctgcagcggtggagatttcctccagcagcgctgggcagctggtgcagcatctgggagactccttctgagaccgatgcaaagatagggctttgctgggtagtgccagggaatgccaggggttgtgggtgttcgtgagattgggattcaggtggtcagccgtacagtaaggtgtaaactctgactgaaaaagagggaagaagtaaattcaagtttgagatttttgtgccaaactgaaattcctgcctacttaactttcaaatattttaagttttaaatgtcctccagccaacagtaacgcaaagctgcctccctccctagccatctcgctttccttgctcagaagcacccttgggggtttccagctcaggcacagtccatgccaaccaacagcctgactgctgccagagaaccacgtgtgatctcaggccagtgggtcccagactttggatttcatgggcaagggaagcttcaaaatgaaacttcagagactctcacagggttgccaatatttttttaatggcaaaaaaaaaaaaaaaaaaaaaaaagaaagaaagaaactgtccttatcatttcctggagaaagaaacattttaacacctacagtgtaagcagggcataatctcagaataaagaatattttttcccaagtaaggacaactggcaggcttttgctcatacattttgaaagtatttttttaagtatttttcattttaaatattttaaatatagaaaattgaaatgtaaatttttattgcatgttttactttatatgtaaatgaatcattgatatgagtttgtcatttggggttatgtattcaataaattattcaataatagtatgttttcaataatcatgttattgaatatgtaaccccattccactatagtacttggtgttttccacattcctttgtaaaaatccagccttgcgtaggtctgttgataatgacaggagcaacgttctaaatggtagttgcttcatttggaacattctgggagaaaatacaagtggcaggctagcaaaggctgtgggcactcctgccctgcggtctgagccctagatgcctcgtcacatcatagagagcaggagatgcctctaagagggcattaggggatccgtccttacagaccagcctcatattgcagatgtatgggaagccctggtctcaggttgcaacagtaggagtagagtgtctaagaaaagggaggtgatcatccactgtgcagtgtgttcattggtgagtgccacactatgctgcgagtggtctgtgagatgggtcaaactgcagacagcctagaatgccaggctaagtgatcccacctaattgtttggatgaagaggactctggaggcagttggaggggtgggcatgatgggcgcatctggagggaagcagaagtcagggtggctagcagagaagcaccatggagtgtccaaacaggtcagattgagttagcaggtccaggactccctccgcaggagggcctccaagctcagttctcttgggttgcaaataagaccctggaatcacagcaggaccacaaacattttacttgctgctggctcagagcacacaatgatcagccaattaaataactgagaagagggttgtgtagttaattgcctggcattttgagaggaaaccactgttctttgagcttgttgactctttatttatatttacattatacacaaatgtatacaaattatatacatttgtgtgtgtatgtatgtatgtggttatgttgctactctgataataattaaatctggacggtaaataacaattattagaagaaagttatatcttaatgattaatcaggtagtatgtggaaactacctcaacaatgattaatcttttttgaaatgtacaaactgtataacaatgctgtaaaattttttaaagcacttaaaattccactattccagtactttgtggttctgtattttttgttaagtagttattttaatttccttagctatttccctattgtttgacattagaatgtttccaagtttttgtttgttttcttttaaccaccgtagatttccctgcaataaataccctggtgtgtacaatgttttcccttcttttagaattatttcctcagaataagttcctgggagtgcaactgctgagtcaaaggataccaatattattctggctttggaatccctgatgctttcccaaagggttgaaccagctcaccctgctccagcagtgtatgggtttcccgatttcaccacaaccctgctagctttcacactggtcttattttaaattaaatgataactggattttagatggaggcttttatttattaatttacacctctcagttctctccattgctctgcccagagctcctatactttttctccatagccccgtgctgtggtttgattgacatctgcctaccctccagacatgaagccctaatgaaagaatgatgatagggcctagacattcctccctgtttatgtggaaactacctcaacagattttaagaaagggcagttgagagatgtttaaactataaatagacttggtgacacctcttatttggtcaaggtggtcccagtaatgaatgcagactctgtgcttctgggagtatgtttatgtctcacttgaattctagaagacatcagagttaacgttaagtcatgatgtataatttaagacagagatgaaagagttcccactgaaaacaacccttctttctaggtgctccgtaattaccaagacagaggtctccatataggggcaggagtcctcgttggagaatgtctgaagaaagctgaaggcaagcccctttgctctgcccttgccctccccttccgggcacctggggagttggccacaagcacagcagaggatggattaggctgtgggaggggggcagcctgagtgagactagcccccagatcccctctttgagcctctgctctgaagtcatctccgttgttggtgctgaagcctggaaccctcagccttgttccttccctgccacctccttttctcctctccaccccatgttctgaaagcttagccctgaggcctgaaaatggagctgcttccctggctcagatccttggctgtccccctctaacagtgcttttgacccatcaggtgaccgctggatccccacccagcattagctcctggacccgtagtaccccagcggtggccctcatggacgattcgtgcaggaacacatgaaatctgagtttcccagagtgtgggcatgcactactttgggtcctcatgattttagatggcatggtagataaccttactttgatagctaagtatttatcttaatgtgattaacacatcaaacttacgatttcactcaaaaatttaagtaaaaaatcatgtagtgtgacccagcaattgtactcagggtatatacccaaaagtaaaaacacatgttcaaacaaaaacttgtacatgaatgttcataacagcactattcacaatagccaaagcatggaaacaactgaaatgtccaccaaaggatgaatagataaacaaaaagtagtatatgcatacagtggaataccattcagccataaaggcagtgaagtaccgatccatgctacaacactgatgaaccttgaaaacgctaagtgaaagaagccagacacaaaaggtctcatattatatgattccatttatatgaaatgtccagaatcagtaagtccatagagccagaaagtacattagtggtagcctaggctggaaagcggggaatggggagtgattgcttaatgggtgtagcattccattttgaggtgaagaaaatgttccagaacaaaatagtgatgatagttacacaacagcatgaatataataaatgtcactaatggtaaattttatggtgggtgtatttggccacaataaaaaataataataatataggtactatgttggcaaaaatcatgaaggtgatatgtgagtaaggcaaaaatagccttacagtatataaagtgagataagaaatagagctgctgggccctgacactccagctgggttgtatttcattgttgaaatccactttgctggagggaggaccagcttgactttcagtgtctacaagaggacagctgctccatgtctggcactgagttaagcacttcgtcggtattatctcactgtggcctcacagtggccctccgagggaggtgctcttattctccctgttttttagaggagaaactccaggccacagcgctggtcagtggcagagccaggtgggcacacctaccctccaggccctgtgacgacctgcatcttttcacccagggttcctctgaggtatcctggttgggctgtcacctactggtgatatctgctacccttatgttttcaaaaaatggggcagttacttccctaaactcatttgttgactattggaggacctagaattcttcctcatgatgccttctttcccagggttaagtaactccaaggcaccaagccctccatctttctgactcaggccggggagggctgcatggaggcacagcaagccttttgctccgactctgcctttactctgagcagctcttagactagaggtagagccccagaagatgtggagctctctgcagatgcttttgaactctgatactattctaggcaaaataattcctattcaatgagatttgaggcctagccctgccacttaccaggtctgtggcttgagacaagcttcccaacctctctgacctttcgtttcctcatctagaaaatataaataatggcatttacataaatggaagactggatgtactctttgttgttcatattattccattttaattaagtaattattcatgcagttatttgtttactgtctggcagctctgctaggcagtaagccacacaaaagcaggaatcgtattggttttgtttcctgcagtatctgcggcatggagaacacggtggattctcgatacgttatctgttttttaaatttcaaacttttattttagatatgggggtacatgtacatatttgttacacgggaatattgcatgatgctgaggtttggggtatgaatctcatcacccaggtagggagcgtgctacctaataggtagtttttcagcccacacccctcctccctcctgcctctaatagtccacagtgcctgttgttcctgtgtttatgtccatgtgtaccctgcgtttagctcctgcttctgagtgagaacatgcggtatttgcttttctttcctgtgttaatttgcttggtattatggcctccaactatatccgtgttgctttgaaggacatgatttcatttttatggctgtatagtattccatggtatatatatgtacattttctttatccagtttaccattgatgggcacctgggttgattccatgtttttgctattgtgaatagcgcagtgatgaacatgtgagtgcatgtgtcttttttttttttttttttgactcagcgtctcaactctgtcatctaggctggagtgcagtggtgcaatctcagctcactgcaaccttggcctccaagattcaagtgattcttgtgccttagtctcgtgagtagctgggatgacagacatccaccaccatgcctggctaatttttgcatttttagtagagatggggtctcaccatgttggccaggctggtctcaaactcctgatctcaagtgatcctcctgcctcagcttctcaaagtgctgagattacaggtgtgagccaccgcacccagcctgaatgtgtctttttgatagaaatgatttattttcctttaggcatatacccagtaatgggattgcagggttgaatagtagctctattttaagttctttgagaaatctccagactgctttccacagtgactggactaatttacattcccaccaactgtgtatgtgttcccttttctctgcagcctgaccagcatctgttgatttttttaactttttaataatagccattctgactggtgtgaaatggtatcttactgtggttttgagttgcatttctctgatgattagtgatgctgagcagcttttcatatttgttggctgcttgtatgtcttcttttgagaagtgtctgttcatgtcttttgcccattttttaatggggttatttgatttttgcttattgatttgcttaggtttcttatagattggttattaggtctttgtcagatgcataatttgtgaatatcatcacccattatgtaggctgtctgcttactctgttgatagtttattttgctgtgcagaagctctttagtttaattaagtcctacttgtctatttttgtttttgctgcattagcttttggggacttagccaaaaattctttgccaaggctgacgtcaagaagagtatttcctagattgtcttttaggacttttaatagtttaaggtcttacatttaaatatttgatacattttgagctcatttttgtgtatggtgagaggtgggggtccagctttaatcttctgcatatggttagccagttatcccagcagcatttattgagtagcgagtccttttctcattgcttgtttttgtcagccgtgttgaagatcagatggttgtaggtgtgcagctttatttctgagttttctattccctcgatacatatttattgaataaaagaatgaattaatgcctgagaaacacttagcacgatgctgggcactcagtaaatgctaatagacgttagtcactggtggtggtgttatcattatcattactattggtgtattaaaggcattcacgaaaactctgattctcaaaacagccttgcaaggttggagttatgctcatcttgaaaaaatggaaattaagattcagataaggtaaatacattaacttgcccaagtcctttagaacttacagtgaagtctgtaacctaacattgccctaaactcctcctcagtaggtataaaaccctgagtcccttcacatagaccaggaattggtagcactactgatatataattatacttttttgagcacacatgtcttagaaataaagcacattttgtgggaggcagcacagtatctgtggattcggtgtatgagaagctgcggttgcccagaagataagcagaattcccaggctgccacccctgcccagactgcggctggcctcccaagctgtgagcccccagcctgggattctctctgcacacccaggtgggggccagtcgggctggatgtggggctcccatggaagagaggaaggacacaggcacttcttcagtgcttggccattgtcaggcccataaggggagtagggagcgtctgttttttctcactgttgtatcctgtgagcctagcacagagcttagctgagaaagtgcttagcagctacttggtgaatacacaaacaaattaatgactgaatgaatgaacaaacctgctgtgtgccaggcaccgtgttggtttgcttatatgacctcacttaatgctcagcctggacacatgaggtgagagcacatgaggtgaggctcagaagggtgaggttgtttactgagggtcagccagtggggtgggtgttcaaaccaggtctccctacctcctgtactaccccagagagtagggagggctcccaggccatggagaatccccttccccaaacaagagagtccatttcacctctggctgtgatagaggctcagagaggaggcaagggcaagggaataagttgttctcaaggcggttgcatgctttttcagccctcgctgtggatggaacagaatgtggggatggcggagggagaacacgttggagaggagtggaaactgaggcctgggtcctcgtttctctgcagtctgggcttgccactttctactaatgttatcaccatcaccctaacctttattgagcagtgacctcatatacacctcattctgtctacacctccacatgagggaggcaccgttgttagccctgtttacagaggccaaaactgaggaccagaggaactgttctggccgaggaactgtcctgaagccacaagtcaatggcagcatccccctgacccactaagaccacctggctctagagccccaccctgtccaggctggccggcagagggtcgcttggtcctggagcagctgctgctattgcagagtgcggcaggcctcctggttctgagtctagttcatccactggttgacactggtgtcttattgttgtcttccaatgttggagctgagaaatctcagaaggttttgttgtgaggtccatggtaggggtggtgctgacaccaggatcttactaaaggaagcgtttggcgctagagggctgagcccagcaacatagtggagctcggcaccatgagcctgttcagtgaggtttgatgggctatgaatcagacttgtcttcctgagctcgtggtaatccacttggaactaagtcctgttctggtctggagatgtttccagtccccagcaggacatctgccccctctgagggcaaggcctgtgtgcctaccctccaggactggattaaggatcacagagagtggggaccacacaactcagctcccagtgtgaacacaaaacagaggttcatggctgacaggtgggcccctggagtctacccagccatggccaggaggttgaaggagcagggtttgtggccaaccagacctggattcaaaccttggctcctccaactgtgggccaagagaccttgggaaactcaccctactgttcagagccttggtttccccacctggatgaagaaggtcatgatgctttccttggagtgcttttggtagatgagctgaggagatggctcaggtcagcccatgtggcagcacccctgccctggctcaacagcttcacacgatcacatgcggtcaaataaggccaggatgggaagggaaggctgaagccatgccatggatcaggacccagactcaagagtcagacctgaggtgcagtgtcagctctgccacacactagctgtatgatcttgaacaagcaacttagcctctctgagcctccctttcctcttctgtaaaatgaagactccatgaaattgtacaagtgctgctcagcccagagcttgtgaccacggtcaccattcccagcattcttttgcctgcaggctcccattctcccaccccatgctctgaggcagctcccttgacccaggagcctcatttgagccccacctctcccagtgcccctgtttgtgggctcggggtcaccaggggccagatcactgtcaggaaccctcaccgaaggagagaagcaggccttttcccagaccagtacccattgcagcctttgaatagaacacttcaaattactcctctttcaccattgctttaggctttccaagctccaaatgggccttcttactggtatccctaggctactttaccacccccctcaccccacccacacagctgcatcaggtgcagcctgtgcagagtgggcatttgtatgcccttcatggccaagtataagctcctgcttcctgcatttgagatgctcgtgctcagggagttggcatgaggcatcctcgtccccatctcaaactggactcaacagagatgccctttcctgggctcttacaactggattactagggcagcctcactaccgagccccaaagaaaggcgttcatcctcagagctcaccagatgggatgcaaccgtgaaagccacccaagtgcttgctttctgccccaggggtttgggtggcatctgcagaaggagtctgtgggcttcacagaccactgatgagggagtgtggctacagtgggtgtgatccattaagagtgaattcagggctgggctcggtggctcacgcctgtaatcccagcactttgggagaccgaggcgggcggatcacgagctcaggaaatcgagaccatcctggccaacatggtgaaaccctgtctttactacaatacaaaaaaaattagctgggtatggtggcacacgcctgtagtcccagctactcgggaagctaaggcaggggaattgcttgaacccaggaggcagaggttgcagcgagcagagatcgcaccactgtactccagcctgacaacagagcaagactccgtctcaaaaaaaaaagagagaaaaaaagagtgaattcagaagttgacagctgctgctgccgccggtctgtgatggtgaaacaaccccatagatttatatggaaaaaaaaaaaagtgcgttgaccagaattttatggcatccaaaatcctatctctttgggtctttatatctaagtaccataattactaagggaaaatatccttcttaaaagaaaaatcaaagcaattgacatatcatcagatgtccactaatatttcatgggtaaacaatccttcctgccttctagaagctcctcctcccacagggaagcaggtgggaaggacagcagctaccatacagcatcatagctggtctggtggagtgtataattcaattacagcggaggggaaagggaaataaagagggtcaggggtcacttttatggtttttttatttttttattttttgctttttgtgttttgcctgagtctttgcaagagttttttgttttcgtttttgtttttaattcaagtgtttagccagaatgggtctaggaatagatttctttcctggaacctaataaactcagaatgtatctagggatagatagatctctttcctggagcctgataaactctgagttctatccctagatacattctggctaactacttgaattcaggaaaacacccttctctgggtcatctctctgttctcaggcccctgtgtccccttatgttctttcttccccttcttccccttctcttttcattggcactgagggagagcttgccaaccttgcccaccacatccatgatgcaaatctccgcagtatctgcctcactccttattgtttaattttttaattcttctgccatgtttttagtattctttgattttttttcatatctcatgcatctctctttccatcgcatccacccgcagtttcatctctgacagttctctcttatcacagaaaccttgtcttcttgtactgtattcaaaagaaaagctgtttgaactttcttccagatcctggaatagactgtgtggggaggtgtggtctctcttatccctctacttctcctacatgcagttcaaacccattacttggaagtattctttcgtattatcctttttggattttctttccccgaatgtacccttgaatgtaataaaatctattcagctttggggtttattaataggcaaggcatttgggcttccctctgagcacactccagttcttttctggaagtagcaatctacaaatgaatgtgagaagatggtgggcaaaagagtgagtcagagcattctagaacccctccgatcagctcctactgggcagtgagtgtactggtcattggcccaaattttctggtttccatagccttggatcactgtgtcttgggaaaagccccaggagatatgaattattttggtttcaagagaaaaggtgtaaatctgttcaatttctgtcctgtatatctgccctatagtatattaaatttcttagatcctagcactaaggctgtctgtccataagtcttagttggtaaggaggtttttagtggtaagtcagggaaagctctgtgaggggcggcctagtctcttctggaaggtttccagaaactggtctgtacccccatctcctcctaaagcttcaggaattttttctcaagtaacttcattgagggccaacattatccagataatctgcaaccctttcacatgcattacctgctttcgtcttcagccctgtgagaaagttacaggtactatctctatctcccagatgaagaaagcaaggtcccaggagttgaataactcacccagaatcacactgaacaataagtggcaatgccaggatttgaacagagatccctcaggttttcgtagttttcttatctttcctccagtgtatgtgttgagctacatgtgaacatcacatatgacatagtatatgtgagtgtgggttctgcagtcaaactgtctgggctggaatcctaccattgtcacagagtgaccttgggcagattactttacatctctggagctgaggagagtagccagggcagggggagagcagatgaatgaactctgtgaatgctgaagacatagataaccctcttttgtctcactcacctcttgattcctttggggtctctcagtggcacctgaggatgattcccccacgtaaatgtatgctagaggattacttttttttttttttttttttttttagcagtttcatgcccttaatcgtttgtgtaattaatgcctctgttgaatgtccctcttctgccaggctgcatgcctcatgggttcagggcctgtgcctgtctggttctgctgtatacccctgtgtctagaatgtgggaggtcctcagtgagtatttgtgatgctaaggccctgtcatgatggcggcgcacatcactgagtgagctggttcctaagcacatcaccctgtgcccttgcagcttcctctccccaatgacctgccaccttccttcagggtccttgcttcttctaattggtcagcagacatgctttcctgccacttcggcctctgttccctgcagagcatcctctgacgatgtagccagaatgtcctaatgaggggagcattggccacaaggcctgctggtgtagcagaaggggaagtcagaattgagtaaaattgctgctggagaaccagtgcaccaattggtgcagagcagaaggatgggtctcaaggaggtgaccgggagaccacagtccagagggtcaagtttcttgggtcctttcccaagggagttgagtctcatgggcagaggagaggcaatacaaggagagtaggtgtaggcaggccttccaatctgaagctgaccccagccagtgacggcccaggctctcccctaccttcccatcccaccccaccacacaagaccagactaacaagagcactggctattccatcacccgctgctggcagagctgagggctgagtgcttggcctgccttgggtgagactggctcccaggcttggtgggaatagcgctgcctacagaccctgaccagggcgttagggctgcaagaggcagggctgctgctgggccagctggatctggccaggccaagtgccttgtgtccacagggtgtcctggagaagggtggagcccacagagatggctcctgccatggagtaggaggagcccctgcccactgaaagcctgcgacctccccatgaggactcacatcctctcatctccgttgagaaaggcagggagagatcaaaacacctgagcctgaaaaccacaaataaattcacaatcagatgccttcttccttccagagggcccaaggaacctctcagtatttcatttcagcaaaatcagtaaagaatttactttgaggaagtgaaaatcagtttcgatctagctaaccctctgaaaatctgttgcttgttttccagagaatgcagggattgataattgaggtttagaatgttgtcttttgttacacagtttccattgagtaatgagtaaagctgacagttttgcatctgcctccattattatttttgttatacttaaagactaggtacagtgtggtcacagatacgcgagtgcattagtggaagtggaaaatactttggcgactgaagcggctgtctgtgatctcactctctggccgggatcctggtggcctcggacgtttggggagcctttctgtgcacagtagcaaatctctgagccagggttggaaagacaagctcaagagtgttttccttggcacatgggcagcctcggttctacccaatatagaggcaggtttctaaggctttcactgggggaatcatcttgcatttccttttagtgacgttagctcctctggaagcactttatagcactctgagaaatatgagtatttagcttgcggataccacagtgtggggctgtcccttaacagagtggctgtggagtggggtgcctggcaaccgcagccacccttccactgagcaatagaatttcagaggccaggttgaagggagtcgtgtatattccaataaagattcaacatggggtccattcatttccctggccattttctgagcccctgctctatgctaggcttggtgctgggcccttgagcatgcagagatggataaggcacagcccttgccctggataaatgctgtaatcgaggaaaggacagtgtgctgcgagcccaggaggagccagttagcagccaggaaggagaaggaggcacagagggaaggggaggaaacccctctgctgaggctcagaggcatgagacagagggcacatcaggggctgcatggaggggctggcatagttggggcatcacatgagacgtggaggaagaggctggaaaggtagtgtggggcagagcccagaaaccttggatgctgtgctaaggagttttcacattgcctgttgggatagaaagccactgggtatttttaagtaggtgaggggcatggtctaatagggtttgagaaagatcacagggtatagactggactggaaatggagagagcaaaagcagggagatgtatgaggggataggaagcactaacagattggagtcagtgtctgtggcctttaaatctaaacctgaagaccaaccaggggctgagaacgctcggaaattcttgtgcttcacatattgctctccttctccctgccaaaaaagtgtttgcttctttaatagaaagagaaagaaagaaatatcttgctttttttttttttacttctaaaactgtagtatatattcatagctaaaggttaaaataatataaaattgtataaagcagaaaataatcctgcagtttcatacccaaagatggctatcgataacagattgagcagtgtattctctgtgtgtgatctctctattgttacaggcatacctgatgtttttcacttaaaaacatatcatggatatctttccgtgtcagttcttagaaatatattttatccttacaatagctgcatgatgttccgctacttggatataaaataatttatataaaccatgtgttttttgtataattataaattacaaacaatgctgcagtgaacatttcttattaatgtttgtagtagtattgctgcaatttgtagtagtattgctgtagagtaaatttctagaagtggaattactgggtcctagaaaacacattatttgacatccaaattctcctcccaaaagtttctatcaatttatgctgtagtcactcttgtatagtgtgactttttccacacgctcatcaacactaaatattatcgatttttaagaactttgtcagtataaatgggaaaaaatatcttgttttagtttgtaattccttgattattactgcatcttgggaatctttcacatttttatttacatttatactcttccacaaattgctcatcttttgtaacattatttgcatttattgtaggagctctttatatattaggactgttgactgtcttataaattgcaaatatttttcctattctatttgtctttcagcttcatgtatggtgttttatttgatcatgcagaagtgtgtgggttttgagaaatggaccccaatatgtcagtctttttttaatggttttgggtcttatgtcacacttaagcctttgcgtacctcagcattataaaattattcttctgtattttattcaagtactcgtattatttagatttcaactccctaatttatctgtaatttattctgttttaggaatgaagtagagatccagctttatatttttccaaatcaataatcatttgtctcaatatcatttattgaaggattgttccttttcctattgatttgaaatatacctgcatcgtatactaaatttctgtatctctatgtatgtattgctgggctccctttatttgtctaactctgtagcaatactatactgcttaatgactgggcatcacagcacattttataacaagcccctctcttcattcttcttgttaaaaatgtttattttcatacatttcctcttccaagtgaactttggaatcatttcagatatgaaatgtgtatgttaattaggcaataattgacatccttgcaatgttgtgtcttcccatctaagaatattatatatttccttacttatttacatcttctttcaatccttcagatatttttacttcattagtttttacctgaattaccaaagtgttacattctcattgcaacaactcagatacaaagagatgtagataaaaggtttgtattcttatgaattgtgcctttatttagtaaaatggatgctttggagaaggattagtaggcccaggatatgtgtatacttgattttaataaatgttatatattatttttctatcaaatatgttttattcatataagtcttacacatttctaagtttattcctaggtgttttatagttttgctgttattgtaaattgccctttttttccattgtgttttctagctgatgattactgttatataagaatgacattgatttatgtatatttattttgaagttaactttgttattctaatagtttttcagttgattatcctaaattgtctaattatatcactaatgtgataactaatcatatcacctgcaaaaatgacactgtgatatgcatctttaatattccacatttgttgtcttgctttatcacattcagcatagtgttaaatgatagcagtatgtcagatattcttgatttgttcctatttaataggatttcaatattaagaacattgttttaattttctaatatgtatcctttatcacatcaaggaagtctgtgctttatcaggacacgccaatgagttttatttgataatattttatttggaatccctgcatcttgatttattaatgtgattggtctctgttttatgccacctctgtcaggtttgggtgtaatggttatgctagaatcgtaaaatgaactgcagctatttctgatttttcctgttctggaacagtttaagtaacattaagtttttcttttacggttttatgcatgagctccttaaaaatcatctagatattgtattttaattatattaggttggtgcaaaagtaattgcagtttctgcgattaaaagtaatggcaattacttttgcaccaatctaatagtatctttctccattattaatatttttctctttattagtaaagttttttgcctcttcttcagagaactttgagaagatatattttcctactaagcattcatttcatctagattttcaaatatgttaccataaaatttacacataccactattttaacatctcttccatatttgaaatcatatccccgctctcatccctaatattgttcatctgtgtctttttcctcagtcgtacataccaaaggattgtccatttcattgattttctcaaagaaccaactttcagttttatttatcactttgctagactgttgattttttaaaaattcattatttatgcttttatattttaaattgttttctcgtttcttttttttctagttctatataatgaatacttagttcactttttaaatgttttttaattattaatataagcatttgaggctgtggacttttctctcggtggttacatggccttgcatcattgtggataattttgatattttaattttaacttattttttcatctcagaattaattggtaagtgttttttctttcccaaataattatttttaaaaatttgtttttacccatgggacagagaagggggtggaattgctccagatgccccgaagccacacgggttatgagtgtgggaggtataatttccccaaaaggaaatcaagggctgtttccaaaataggtagtgggtgttaggcagaaaaaagtgtcagtttcttctctattcccaattgtcattgaagggttaaatgagctagtacatgtaatatactcagcacagtgtccagcatgaaaaaaggccaataacagtaaccagatgcatggcctctcctcatgccccttcttactgccagtcagaaccccagtgcacgctatgccatccattgcactctgggggaacgtttgcaaacagtgggttacctctttgtgcctgtacattaccaggcaatccccagggcatgaggggatctatagttgtgtcctcatttcaccttggggagccaggaggtgatttggcttccctggacttcaggattctgtccagacagcaggactttgcccacgtgcctttgtgattcatgagccacaaccccaagtcatacacaaggccatgtgctcatccagaaagcgtggcctctgaccacctgccatgtgactgcctgcgcctgcccccttctgcagaccgaggaaactgtctcagtgacagtaagcttccaacagctttcacaaaaggaatactctctaaatgaggatttgttctgaagccctgttttgcttgttggatattaattagcaggtgctagttaatactcacagtcttccccatcttctcagggagcctgggccgcctgctgagatctcatcatgcagtagatggaaatgctttgtgctctcttaaagagagcacacacatcctaatgagctgctgctttgttatttcatttggaatttatcaggacagtttatgtgatcaaaccacacaaatatagttctgcatgccagcactcctgaatactgaagtttgaaagtgatctttttaaggcagagcaggagaacatggaaaaaagtctttcatctcaaactttgaaaaagggagagagagaaaatggaaagtataagatggaaatgtggcacatttttatgctgtagagggtttttttttcccctcaacacagcagaattttccttattaaaaagatagctgtatgagaaaaaccaaaaccagacttgggttggaagtgagacagggtggcgatgggagaacaagggagcagtgagtctctgggcttgtgggaagccctggtgccagccgtgggctttggcttggggaggctgcaagcgcccagcttcaagcaggctctgggccatcgagtatgggtgtccctcagcttcagagaaggtgtctgttcggaagagcacctcctttgtcagcctggcactccctccttggggccgggtgtcctgtggacacctctggtggggagcctgtattcactgtcaagaagcaggtttggccacctgccccttgtgttgaggccagcccagctgcggagggcttctggagcagaacgaggtgagagctgcccactctggccctgggggtttgcctcaccacggcagtctggttggcactcatgtggcagctacagcagtgtcaccaggccctgtgtggggcatggaaggagggagcagagcccaagcatggtctgggatctgtctcagaggaggtccagtctgcgggtgggcatagccatggggcagatgccagctgccagcagtgtcctggggattgggggaagacaggccacagcaggggtcctcacacccccaactctctgcctggaatcctcatccctgtgccagccaatgacttccagcccccagcctccagcccctagcactgctgtctgtcccagatctttggagtcaggcagtcctgaattcaaatcctgattctctcacttgcaagctgtgtgatcttggccaattgaaactaagcttcagtttcctaatctgtaaaatggtggggaacaggagtgccttctgtacagggtcactgctaaggtgccatggtaaacacaatacttcccttccctagagtagacagtggctgttactgtcagggttgtttcccccaacaggtctgcacctctcagccttgcctggtccctggcactgtccagccccaaggcagccagggccaatggctgatccagttactgtccatcttcataaggccaacatcacaatgtcatctgctttggtaactctgtgtaaataggaataggagctgagatgtccagctgtgctgtcccagtccaggtgacagctccaagcactggtccaactgaggggtggccaccatgcagtcagcatctgggcgccatccacggttgtggcaaacccagctgggctcattcctcccatgctgctgcttcaaatagggccagccgtaaggtcagctcagcttcttatgcacttcaatggtccaggccctggactgggagactcgtgtaaaccaccgttattacccttattcacagtcaaggaaactgaggccctgggaggtaaaaaggcttgcctaaggccacccagctggtgagtgggagagcctgggttccgagtctcctggatccgggccccacgttctctcacttataccacagctgcttgtcatgtggcagagctggaaggacccgcaggactgggtgggacactgatgatgggacctggggctgaccagactgaccacagtggacatgagggaggtggagagtagcaggtggtagatggcacaggggaggcagccacagtagagtcatgagcccttttggagagtgttgaccccataggggaaatcaggcagggacagccatagcctgggttcacctatgcccctatcttgcctcactggctgccatacaccagagagtctggctggagtaaaagaagaaccgcccatagacaacctggacagacctgtgctcaaatcctgcttctgccagttcccagctgtgtggccacagacaaacggtattcccggtgcactctcagcttcagtttctttccttataaaatcacaatgaaacctccctgacaacagcatttttcttatgaatcgataatctgggcaaagctcttagtttaggacctggcacacagtatgtgctcggtaagcattagctctctttatcatcacttgactggtggtggctctctcttcagctacaaaacgagggtaacatgtgcttcataaggttattgtatgagttaaataaaatatgccttctctcatgcattcctttgtcagccagcgtttaccaagcagctcctgtgtgctcagttctagatgctggagattgagctcctggagcaagacacacttcctgcccttgaggcgttaggcctgatggggagtcagatttgaaatacacaaatgatgcaaacaagtgtctgtgtgcggttgtggggtgtgccaactacatgtagagctcagcactgtgcctgacatggtacaagtggaaggtggttattcttacgatttcattatagtttaggcttatacatatctctgttgtggactaatacagtactgaaaagatttctgtggatttgtgcagcgttaactgtaggagacttgctgcttgtgctgtggttttcattgtgggagtgaaaggctgtttatagggaagttctttctaggcattgcctaggctcaaggtctccccacatcactggagccaggaggcttccttttgaggggtgctctacccagtccgcagcaggtatggccttggctcacactcctgggtcttgaggagtaggcaggtgtgggcatctgcacgttttgtagaggggaattatgaactctgtgggcctcagtttgcagagcaccactcagggatccacttccaggaacccaagaggaggcccagtgtccggcacctgttctcacagggcagcacagggtgcacctttcatgttgagggtgttacttgagaaaaggcaactccctctgtgtttctgatgaccagtggatgggaacatgggtgcagcagcctgatagacctgggttcaaattccatcacccttgctgtgaggccttgggcaggtttcttaatctctttgagctttagttttctcctcctactttccagggttggtggcaggatcccatgagacaggagggaagtttctgtcttggatttgatacccagggagcaagttgcctttccccccatcctgctctccagtttctctgcttctaggctgagctttcactctgccactctgagccagctgggccgaagtctgcacattgcgtctggaataaagctgccctatgtcccacatctcttcactccctgccatgcactagaggatgctttttgttgtggttgaagcagtaatagcatttttcaggattgccgttgctgacgcttcagggtggtaactgagttacatttttttttaaattgtgcacatgtaccctaaaactgagttacatttttaagagaggagaagaaaaacaaggtgaagagaaagaataaatctgtggattcaaactcaccaaacttggagcttctctacaagggaaattatttctaattattaaaattttggaaacatggtaccaccaggaagaaaggaagtggaaatggctcctgtgagaagtattagcatatgtttctgtgatttaacagtttcccgtaacaatgtgcatctattttaaaagcagacgaatgactcatggtatctagcaccagtgctccactgtaatggcaggaagtgtgtaccctggaggaggcaggcttgggttcaactcctgtctctttcatttaccagctgcatgaccttgagcaagttacacatcctctctgagtttccttttccttctctgtaaaatagcttgttagaaggataaatcagataatgaacatataactcttagtgcagtgctcatctatccatgcacaaaccctcacaacttttatataattaaccaagttaattccaatatttgtaataattcttagttgtttaatagtaaatttttaaggctataaatttccccctgattaccattttggtcagaacccataagttttgatatgtagtattctccttgtcattgtcttcaaatagattcttcaaacagattttttattttttctttgacctaagagttatatgagtgtgtgtgtgcatgcgtgtgtgttttcaaatggttagttttttttctgtatttattgttaaatcctagatgtagtaaggtcaatgaaagtagataatatagcatttactttttaggacttactgaggttttctttatatacaatcaatttttgtactccatgggtacctgaaaagaactatattttcatttatagaaaaccaagcttgttattattattattattaggcagagtcctgctgtgttgcccaggctggagtgcagtggcccaatctcagctcactgcaacctccgcctcctgggttcaagtgattctcctatttcagcctcccgagtagctgggattacaggcgcccaccaccacacgtgactaattctgtgtttttggtagagattggctttcaccgtgttagccgagctggttttgaactcctgacctcaggtgatctgcctgccttggcctcccaaagtgctgggattacaggcatgagccaccatgcctggcctttttttttttttttttttttttgagacagagtcttgctctgtcacccaggctggagtgcaatggcatgatctcagctcactgcagcctccacctcctgggctcaagcaatcctcctgcttcagctttccaaatagctgagactacaggtatgcaccaccatggccagctaatttttgtgttttttgtagagacggggttttgtcatgttgcccaggctggttccgagctcctaggctcgagcaatccgctcacctcggcctcccaaagtggtgggattacaggcgcgagccactatgctctgccctaaaacttgttaacgttgttactgtaatactgtatcattgcattaatatatatatgtgtatatgtatatatatgtgtatgatgtatacatatatgcttatataaattctggaaaagacataccaaagcctccctctatggttgtgtttttgttgaactcacttttcatttctaacttttttatgctatgtattgtttgatgtgttgtttctttatgcatagaaatttgtaaccattagatcttcttgatcacctggacttttgttttttagagcaagcactcttccttgctttgcttaatgttttctgccttgaattctgctttatgtcacttctcctgcccaactctgccagtgtggtgggcacaatagcagtgctcctggagggcagctgaaaggacgttccatccttggcccatgcacatctccaggtggtctgaagctcggccctgcagctagtcagccagctgagagctgtgtagtggctgaatagccagcggcccttccccttccccagccaggcagtttgtcctcaaatccccccggcttatcactggcctgtgatggatcttactaagattcttttagacataggtttgatcttcaaaagctttgcagactacatgttactatttctgtaacatagctgtatttttatttcacatcttattttcttattaagcacgattggccaaattctctagctttagagggaattttttgtactgagagctgttgcttttttaattttttcttttgtttcttagttaatgtatggtgaggtaggggtaggggaacagatagacaaatagacagctgggcaaataaagaagaaactgaattcagcccaaatgggtgttctcctggacatggcaccttagacctattaaacttcagcagttggtaagaaacacaagtattcatccctttcatgtcctgttattttctagttgggttacaggtaaaagccttattgctggagagtatttgaactagaaatgctaaaatcttgccagcatacattttggttgttgctcagatgtttgatttatagttgggcagtgctgtgtgaaaaaattagtaatcaggattggaattaaagtccaaatattatctcagttttccataagtcaccctttatattttttagcagatcagtactattttgtgctattttgttctggtttgtggtaagctccttccatcatgaaatatcttctttaattttaggaatctatcttctggatttaatctacattgattctgcatatcctgcctcaggcagtatcatggaaaatgaacaaagatccaatcagatgaacaatattcttcgaataattgctgatttacaagtttcctgcagctatggttagtacccttgttgttagaattgtgaaatcttacgtcattgaaatttgggtcttaccagtgagaaagctctagaaacctttcaaagaactacaaagttcctcattttaatatatcgagcatcaaacatgtactagatccttttatacataggtttgatcttcaaaagctgtgcaaactaggtgttactatttctgtattacaggtgaggaaattgaggctgaaaacagtttagtcacttgtccacaatcacgcgtctagtgagtggcagagctcaggtctttctggcccctgggtcattcattcatgaagagctttctgggcagctctcctccaagcagattcggggaccagccttcattgttctgtgactctgctgtctcccatggcctcagaatcctccactggactctgcatccagctggcaggtgcaggatgagagagaaccatatatgggtgggttttatggtccaggcttgcaagcagtgcaggccacttttgctgacaggggctaggagatataatctagctgtgggcctgggagaagggaaatgatgtggtaagcgactggccacactctgctgcacgtggccaaatccacagtgtgcccatgatggtggggtgtgtaagagggatggagaaaatcattggagatgatgtcagaatgctggatgggccatccatgtggggattgatttcacccgagaagatggcagacttggggtgtggagcttgactatgagccaggtgctcaagtcttctgggaattagcactgatgagcaggcggttagtcagcggaagtcagccgtgaagggggtgtggtgcatggggggtggggctctaggcacctgcctctggggagcaaggctttcacaagagggcagaggagtaaaagtccggaagcaccaaagaagggtggtaggaaggagcctagcctcacttgctgtgcgtagggtgtgagaaaatccacagcctccgtttgggaatgtcacagggaagccagggtgggttcaccaaagcaagagccctgctcaccagcccctccacagcatccccaggcagggtgggggttcccacacttcagggccgctttcctctgacaggaggggtaggaggcacctgtattcccagtgcaggtttcgcctggcctgggccatctccagcacaaatacattgatacttgttgttccattggccagcagagcaaccacagacatgggcttcagggtcagatggactccggttcctattccagctttgtctcttgaaaagtcactttctccccttgaaggttttctcatgcatgaaaatggggataggattcatgcagagcccttagcacagtccctggcatttcatgagagcccagcaaatgctctcttaccactgttcaccttcacctgcgtcatctccatcagttttgtaaaacaggtatcatcctcacttcagagagaggacactgaggcttcagagaaacaaaatgatctgctcagaatctcgctatgaaaggccagagctatcgggtgctcatgctgcacctggacgcacctctccagaaagcgagggtccttcctcgccctcttttctgttcctcttcacgacctcctctactccctccacctctcctcttggcttgttctgtcccacccagtggccctctcagaaggagtgcagtgactgtgaaggtctgcagagagcagctgacaccagtccctccagaaacgggcaacaccgtgtggcagaagccttccatcacctgaagtcccaacccagctctgcccttctcagcaatgcgacctgtgcaggttgccacagtttcttcctctgtgcaatggggatattgtttctcccacgtgaggcaggtgtgaaggttaacaaagatgactcctataaaattacctgctgcagagcctggtacaggcatgttcaggtgcctggacccctccctttcttcctagggtgcagcagctccagtcataggccagcttctgggttaggcctccacacctggctggacagggtctgttcattcattcttgaattcatgtcacacagctggtgggtagatataggaggcttgcccagttaccccaatggaaacctgttttagggcacagacacctggctctggtctgttttggaggccagggagccatctttccccagtccctgatatctgagtggaggtgcagctcctccttcctggctaaaaaaacatggtggcctcagagtgtggtgactgaggcccggtcatctggggggtactccttgagggcagaacccaggcctgatgatccctctgttccagtggccagcacagggccagtccccaaagagcatcagcaactgctggaagagtgaatgagtctcagtatcctgggagcatctaaaatcatgatttctatacttctcatctgggggcctaaagatgggagagcctaaagtttctggatgtggtccaccttttgcagatcacctcaccaccctgccccatgtgcagaagtacctgaagtccgtacgctacattgaagagctccagaagtttgtggaagacgacaactacaagtaagtccccacgtattcctgtgtcaggcctcccagccccacttttgtccttagtgctcaggtccctgcaagtggcctagcccttgttgggaccagtgagtagccacctgcagggcttatcagagtccacagcagtagcgcccaggccccagcacacacaagcacacgcgtgcagtgtgatctttgacctcacagccccgcagtggtgatgtctgaacagctctcatacccatctctgccccatcctcatgggccccccagttcagagtaaggtgttgtgttaacttctcagtatggctttcccacatggcgtggataatatgaacttggaccccacagctgtgaatggcacaggcgtggtgctctggttctcacaagtgactcccccacccacagtgctgggtggcaaggcagcttccagccatatctccagactagcaaacagagttctccaagagcctgtttcatggatgagacagttccttataactctcagctctctgcagtattcaaggccctacctccttccccgtagagccccagtggagtagacccagttctcataacaaacccatgggccctttggcctcatcttccactaaccctgctgaggctttcagttctttcttcatttgtggcatctgggaatttatccagcatttctatgtatttggagggaaaagaaggatttttttcgtgttaactctgtctgccatactgcttggcaagtcctcttggcccattttcagcttgattgagactaactaagaacctcagtactttttcatatgacctggtattaaggcaagtcccagccatcttgtaatcaatcatttacctcttaaatgtcaacttcacattcacagatggtccccaacttaggatggttcaacttaacgatctttcaactttacagtggtgcgaaagcaacgcacattcagtagaaactgtactttgagtacccatacagccattctgtgtttcattttcagcacggtatttaataaatgccatgagatattcaacacttccttataaaataggctttgtgttagacgattttgtaagctcttataagtgttctgggcacatttaaggtaggctaggctaagctatggtgttcggtaggttaaatgtattaaatgcatttttgacttgtaatattttcaacttatgatgggtttattgggatgtatccccgtcgtaagttgaggagcatctgtattcttttaaatcttatcttatgatggcttccaatatgccatgattccttggaatcttgttattccagtatattttttatctcttccagttttgtgtctgtgaatttaattagccagactgcatggtcttcatctaagttcgtgaaaactgtagagaactgtagccacagagacaacccccacgttacccacagttcactcaccaggaaagaccctaaggggaacggatgttcaagcagtgtcccacctggtcagctttacaggagtggtctgcagccgtggctgtgaaccagagtcacctgggaaactctaaccatccagatgtctggggtggggcctgaaaaatctgtattttttcaaagctccctaggtggtgctaatgatcttttgcaacatagacataatgcttttagttgttttatataataatttgttaaactataataagaaattgtgatctgttacccaatagtaacaacaatagatgaaagccagagattaccattaaaattatgcttaccacaaatcaagctcattttatttatttacgaagcattggctcttcctgaaaagagtgccctggagtacaaaattattcccacttagtttctgggataatattttccatttatgcaccagtattgtgataaaggagacaatggtttttcattaacactaatatgctttagacagaaaaatggcctataagtacttctgaccatgagataatctttggacaaactgcaaatcatgagtaattactccttctactttgaaggagtaacgcctcagcacctgatgctaaacaacagtcagcctagctctttgttgtggtcaaagtggacaaacccagggaggaggcctgcattctcacccccggccctcagaccatctagggagttcctcctcagggaggtcctggccccaaggggcaagagatgggcagagcctgtgattctgcttgaggacccacactccatggcccaactgacatctggaggctggctcctcacccacaaggatgcaatggcttagttattaccttagtggcattgcattgctgacattctcccccatctgctttggagatgttatgccaagaggtccaaccagtgctttattccccacagcctttattctattttattttatttaagaaaaattacccaatttcccattacctagaaagcatgaccattagcattaagtgaacatacttttggacatttttctatgcatagaaaatgtgtatatatgtagggaaggatggatagatggatggatagaaggatagaatattaaaattggattctactacactggctatttttaatttaaaatactaactttaatttcattttaatttaactagaaaaaaactttcatgtgaaaaaaaaatgctgctctttaaatatttatttaccaaaagagagattattttccaaaagagccttctaaaattaataaaagagggccgggcacagtggctcatgcctgttcacgcctgtaagcccagcactttggaaggccaaggagggcggatcacctgaagtcaggagttcaagaacagcctgaccaacatggtgagccccgtctctactaaaaatacaaaaattagtctggcgtggtggcgcacgcctgtagtcctacctactcgggaggctgaggcaagagaatcacttgaacctgggaggcagaggttgcagtgagctgagattgcgccactgcactccagcctaggtgacagtgagactccatctcaaaaaaaataataataataaaagagatcaggaaaaacattaggaggcttgagtcaataagttttattttaactaggtttccattgtgaacagtgtcagccaactctggttatgaaagatgagaatattagccctctccccttccttaacctccacttcaccagcttccaactttttgttagttgtgttattattaccacatagtccaagtctataacataagcatgttcaggaatcataattcttactgtttagtatttttaaacagattcagtttttaccacctgttgtttctccatagtttttccattcctggagtctttattttaatcagtcccttaatttagctgcgtttcatcaggaagtaggaccccctacctactgctccaccagaaaaataaaagtgctcacagggcccgcatgccctgcattccctcagagaaatgtctgtgttggactagacccggccttgctggctgccctcctttgtttctctccctcagcactgcaggccgtgtgccgttgcctctgggctttgggtgttgctgtagagaatgagcccatctaattttttttttcctcttgttaagggtcctgtctgcctggtaggtgaagaattccttaaagttcaaaagcttcataagagaatgcctcagagtagagggttctgtaccagatttccccagaccatggtgtcgtcatctttcttcatggcagaagaattccttttgtttatatctttgactacttctgtgccatttcgtggcttctctcttccagggattccaggaatccgtccgtgttggatgctctctgcccgtcatagccattcgcttcttgctaacagcggcaacctccatcttgttcatcagctgtaactgggattgtctatttctacttaggtattcattcagcactctcttatttcagtcctggatttgttccccctaggtcttcaatctccttttttcttctcattcctttgttttagcatctcatttttcgggttttgttttacttgtgtttgtaataagttgttccactgctctaagcacttgaggggatttcgtctgctcctggggctgccttctcggttgggccattgggcaatgctcacctgttctctttccttcttttgcaagaggatgttggctgtattgccataccatttcttttcttctggctcccatttgagaagctctgtctggatgttccatgggtgtgatccgagggtgggagagatgtctggccctcctcccatgtgtgtgaggggggaaacccttactgctagctgggaggtccaggggttttagtctttctcctcttctgtagcctgtgggagtagaaggctcaggctctgtggaggcagtaagcaagcagtctgtttcacatatgtgtgttctggcaaaaggcctatgttggagtttccttcacctcgttggggagctgtatcccattccagaaagaggtaccctcaggtttcacatcatgccccgtggagccttcatttccatcagaggagctgccgtgctctccacctagttccttagcagctggtgccattcagcagagggagcgataaggacccccactcagacccagtgagacccctcattgggcttgacaggagccatgccatgatgcaactcttggtccagtttcagaatcctctttttctttccttaactctaattctttgaagttcatggctttaaattatgccccttcccttgtttagttgcacctggtgagttcttttacttgtaagcttttataattttttgttggttttgggaggagagggagagtctggcatctagtctcactctgtcattttcacccagaagttcctattcggtgcttcaaaaagatatattgaagggccagtcctcatagcatgtccgttgccttgtgcctctctaagggcatctgatcatggggagtgcagtgtaatcattaaacactccagttgagaggccacgtgcggtggctcatgcctgtaatcccagcactttgggaggccaaagcgggctggtcacttgagctcaggagttcgagaccaacctgggcaacacggtgaaaccccacctctactaaaaatacaaaaattagccaggcatggtggcacacgcctgtaatcccacctacttgggaggctgaggtatgagaatcgcttgaacctgggaggcagagggtgcagtgaggcgagatcttgccactgcactgtagcttgggcgacagagcgagactctgtctcaaaaaaggggaggccgaggcgggcagatcataaggtcaagagattgagaccatcctggccaacatggtggaaccccgtctctactaagaatacaaaaattagctggggttggggacgcatgcctgtattcccagccagctacttgggaggctgaggcaggagaatcactgcattccagcctggcgacagagcaagactccatcaaaagaaagaaagaaagacagagagagagagagaaaagaaagaaagaaaaagagagagagagaaagaaagaaagagaaagaaagagaaagaaagaaagaaaaaaaaagaaaagaaagaaaaaactaactctggttcagggtcacacattcctgggtttgatcccctactctgccacttgctaatcctatgaatttggggaagctgcttaacctcaccactcctcagtttcctcatctagaaaatgtactggttcagagtgaacacatctgtgctcagtagagagtaggccacactcaactccttttcactttgtctttcttaaccattgtttcttggctgtggaaacccccggagacctcagagggaagtgactgtgatctggagcagatctcacagtattcctggcttctgtgactatagtagcttttcccagccccaaacaggttcctgtgtggtaaaccagagcccatctgatcttatgaaaatctttgttttcagactgtcgctcagaatcgaaccaggaagcagctctccaagactagtctcttccaaggaagatcttgcaggtatcgtagctacctcgagtgggagcaaacccacttaatagcctaattgtggctgccagagttggccttgaccggggaggccaagggcaaatcaagtttgcagcttagcagactcagctatccctgttcacagccctcctgcaccagcctgcccaggctcctgatcatgcgggacttctgtggttcccctctgtgccggggctccctggaagagcctgagtgttagagcctgggcctgaacagccccaagagaggcaggatcagagccccaagttgggagcacacacaaggtagagaaagccccagcatcttctccaggctctccagacccttagcggggctgctgcccaggcttgggtttatgtgccctggaggggtgcggaggatgcccagggtatctggtgccaccagatgcaggtggctcatcagacttgtgaaacacacacacatacactgtcccctagtgatttgagcccaggctttgcagtcaagcccgagctccgctgtttcctggctttgtcactttacctgtaatcttcagtggcctcatccacagaatgaagataatatgacgacttaccttctcgggttgttgtgatgcctgagtaagctcatgcctgcctgtaaagtgctctgctcacactgacattgtgaaagtgtgctcagtgttggctgcttcatcgttattatttaatggttactttttactcatattccaactgactctcaacgacaggagctgatctccactgctgtccagggagaggtcgggggcgtggggggtcaaggggaacccaacagcacttcctccccctggtttgcgctctaggtcataccaccctgggttctaggccactgcagtcttggacaagtgacttaacccctttgggcctccttttttttttttttttttttttttatcctataaaatgggatgatgaaaccttcctcccaggaacgttggaatgtcaaaaacaaaatactatttggaaggcactcggctcagagtctgatgtgccctgtttgtaagggggtggctgctacaagctgctacgtggtgccacacctcccctagcccgttgacctgctcaagccactctccccactctctggtgccaggccaacctctgtaacagctcctgctggacacaggaccacagagcccatagggccagtgtggcagcctctcatgagccccacccagtaaggctctgccctgattcccaggggggactccgggctgcttgccttttccagcctctcctggctgcattggacaagccagaccctgcctccagcacccctgggggcctctgatatcttagagagacatgctggttgattctcggggtctccggaaatgctattgtctatacctcaagacagtcctggcagaagcttgattttcacagggtttccataagcccagtattaaaatatctcttgcagtcttccaaatccattgccttccatatgtggcaggtgacccccagcaaaggtggccagaaggaaagctcctagtgctggtcttgtctctactttgtcatttctgccattctagaacaccttccccctcggtcagcattgctccttttaggtgcgcagtcacctacaactgacctgtgggggacgaggagggagcagggcagggttcctatcagaagactgtaggagacagcagttgttaagagctacagaaggaatgctagcaaagactagcctattgcatcgggagatagtgccagaattctggagcaaaatgaaagtggtggtctgtccttccgagtcccctccaaattagtgtgaataagaggcctgtttggcctttgcagcctcttcagttcaatagccttcacaggatgagccacatccctggacttctttaaatgccaagaagtctccatgccacacttgctgtccttcagacagctctggaatacccatctcccggtgccccttcctgctgcctgattccatgctggagccactgagcagggagaggtgggagagcccagggtcaggcacaggatggtgttcgccttggtgtgagccaactctgcctttccctagtggctctgtccatccacaggccacaccctagcctcacctctgcctgagagtagcaaggcctctgtgaagttctcctccccaggcccctcgctcaagccttagacattctcccccttgtttttgtggtctgctcctgctcatcctgttgggctcagggtggcctttatttcagctcttggcttctttatggcactcaccacaacttgtcattattctctgtctggtcactgggcccgactcattccttgttggatctttagcacctggcattatgcctgccctttgtagatgctcaattttcgtagggtttttggaggagagggatggatgggtgagtgggtgggtgggtggatagatgggtggatgaagagccaggctgcagctctgggtgggcccctggtatacactagcccaagtgtggaggagatcctgttgctgcagcctcacgactgagcctcagagggctctcctcctccctggtgcctccacccttcacctccagcccaagccctcatctgccagcctggctctccctggcaccagccattcaacacgcctgcatgctgcttcctgccagggcgatggcgacagaggcttcctcttcccctccaggcatctatgtgacccagctggtccctgcatttcaccaccatctgccccactatctcctccctgaggaagagcccagggccctgcctcagcctcagcctcagcctcagcctcagcctcagccctagcccccagcccaggtctgcgctgagcaacactggctcccgctgctaggggtagggagaagaacaggaggttgcagacctggagccaggcttagaaaactaaaagtgctaattgggggcctcaagaatggggtcactcactggtccctggggcaggaaaggaggcactgcatttcctggcctcctttgacccctgactgtcctggaagtcagctgggcagctaggagccagccctggcccagcctcctcaggtacagcctcctttcccacaatccacccacacctctacttggctctgttgtttattagccatgtgagaccagaaaccagcaagccagccaacctccagcatcagagccctggcaggggacagaatggaccccagatggttcacatgaagagactttaatgaacagaaccaataaagcatggcgaggcacccatgggccggcccagggtcctggggagggtggagccctaggctaaagggcatggggaagaagtgttaccaatcccagggatggctgagttctggaggatgattggctgtgcagggtctgtgggcagggagggggaagcaggagcgagcagagaaaaatccctggcctccctttcctccagccctcagtctgccaccagagcctttcattggccaaatccaatagaaagctgggggcaaggggtccaggagatgcatctcaggggtcagcctcccccgaacagaagtggcaagtgggcagggcaaaaaatgcagctgaattgtgtgaacagactactcagcatactgccaagcctcagtgtctctatctgtaaagtgggcataaaatcttcctccttcacagggtagtgttgttattagcacagtgcgcaacatagaacacacgtgttaggtggaacttgatcatggtgatgtgattatcataattgtcatattgtgattctgcctccatcattgcctcagcctgcagcttttagctaaatatcactgcctcggggaagccttctccccactatcacccccacccccaatcaggtcaggccgtctaacagccaggctgtggcaaactgtgggacagatccaccctctgttttcatatgggcacaaccacccctctttggttgacatatcgcctgtggctgttttcatgcagcagtggcagagttgagtgcttgggacaaagaccctgtggcctgcagagcgtgaactatttactatctggcttttacaggcacatgctggccctggctccttcctgcaactggccctcatgctcctccgtggcacttccttctgcagtgatggcacagttagttgtgggcttatttgcccatgtctgtctgctccgccagactgaaagctccttgaggaagggcccagtctagaattcctagagcccaggacagaaatccctccgtcagccacaactcttcaagctccttacagggtcctgtaggcacctggtcctcagaggcagctccagagtgggctgactgctgactcggcacagccttgggagaagtgctgatgctggcagttttccacagcagagcaagccccagctcataggagtgttttccaccaattttccaaatccctggcttcagccctggaagcaggatgtgaaggttttcattgatcactagagggtcgaggagtgcctggaaggtttcagacacactcgggggtcccagcttcccactagcagcctcagaagacagagagtgggtgctgctgcagctgtggggtggcctggggtcctgggaagggtggggccagaggggcagctccagggaggcctttctggacctggcagccagactgagctgcgtggcaggagcctgaccagactcagggacaggaatgtgcctcttgcagtcccgggaatgggaggaacgcaggcttccctggctcctcaggagggggtttaggcttcagctcggtgccctttccagtaggcacatcccccacacctgcaaaggagaggccctaagacatgttcattcattcattcacccaagacttccaggccaaggacttgctgtgagccaggtgcccagcaaggcaagaaccttccccacaaagctcacattttagtcggggaaccaggcagcaaaagctgccaggggcaaggatgggtacactgaggagctgaaaggaggcagtgggagcaagaccaatgtgccgggcggtctctctggccctcttctaggcagcgcccacgcctctacccctctacccagcctacctgccctcacattgacagtggcccaggtctcgccctttgaggccttgattcaagtccgaagtggtctgtgggctgaggctgccctttgtctctgggatggtccctgttgcccacagagagctggcccccactttccacccctgcagaatgacttcacaggcagttccacaccaacaaataggctgtgagaaaggaaatggagaaaccttctcagtttctgtgtctgtggagaaaaaaggccaagaatgccacgttttccattttccctccacatgtaatgtttagtttctataaatgaactaatattttcctggagagaaaaaaatcataaagaacgttgacccccagagagggcaagtaatgtttgtgtgtactttggaactggtgaagacatttccagattttgttagccccgcctccacgtggctttaccaactgacaggttttctcagaagattcctgggcagcaccgcgagtccaggaaaatcttcagccttggcctctggtttctgtgctcgcactgtgaggactgctctctgacacacctgcgtgtctccctgttgtattgcctggtggtagaaaccacctctggagtcaggcagagctcagttcagagcctggctccagcagttcttagctgtaggcccttgggtcattggtttgatccccctgttttcctattggagaaataggaataggaatcttcatacagacatacttcacagggtctctggggaagtccccttagtccagcccctggcatacacttacctcttgagagtgttagctcgtggcctcccaggcgggctctggtgccgtccagacatcggggagttggtagggggacagagggagctcctgctgaggcactcaccagcataccagtactgctgtcactcacgagccaccccagaacctaagggcatgaaacaaccattttattacatgcatagactctgtcggtcaggaagctgaacagggctccggctggagctggagtcacctggagccatcttcactcacatgctcagtgcttgctgccagatggggcttgagctacaagcggggggcgcagaacacttacctgtggccccccactgtggcctgggcctcctgacagcatggcagcctcagtattgcagcctcctgcagggcagctggctttcacccagagcaaatggctaaggagagcagggtagaacctgcatcacagagcccttatgagccagcctcagaagtcacgcagccttactgctgccacactctgctgctcagggcagtcacgaaagcctgcaggtccaaggagagggacgtagaccctaccactgaatgggagcagcatcaaagactttgtggacaggttttaaagccagcacctcagctgttccacaggagggaaacagaggctccaagagttacgtaataccagtcatagcagctaagctgctttgagcctgtactctctgccaagcaccatcgtaagtgcttgtcatgtgctcactcagtgaccctgacacagacactgtgaggtggggccaatgtcatccccattctacaggtgaagatgcaggtgctcgcgcagcctcatgcattgaggaagtggcagaaccagttgccaagcccaaggctctggacagcctctgaggctctgtccccacagctccatatatccgtatagtgcaagtaggcattacattggcatgtccttgactttcctacagtcacttttgagtcacacattgtccccagttggtcctcagaaggcaacttccatgtaagaatcagaactccaaacctgatctaacattaactctaatctccttgttacaacctagttggggtgcttcaggcctggctgcttgtggcaagagaggaggagtgtttggcccttctccctccctaggcctttctccatctctttggcctgtggcaactgggggagaggatacagtcgtaattggagcatagggtcatatgagccacatccaggcaaggagttggccagaggtaggtttgagtcttgcctcttctgcttgaccttgatgtcaaggctgctgagatgggagactcaagaacaaaggagatgtgaaatcccagaataatgggccacaactggcctcctatccctggagctcctcaaggagggcccctcccgcccatccattctgaaaatataaacgggcagcgagagtatgtttcccctgcagatctcatgtttaaggggccaggcgtggtggttcatgcctgtaatcctggaactttgagaggctgaggcaggcagatggcttgagcccagagtagagtttgagaccggcctgagcaatatggcaaaaccccatctgtttaaaaaaaaaaaaaaaaattagcaaggcgtggtaacttgtaccttagcttcctgaggccatcactagaagcagatgctggcagcataattccttacagcctgtagaaccatgagccagttaagcctacctacctaccttccttccttccttcctgccttccttccttccttcctcccttccttccttccttcctccctccctccctccctccctccctcccttccttcctcccttccttcctcccttccttccttcctttttttttttttttgacggagtctcgctctgtcacccaggctggagtgcagtgatgtgatctcggctcactgcagcctctgtctcctgacttcaagtgattctcctgcctcagcctcccgagtagctgggattacagtcgcccgccaccatgcccagcaaatttttgtatttttagtagagatgggtttcactatgttggccaggctgctcttgaactcctgacctcaggtgatctgcccaccttggcctcccaaagtcctgggattacaggcgtgagtcaccatgcccagcctaaacatcttttctttataaattatccagcctcaggtatccctttatagtaatgcaaatgtactaatacagaaaataccccactcctagtacctattttctgtgttaggccattcttgcatcaccataaataaatacctgaggctgagtaatttattttaaaaagaggtttaattggctcccagttctgcaagctttacaagcatggcaccaacatctgcttggcttctggtgagggcctcaagaagcttacagaaggtgaaggatgaacaagcatgtcacatggtgagagcagaagcaagagattcaggggtgaggagaggcaagttcccagacttttaaacaaccagacctcccgtgaactgagtgagaactcactcatcaccagggggatggtgctaagccattcatgaaggatccgcccccgacccagtcaccccaccaggcctcgcctccaacactgggaatcacatttcaacatgacatttggaggggcaaaccatttcacagggccttctagctggcagccgatatcgctgatgcttcttctcccaggcacttccgtgggtatttcagagattccacaagtcccttgacccaggcagatgcaaacctattttggggacccctgcagccccttccatgcccccccgcaaagtctggtgcccactgccagcttcctgatgtttgggtcccctccagccctcaactctgccagctttcctcacatgggccacctcggtccacaggaggccgtacctgtcctcattctaacagacctgtgagcacaacagacctgcctgtggccaccgctgtcttctggcacagccgtttggcctcatcaggcctgagtaaggcacagtagctcccctgggtctcctgactgctagagacatagttcaacctccgcagggggtctgtggagactccgcctgactatgtgtgagtagaaaaagagaacagccaggggcaagctgtaggccctctctccatgtgctcctctctctggaaacatactctctctgcccgtttatattttcggaatggatgggtgggaggggccctccatgaggacctcagggataggaggccagttgtggcccattactctgggatttcacatctcctttgttcttgagtctcccatctcagcagcctgtcacatcaaggtcaagcagaagaggcaagactcaaacccacctctggccaacaccctgcctggatgtggcccagctcctcacgagtaccagcggctcccccagcatctgctgctccgcgctccccgtggcctaggaatctaagaaatgatcaaggtcaaccaggtgcagtggctctcacctgtaatcccagcactttgggaagccgaagcaggaggatcacttgagcccaggagttcaagaccagcctgggcaacatggcaaaaccccatctctacaaaagtatataaatgatctgggcatggtggtgcgtgcctacagccccagctcctcagggcttaggcgagatcgcttgatcccaggagggggaggctacagtgagccgtgatcgcgccaccgcgctccagcttgggtgacagagcaagaccttgtctcaggaaaaaaaaaaaaaaggaaatgaaccaggccctctaaatgatgtgtgagacagctcttggctgacagcgagaactcgtgagagctgcatgtatgagaaacaatgtgtgtgaatgtgaaagtgaccagctcccaggctccactgtgaaacctggccagagaagggtttcaacacagactttctgtgcagaggggccccagtgtcctggagagccacagggtctggcagacctggagagggcctgagtccttgggaaccggattctcagcctgggcaggagaaacactgaggacactgagcccccttcacattaggtgaaagtcaccgtgtgcaccagaggctcagagtggtacctgcaagagcacccggttgcacagttgtcaagccccctcctccagtgagaaaacgcaggctccaaagaatgagactggactgtgagctcccagctcagcgtggggcagaggctggactggaacccaagtcttgtgactccaagctgagtagtttcccctctgccacagctgcctcccattaatttctgatgtgcgatacttggaaagtgcccctgtgagcggcagcagggctgccaggctgcttaaatagggcagtgctgtcccaggcaggccacttggatgctgccggaaatccgtgggaacgaggcttcccatcccaaacacatgtcttcctccgcagccatgagcactatgcccatctacccagtggcctccagatatcaatcccaaaatgaacttctcatcgtgtccccagaacctgacagtaccagggataccactccaccgacggtcaccccaagtccccctccctccatacccccagcctgtggtgtcaagtcttggccacatctggttgctctccaaccaaagcaaactttctagggtacacatctgaatgcatcagtgccccttcctaaaaatctctacaccttcccctcgttgaactccaggcttcttcaaaggccttgctctctgtcaacccgagtctgtgcacatgctgttctgtctgcatccatcactgctcctgctggagctcttgcacccacctggacatcaggccctccaggggtcccctctgtgttctcacgtgcaccgtgctcagggctgtcccgttcactggctgctcaactgggcaagttcctgaactcttcccttgtcaggttctacatcctaaaagtgagatagcaacagtatttgcatggcagtgttaatgtgaggcttaaataagatcaggtgtacaaagcatttatcacagttcctggcaccttgtagatgctcagtaaatgttagctgctgtcattattaccatcattattgttgtagttatactactggtgtagttgttgcctttaccgtatttattattattattctcatgtaaaagtagatgtctctcctggtgtaattacctggctacttctctctcccacacttgactggaaactcatctttctaatccagtgtagtatctccagctcctgcccccgaggtcaggactcaggaaaagtttgtcacgtgaaggagggagggatgctgtatggcttactcctcacagggaggctgtcagtcagggtcatcattcctgttttgcagatgtagaattcaggttcagaggtgtgaggtgacctactcaaggtcactcatcctgcaaatggcagacacaggtggtggaccaggcctgtctgccttcagatcctgagtctttggcatcactgttcatcatcctgtccactccaaggctgttgttaggaggctctgggctcatttctcttccaatcaatgagaggtctgttgggcagcctgttgctttcttgaaagaagtgtaatgaaaaccagattttttttcaacatgatatctcgttccccacagagactgtcagttctcatatgttccaataaaactgctaaagaaacagccacttaaagagctttaaagattattcatggaaaaattatgctgaggaaaaatggagcaatcctctgagatagtcaagccacatggtcagtttttccagctgtccgtgccatatcggggctggcagcaggaactgcactctgctcagcccgcccagagccctggtgcattatgaccacccacacccttgcccctgctgcgggacatggagaaacaaacttgccagccacccagctcacaagcggtcccagaagacacgtgtccctggtgctgtcacgtggtggccaccccaggcttggcagggcaggaacatgaggcctttcagtagcagagggtgtcacttactggcagagaggccccccatccctggggcccagttgaatgggaattcttctgcttccgcgtcagacccaggctgttggtcaacaatgcagaagaggggaggagctgagacccagagcagggagagcagcatcagctttgaaacggtgcccagggaggctgcaggcttttctgctgggccccccacccttcctccagttgggtcaaggggcatctgaggccaggcgtgtctcccagggccatccacagccgaaagaagaggtggcagatccaggcctagtcctggagggagagtcaagaattgaatggaagagaccaagggcaagtccagtgggtttgggagagactgggcatgggaatcggagctagaggcaggaagcacatggagacagacaggaaaaggagtcaggcaggagtgagcaggaagggccgaagaagttaccagaagagacttggagcctccgcgtctcactgcacccctccagctgtgtgactgcagagtgcctctgagccttcctttaaaatggcgatgataaaagttactaacctcataggagtcaaggaacaggacttggaagtgtttactcaagtctggcacacagtgcataatagatgctagttcccatcaccttcctttcctcaagggtagtaactgggtcttacccactacagacttcctggaggaaatgtctcctgtttactagatcacttcagatatggccaccgtgttcctccttcctcatgttctgaccagcgcctgacctctgaacagctagccttcctccccagccaccacaagagtgcggcacacctgggatcaagtcctgcctccagcgtgcagtagctctgtaagccccactttctgatctgtaaaatggggctactaagagtttccacctcaagtcttgtggcacaggtacagagcatagcgctgggcgcattacattagattataattatcatcattattattactaccacaacaccaggtagccttgggttccactccaaaccgcaagggaggagcaatgcaatttgacctttagaaaacacttttctgagtcagggtgggagccagagtgactcaggcagtgagactgtaatccctcgcgcatggctgctgataaacaaggcaagatccaccctctacatggatttgtttcttgagcaatatgtgcaaaaccaaaacaaagcaggatggttttcattcttcgttttcctttctggaacaactgcacgagatgtttcctttggaacggagcctgcctgtgttgcagcgctttgagcagagtttcttcccccggggtgcacagcagaatcacctggagagctttggctccaggtctgcaatgcccagacccacctgtggcccacagaatcaacctccaggggtggcccaagaaactccgtttttaacactctctccagatggttctgatatattctttggttaagaattagagccttttttttttttttttttttttttagacggagtctcactctgttgctcaggctggagtgcagtggcgcgatctaggctcactgcaacctctgcctcctgggttcaagtgattctcctgcctcagcctcctgagtagctgggactataggtgcctgctaccacacccggctaattttttgtgttttttagtagagacagggtttcaccatattggccaggctggtctcaaactcctgacctcgtgatccgcccgagcctcaaagaagctgatgaccacatggaaccccttgcggggaaaatgcacagatacaaaagcttagctgcactttcagtcctctatacacctctcctgggtttgtgaagtctaagccacaaacctttcctttagagtcatgcctctccagttccattacggtggattggtctgtcagatcctgttcttgagatgccatctgaaagcaggaactggggcctcagagagcctctcctctctcctgccaccaggctggtttatctaggcagctgtgccaagaggcagtgtcgggtggtggggtctctttgttaaggttctttgaactgtagcaacaaagacagactggctgacttcaaccaaaagaggatccattgggctggttgcagtggctcatgcctgcaattccagcactttgggagcctgagatcggtggatcacttgaggccaggagcttgagaccagcctggccaacatggtcgcaaaaccccatctgtactaaagactaagaaaccccatctctactaaaaaaaaaaaaaaaaatgtagccaggcattgtggcgtacgcctataatcccagctgcttgggaggttaaggcatgagaatcacctgaatgcaggaggtgaaggttgcagtgagccaagatggcaccactgcactccagcctgggcgacagagcaagactgtctcaaaaaaaaaaaaaaaaaaaaaaaaaaaaaaccccattggctcacagaatccagggagggctgaacagccaggccagggacacactgggtgtcaggaacagctgaaacagaactctcttccaccttgctttgtggcctcactcagtgaggttactttctttttctgtcaccacagatcagattccctcaccacaagcagggaaacatggccatccttagtatctaggttttatttctcattcatcaaacagagattgtcctcaaatgctttctaggctcaaatccaacagtcctggggagtgtatccactcgtagacccatcagctggggccagaggcgaggccgctttggactggcattgcctcccctgtctccatcagtgggaggagaacgtgcttcctgagaaggtgctgggcaggtgatcccaggtgtctgctccatgcacccacaaggcctagacttgaacctaaccccgtcgccagccaggttctggacgcatgcttggtgcctacccactgagcttctactactctacttgcaagttgaagctaataatacagacctcagaggagtgctgtgtggattaaatgtgaaggcactacagggtcaaggcagacacaaatgatacaagttgggtggttggaggagagtttcagaatggggctatttacaaagatgtgggcagagtgtggggaccccaaaggacagctcagtaccccagggttagaaatagactgccacctctcaggagggaccccacaggcagagagccaaaggaggcagctccccgtcagcctaacccagcgaggggccagagcgggccagggagcctactgacctagccccatatgcagccccctggtccgtggcacagggtggagaagggtggaggacaaatctggaggggcaggtggagattccagcacagcacctggcacagagtaggtggccactatttttaaagtagtctcactttaaataatgaaatagttaatgcatagagaatacctattgtcctcactatccgtatttaatagcagttaacattttgccaggttcaccacatatttctttaagtattaatactacacacagagggaaggcctctcacccccatcctgcctcatttccctttcctccctacagttactgctgtgctgatttacattattcttgtgcaggttttgcgttttactgcatatgtacttgtgtgtaaacatatatactgttgttttgtgtgtttgtaaaaatttgacctaagtggcataatgccataaacattcttttgcaacttactctctccacttaacataagttttgggttttgtttgtttgtttgtttgttttttgagacagggtctcagttgcccaggctggagtgcagtggcatgatatcagcttactgcagcctccacctcctgggttcgagcagtcctcccacctcagcctcctgagtagctgggactgcaggtgcacaccaccgtactggactaggttttgtatttttttttagagacggggtttcactgtgttgcccaggctgaaacataagtttttacgatttatctgtattgatacctgtagatgcagtttcttctctttgtagaatttgttgtaaataaaccacagctcatttatctatttccctactgattggcatgtagcttgtttctgcttttttgcaatgacgcacaatgctaccttgagcatccttgtgtatgtggctcctcgtgtatatatgcaggagtttctctagagtaaaaacctcaattagaatcaccaggtataaaaggcagggcatcttcctttattcagcactgctcattgctttccaaatatttcaccttcatataagccccaaactagagttcctgttcctccccttctgccaatgcaatacattgtcaggctaaattttttatttttttaccatctgttgtaataaaaagatatctccttttactctcatttgcatttccattattaccagtggggttaagcgtctttccttattgttactggccatttggagactctgttccttgaatttgcctttcatatcttttgcttgttctctctgtgtggtttgtcctttcttacagatatttgaagttctctgtgtatctgaaagctaatcctgtgttggtttaggggtgacacataccttctcccagactgtgattcgccttttaacactgattttgatgtcgtttttggtcggttgttttggtacagacatttaaatgttgtcaaatttattcatctcttcctttaggatttgtgttttttctttcttccctttccccaagattataatgattgtctcctatttttttcccagtagttttgcttttcacatttgtgacattaatccacttgcttaacataaggcaggactctaattttgtctttttccacatggaacccagtggttttgcccctcatcctgaaaagttcctcctttccccactgactggtaatgccgccaccatcaggaagcatgtcgggctctcactttgtattcactgaactgtgtctgcatccatgcccaataccacactctttgaatactactgctttaggttttgttctgccatccagtagggcaagtcttgcactgtttttcttcagaatagtcttggctactctgtcttttttcttttccatcaggtttttttgtttttgttttttgggtttttttttgtttttttttttttttgagatggagtctcactctgtcacccaggctggagtgcagtggcacgatctcggctcactgcaagctctgcctcccaggttcacgccattctcctgcctcagcctcccgagtagctgggactacaggcacctgccaccacgcccggctaattttttgtatttttagtagagacggggtttcaccgtgtcagccaggatggtcttgatctcctgaccttgtgatctgcccgcctcggcctctcaaagtgctgggattagaggcgtgagccacggcgcccggcctccactgggattttaagagtggcttaaatggccaggtcaggaagaactttgaacaccatgtcatggatgatttcaagcaaggcggtgacatggttagcttcacgtttttcaaatacttatgaagctgtgcttgggttagattttagaagatcagactggaggcaggaagacaataaaatgtgggggcccagaccagtcagtgacaagagaggtgggcagggaggggctgtgcagagtctggaggccatgatgactgtgcagcaagtgaggagggaaagggaggagagaagaggcaagttgccgtgtggcaggagccgagggtgggctcccattccaggccaggcgactgggcaacccacagtgcctccagccaaggctggaaacaggagaaggagttgcaggcttagccttagctgtgctgcacttgatgcatcttaggaaagggcagatggagggatggtgccaagaggtggatgtatgggtctcaggctcagaaaagaggtctgggccaggcctggtggcaccctcctgtgatcccagctactcaggaggctgagctgacagggttgcttgagctggtgagccggggaggtcgaggctgcagcgagccatcatagcatcactgcgctccatcctgggtgacagggccagaccctgtgtcaaaaaaaaagaaaagaaaagaggactgtagtcaagatttaagagtcatcagctatccaatcaaagaaaaaacaggagccaaagagggagtcctgtgtggacaactccagcatgaggggtgttagaggaagagaaggatctcacggaagaggtggtgacagtgattgaagaggcacagggagaagcaggagagtgtggcatagtgcctgccaaggaaggagggcattttgagaaggagtgaccccgagcaccaggtgccaagggctctgggaggaggctgacgagccttcattgatttggcaagaaggaggtcagtggatgtgtcattaggtacagaagtcagagctgagtgactggaggagcacagacctccatttgctgggaaaagatccagtgaaggaccttggcttacagggaaagagagactagagcttgcctgtaggctgggggaaggagccagagagagaaggggaaagtgaggcagggaattatcagaggagacgggtaggacctgagagaagagaagggccccggcctggtgggaaggccagtgtgaatggaggtgtgcatggccactgcaagggtggctgtgagagagatcccacctgacatccagtgttgtcactgaagtaaagagtggcagcatttgaaaggggtggggtcttggagttgcccgggggcactgaggaaagaagtgacattttggaatgttattgagaataagaaagttggctaaggcttaataaagggattggtgggggcggatgaaggagaaggtgcctgtgcagagtggggttgggaaggaggggggacagcagagaagacaactcatgggaagtgagcactcagccagcacaggagctcagaactggaggtgatgcaagtgcccttgcctcctgaatctgccaaaatgccagatgggccagccttcccacagtatacgggctgggggtgtgggtcattattttggacattaagatgacccaagcaggctggaggacatgggaacctgtaggccactggtgggtctgtagggccttgtgttggaggacctggaggtctgggtgggcttgggccttatgggtccccccaagaaagttctccagccatggccaggcagccacccccttgatctgctctgcatttggtgttctctgcaggaagcagctgagcccctttgtagagtcactctttcccacccccagggcctgacccagatagccagagctaggcgagcctctggagtcacctcccttaaagacctcccttcccaagccacagaaactaaagagtgccacagtggccagggtcacattcctccagacatggctgaagacatggccagcatgaaggatttggcctcagtgtctgtgtattgtgcacagtgaggtttgcgcccctaactccctggctctggtgacctgttagccccatgactgggttgagaaggacatggtaataattaccataataaattaagtatgagggctaactatgaaagtctgcgtacattacctcatggacttctgaccacctgcaaggtgagttgaattattcccacttttcagatgaggaaactgcagctcaagggatatgttcagtaacctatccatggtcccaggtagcaaatgaaagacctaagatctgaaccctatctgtctagctgtgctcttgcccctttttgtttaatgagtacatagagaccagaaagtggctgtgtaagagctcaggggtaagggaatggacttggtgttagaagacacacttttttttggggacggagtctcactctgttgcccaggctggagtgcagtggcacaatcttggctcactgcaacttccacctcccgggttcaagcgattcttctgcctcagcctcccgagtagctgggattacaggcatgcgccaccacacccggtggatttttgtatttttagtagagatggggtttcaccatgttggccaggctggtttcgaacacctgacctcaggtgatccacctgcctcggcctcccaaattgctgggattacaggcgtgagccaccacacccggcctagaagacatactttgaagtctcacctctgtcattcaccagctggatgtccttagataagtcatgccatggtgaagcagggccaagactatccccatgtccatccatggtgccctccctttggccaggacagcaggacattgaccatcctgagagttggttgtcagccttgggagtcaagtactatatggagagtgaaggatcaatatctaatgagtaggaagctacagagctcatatgaaccttgccccacctgtgacagctgggccagttgctgtacttcaaacccggggcccacctccacacctcaacccagcctgtgcagcccctcaccctcccatcataacccccgttgttgctctctctgctctgtttgcaggtccctctgctggctccggttctgcgaggttcagccggaggcccacctgtcctgacacatctgttgctggcagcctccccacacctccagtccccagacacaggaagagccacagcctaggcaacaagtgggtgactgagcaagccctcccgccgggcttcagaccgtcctgcacatgggcctgggcacagtgcagggaatcacttgctggctgggtccctcccctgccctgttctgggagttgctgatgagagctcttggaatcctggccagtgcgctttcctgaggctggtgtgagcttgggaggagctgaggggcactgtggcagcactgactccacaccaccgacaggtgtctcaggctcagcagctgatggaggaagggtgcagggaagggcagggaagtagcagtggcattccagagaatttgcccaagcccagttaatgactcatggaaaaccccaaagtccagtagacaccagtgactgtcatccagggcagtgttcagtttctcatggcatctgcctacagagcagtgaacctgctggctcatcagtcctgtgaggcccatagctgggggacatgcgtgagccctcggcatggctagggcaactgtgcctgtgtctccagggcattaggcacaggcttccgaacagatgagtcccttccttccttccttccttccctcccttccttttctcccttcttccttccctccctccctcccttcctccttccttctttcctacctacctacctacctaccacttccaaggcacaagctcagcccagcctaggcaggccctggaggagctccaaggctggaggagaaagagttgctctttgagtgttaagcagccctctgtgctagacactctgcatatgcctgtcaagcatgatctccctgagtccccatgcaggcctctgaggtgggtgctattattacatattttgagaacgagtctaatgaggttcaacaaggtgaagttcgttgcaatggtggaaaaacatcagagcaagggtctggacccggtgcatgtgactccaggagcagacatcctggccacaggcccactgctgctcacctgtgcagcctcatcactcacgagcacatctgctcactcgagcctcatagccaccagggggatgggcagggcaagtatcgttatccccattggatggatggagaaactgaggctcagagaaaggatgtgacttgcccaaggtcatggcatgagagaggacagagcctgggctgtaccgtggctctgggtggaggcctttttcctgcagctgcaccatctgctccggccccaggcaggtgtaaccactgtcactccatagataaggagctttgccttctttcttcctttccattttccagtatgatgtgtcagttgagtgtagttgagagtaaaagtgcgacattcccatcggagaaagcaaggcacctactggacgacagtgtcctagagtcccgcagcccccgaaggggcctggctctgacctcctcctctgctgtcaccaatggactctccctaggtaagcgtctccggcctgcacatgataggctggtgggctgtaggcccagcgtgtgctccgtgtctgtctctgtgtcactgtgccatgcccagtggcgctatcattcttggggacccagtggcccctcacctccctgcagaggtggctgcctgcaggaatcgcccagacccagggaaacccttgtctcctagcctcgtgggcttcatgaagagccctggatctgtcgtcatcctgctggtggcatggcaggcaggtagaaaaagcagccaaacacatgcctgagaccagctgccattggctggcagctccccagaccagactggaccacagtcaggcttctgtccctgggggatcatgacccacagggccctgcagggcaaagcaggagaggcagccagggagggtagctgggtggccactgggttctcactgcgtacttgtcttcacaatgggaagctagaaggagggaggatgaaaaattgatattcagggatgaaattgcatcactgagtgtcagccagacgtggtgcttatggcaacagaagagacagaaattgtgctgctgaggctgggataagaagaacttgacattaggactcaggctggtgttgagctctggttgtaggtccgtacccctgcagtgtccaggtcagctgaggacaggtgggcaccgccctgttattactgccgtcaggccagtgtgctctgatgcctgttgcctttcggtgtgcctgtgcctctgtggtctgtgtgtctgtgtgtctgtcggcttcccttagcagggagtcctcccatggctggtggttagaccagttgccgagctgggagttgatcttgtgaggactgcagagcagagggcccagagcatgggggtggggggcgggaggggacaggagaaacaggcaggaatcactcccatgtctctgtgaaagcaagtcagtctcagagggcatgggcaatatcagtccaggggtcgctgtctcccacgccctggaagtctgacaagcatgttctgtgtctgcctctgtcctcagaggaggtcatcctgtttggagccagtcagggttatacaacagctcaggacgatgtgtccggggttacgaggtgtgccttgggagaagagttccaggtcatgcatggggaaaggctgggttgagcaaaggtgtgcaggtttcttcccagagacgcagctgtgctggtgggtgggagtcctctaagaaggcatcagagtccacagtgtccacattctttggtcatgggaccctcttccttggagtgtccaatgggacctgggttctgaggaatgccctctgggaaatgccggcccaacagcactcagctgggcggcaaaacagctgttttatatccagaaaactttgtgagctgcgcctgagtccaggccttgctattcctgagatagaaaacggagtcagatgcagagctgtccaacgtccagacaggagatcataaggttgtttggttcccggctcctcaagttggggaattgaaactgtttttctgtttgaggccaaaagccctgatgaagcggccatttgtgcatgtgccctgttgggagctgggctggtcctcccctctgtgatgagggctgttactcagacagatgccaaggggcctgggatctcctccctccccctttcccagtgctcagccttggtgctctttcaggcaaagagcactgaacctcagagcctctgaggtctgagagacagtccagaagcattgcgcatggatgcttgggtgagaggagaaaatctctcctccaagagggcttagagagcccgggagaagcagggtcgcccattcagcccagagggacaggcctgaaggaggaatagggagcaaagctgtgggacccagcccctctctgtgaccccactggccaggggtctgcaggggctctcccttgaggcttctgtctaatgccaggtagctgcactgtgaccaacgtctagtcaagtcctgacccttggggaagaggaagaggtgctcatttggcctcaccaggtgaggcctgttctagtcctggcttcacttgggccagaagggaggcagtggtggagccaggtcaggcccagaagaaagcctgaggacccagaccccagcgggccagtgggcagttagctgtggcccccgggggcagtgggaaggtagcagaggacctgcctggaacagtggttctttgaccctcccagagcagagttagaactcacagcaaaaactcgagtacgttgaggctcccaatgtcaggaagcagtttctgtggcacttctgtgagctcagggggcctgggctcggtgacccaggagaacaggcccctcttctgtgaagccgttgtgctcattgacctgtgttccttttccaggcagtagtgagagctcagagtttagtgaagagatgtcttcagggctggaaaggtgagtgtggcctcagcatggcctccctcccaggggcggtgctcagggctgagggagccgaagacaggccccgggcagggacgggccctgccccacccaccccatgaggctgctctgtggctccttcagcagactggctggggcagggctgagtaggagggaggatggaagagcaggatggttgctggggccccagcccccatgctctgagcagccccatgcctcccctgatccaggaggctcttcctccagcacagctgcaggaggcctgtgagtagatttggtccgaagtgtgggttcttgaaaccaaaagcctaagaagtggcctgttcttgagatgggcatgtggctccgcctggtggggtctgagaatattgcaccctaatggcctcaggccttcggtatttattgacccccaccctgctaggcactggtgacagggaagtggccatagcctctgcctccctcgaggatccctctgcctccctcgaggatccctctgcctccctcgaggatccctctgcctccctcgaggatcccttggcccagggtttggctccctgggagagcctgtctgccagggccccaggcctcctgctcaggaattcccatcgcacagctccacgtactagtgttttcctgtgccaggcgcccggtgatctctaggaaggcaggcaatgctgtgaagggggtacccccacagccatggcaccaccaggggtgaagggcatcgtggcgactcagggtttgagaggaggcgggaaacatccagtgaccagtgacacagaatgtccaggaaaggcaggtttgcaccagtatccagggccctgggcacacacacacacgtacacatgcacactcacatatacacacatgccctacacacacatatacccatgcacacactgtacacttgaactcacctatgcttgcagtgtcacgtacacaggcacacgctcacacatgtgcttgtgtatacattcatataaccacactgtcacacgtgggtgtatacactcacacgtacatatgcatgcatgcatgtaccctctcacacatttgtgtgcataaacactcatatgcatacacgcacacacacacactcctcctctggcgctgaagcttctctccttagtcttcataatcataaattggccagagagacgataagtgctgcctagcaactcctcccagggcagacgggctgcctgctggtcagtgctcttggttgagcatggcctgtgccaagcactgtcctggtgctttgcgtgcatggatgtaccaaatcctcagcactcctgcacaacagccattcatagtgtccccgttttatacatgtggaaaacaaggctcagagaggtaaagtgacttacttgctccacactctggtatggacagagctgagccacacccaacagcctcctgaccactgagccacctcttcatcactgctccacagcttggccagatacggggactgtcccatattggtcagtcagtctgtctgcctgtgaaacccaagatgggggttggtgggggagtggcgatatgccagccctcagaggctctctctttcccctccccggccatctgggttgctcaggcaaatgggccaatagctttcaccctgggagccaccccggcagtggggaggagaactggacaggcacaagggcagactctagaactctcagcatcagtcaggggactcctggggacaccctgagggagatagcttacaggcaggccagcacctcccctggcctcaggccaatgagaagacatcaaatggcaaacagaggcacagatcctgaatagcagctagacctggacctgttgttcattgattgattcattctttcactcgcttattccttcattcactcacttattcattcagtagctgttaagcagctgctccctgccagacaccacacgagttactgaaggtgtagcagatatagttcctgctaagtactcatgactgagattagagcttctaggaaggagggtggtgagaaagaattccttgtcccagggagatgatgctgtttgcaatgctgtcatgatcactgtaggccacagcatttcatagcatttagatcactatccatctgaatgtctagaataggtgattttgggatctcttccaagcactggtctcatggctggcgcagatgcccggctctgcctccagcagtcttgaaacatccctgcagggaggatgtcctgtttctcatcctctgaggatggcttttggcccagccccaccttgctgaggggagcagggggccacctgctttggaggatgccagtgggcctgcgatgtctcccccagtcaagacccaggccccgtgcagtcctgatgagcagatgccagttgccccttggccaccggcctccatctccatcctgcactgcttcttacattccctgaaataatccacactcgcaaaagcaaaggagcattctggaccttcctggagagtccacaggagagtcggaggggaagattgacctcttgcagcttgaaaatcttcattgcctgtggctctcttctttcagttactcaccttcatgctctttcctgggtcttctctattcctgaccttcatgggcccgatgcttagctcctccaggtcctccctccactcccagctctcacccaggccaaatcctcctactctaatggggagcagactccctctccctcagaagactgagtgtcagcctgcctgggcccagaggccagcacctgccctgaaagagcttcccctcctcggagaccccacgagctgttccctgcagatgccgtaagaacacagctttctctgcaggccgcaccgctcgagcagacagaggccgtggagccagagccaagggtgcaggggaggcctgggccacgcagagaagtgaggtgtgagagaggagagggggaggcttggccgtggtgggggagacagcatttcgccccacagctctgaagcgcaggggccacactcttctattgaagattgccaccagccccctgcccctcaaccctggtaataagcctgcccaggctaggaagagaaatagagccagatgccaagacgaaagccaggaagaccccaggccagttcctccacaccacacacacctctggtgggttgagggcacaccttcatcactaagaatgccactgtcagcaggcaggcaggagtttctattgtctggccaggggtgagactctgcatgcccgtctggtgaatttgccttccctgagtttatgcacatagatgtctcctctttgggtagtagccagagttcaggctgcagatgcccagtaggtccccatagtgttcggccataaagagcttccacacgggagctggagcccactgaggcctgcggagctgctgtactgccctcggtgggaatgggtctgttcctactggactgtggaacaagggtgcagagagcaaaggggaccctcttctgctcttcatcctcctgtctcctcacccatgtcagccttggcaaggacacagggcctgtggggtcggggaggggcagtgagatgcagggaggtgtttgttagtcacttctgagcccccaggctgccttaaagaccctcccctacccttggggcccagaatgaggacagggtggtgatcctgggccagggccctcaggaaccagagagctatgggcaggggtgggcctgctcttctctgtgactccacctagtgtccctggtcagcagtcttcctcacctcatgccggggagagtaggggcgaggagagaaggggggcccccagcacactctgctctcccagggaggtggggaggcggccgcagggcagcggccgcagggcattcagttacctggagaggagggctgtgggcttgtcaggatgatctccaaccaacctcgggccccttggaaaccaacagggaagggagcgtttagtcaggagcagcagtaatggataacagatgcctttttctgcctgatttggaaagcaagtgttggcactaagatgaaaacaagaatatcagcctacgagttaaaggattttaaatgaggtgtttttaaaaagatgaacaaagtggattgtagcggcgatcatgtatgtatatatgaaaatagagtctcactcatcctgagtatttctggtctccaggtttattgagtgagtttattttccctgtattcttcagattttccacagtgtgtaaatgtttcttttctacccagaaaaacaattaacatttaactgtataaaagaaaacataatcagaaatgattactgatcagtttttaacaattgaagtatgaaagtgccacaaagttgattacgaaacccttggccaccatctcccctggtcggaatcacctgtctctgtggaagggccttctcgtgtgaggcacaggctgtaatacaggtagtgggaagcgtaggggatgggggggtccttggaaggcccagggtgagaggaggcccctgtagtgggtgagggaagtgaggctggggcagggttggggggcacagtgcacaaccctctctgaagcaaagcccattcctcttcctgctctgggggaggtgagggaatgggtcagagctcagagtcttaaataagtcctgtcagggaagcagttgtgcaggatgcagtgggaggatccaacagggcgacctgcatgaggcaccaggctcagaggtggcttctggaggaggggatggttaagcagcagcccaggacatttagtgaagaggaccctagagagccctcgaggcaggacctgggacctgaagaggctgtggcctgtgaatcatgcaccaggctgggacagatggcccagggcttggtgtctgttagagtctcatacaggctgggccccatggcaggtcctcttctctggagttctccgttgacctccacagtgaaaggcacagccagccatgcggggggacctgaagttaggaccactgatcctcccaggtccttgggcagctctcagtacctctgagcctccattcctcagccctgtgatgaggctaggcacagtgaagatctaacacataggtggagctaccacatctgaggaactgatttagggacttttttttttgttttagacagagtctcactctgttttccaggctggagtgcagtggcactgtcatagctcactgcagccttgatctcccaggctcaagtgatcctgctgtctctgcctcccaagtagctgggtacaggtacacgccaccatacctggctagcttttttattttcatttttcagtagagatgggggccacccccacttccaaagtgctgggatgacaggcaggagccactatgtccagcctgagttggagacttttatgaatttccctcaataggtactacttaccaccaagaaagcaacccaggggtctaaggctgggtagggggaagaaaagtttcctcaaatgcagttcagtcatcatgggagggatggactggagtgatggcaaatttctaccagcacctgctggcctccaggatgacactggactgtgggagggcccctctaagaggtcgctgcagacagttgcccctcagagtgctgtggggtggtgctgtagggcgttcagggagttgggtgatgcagtttctgcccatgtgaggtttacctgttcgttttagctggtgggatcatccgacatccttagggaggcaccagggaaatgcagtcatggtgacagagcaccaagtctcctgccccaaaaactgagttttaaaagacacttgtttccttccttgagaagatcagaggaccctggtagatgcccaggtctgccaggtcccaaggatgcctctcaagccccaaactctgcagtattttgggagaggcaggccaggctctggaggcgatcccgcaggtgataggtccccttggctgcagcagacatgccagtggccattctcagggtgactaccgcagaggacctcactgtcccccacacctgtggctgaggccaggatcccaggctctcattcttcccctgagtctggtgtcctcgggttcattctgctgcctggtgcctggcttcagtgctctggacagttggcctatctctcctgcatgagactcagagacactgagccctgggccatctgtcccagcttggtgcatgactcagagcctgcagcctcttcaggtcccaggccccccgtcgagggatcactagggttctcttcaccaaatgtcctctgggtggcagcccagttagaaaatttgccagcttctgatttgggtttccctccgatatgtgatctcttgccttactcccttagctccaaacactaaagtctggcagttgaggctccagccagcagactgagagaagtctgcagagagaagagtgcacaaagaacccctggcctctaggtgccagggctttttgcttgactctgttttcgagccctgccaggcagctgttgctgcttcatgggtagctgggaaatctctgcccacagcttctctgtccaatatctacaattcctccagagtcagcacctagaaagcgggcaggacgctccttccatcttgtgtccatccttctctgtgcatatctgctttacccctccccactctctctcagacaagatttctgaacttctcagtgcacagaggggaagatggatgatgcctcatggcaacttgggatgcctcccaggtttacatgtgatagtttcgcccagccactgagcctcactttcagcctctcagatctggttcctaatcaccaggagagaagatctggcatacctggcttggatcactggtgttgccctgtccacttagctgtcagaaggatggggacatacagtacaaatgtggttcctagggacccacttagtgaatcagggacattgcccagagaagagtgggtggcccatagaaagcaaatgtccttcaaaaattgctgctagaagggacaacccagggcccagcagaattcagggtagcagcttcctgcctgaagatgagagtgaagcatcagaaagtggccagcataggccatggcctaattggatggcttcccatccagggtgcgcaggcgcaggtggacactgctgatcagtagcatcacctgggcccttccacatgtgcactcctacccaggctctgtggacttgaggctggggctctgtgtacagaagattagggaaagtatattagtctgttctcacgctgctaatgaagacatacccgagactaggtaatttataaaggaaagaggtttaattgactcacagttcagcatggctggagaggcctcaggaaacttacagtcatggtggaaggcgaagcaaacatgttcttcttcatatggtggtagcaaggagaagtgctgagcaaaagggggaagagccccttagaaaaccatcagatcttgtgagaactcactcactatcatgagaacagcagcatgggggtaaccacccccatgattcagttacctcgcactgggtccctcccatgacacgtggagattatgggaactacaattcaagatgagatttgggtggggacacagccaaaccatatcagggagggatcctacttctactaagaccaagattaccaaggcctcaacataattattttctggggaggttgctctccaacctcctagcccagaaacagggacttagggctttatgaaatgtaagccccaggatacctacaacctaatgtgtacctagaaaatgatggagtgaagatggcctttcagacctgcttgactagtctgaattctcatgatgctgttggctcaggaagtgccctggccacttccacctcaatagcaccacctactctgcctcttcccagtgtcgtgatcttgggcaagtgactctacgtctccaagcatcaggttctttatctataaggtggggataataatagtgcctacctcacagtgttatatgaataaatgagatgctgagcgaatcctgcttagcacattgcctggcacccattgtctcatcaccaccaccaccgttaccaccatcaccatcctcatttcatcctcccacttttactgtcaccaccaccaccaccatcatcgttatcccatcatctcattgtcccatcattatcatcatcccatgaccccatcctcctgctcatcatcaccttgtacaccccttgggactgaagtgttctactttgttgccagtcgatgtcttccccagacccaggttcccacaagctcctggtctgggcaagcctcaattgcctgttgcagtcctccttctgactccacctaagatccctgagagggatcttagtcaaacggccttcctaggacactgtgttcagccacaggttctcagaatgacactgggaaaggtgtctgtggttctgggctatgagcccctatgtcagttaccaaaaaacaaacaaacaaacaaacaaaaactatgatttctggggttcctctgataccaccacccaatcattttgcattttctggccctgaacattcaaataacaaattttctcaaagcagggacatttccagacactttcggttgtctggttccagtggctgaagatcctagctcctctatgctgatgctggcctgccaggcagccagagttgccctgcccagcacggtcctcctccagctctggaggactcacctggagggaaggctggccacttccaccctaactctgtgttcctaaaggctggcctggagaaaggtcacactggtgccgcccttcaaggcctggggtcgctccccgtggctccagagagagcaggctctgacttccatagcctggagcagccaccccggcacaggccctccacccgcaccagaaaatgagcctccctttgtgaacacttgagtctctatctctaatgacaggccagcagggtgggacaagtggcttcacctccttgagcctcagtttcctcatctaaaactgtgagaaccgggcccctctcacagagctgggcatgctcttgtgtgaaagcatgtagttggcacgtggcgtgcagttgagtagaggcagctgctcttcagtgccaggcagcaactgccaggagactgctccactggggccaccaagggaccaggagacctggaggtggccctattctgggagatccccaagcctaagaatcttgtggtcattcggtctcagacactgacaaatcccaggcagcgtgagtgcaggtggggacccacaagtagaggtgcctctgagaggataatgccagaaagggcccccacagtgggtccagtcccaatgacagaccccaccatgtttatgctgccgcctctcccttatcctgaaaggctttatctcacagtgtggtgaggaacttgggctgcagagtcagacagtcctgggttcaagtcctagcttacaaggctcatgccttggtcaagcagattcacatcactgagcctcagtttcctcattgtggggacggtaagggtgctttacacaaagcttcggtggcagcgcgagtgcactcgatgaagttgcaggagcatcagagcatgtgagcactcactacctagtgactgcttgatctgtcaagagcccacccagagacccctggtgtccctgtgctccccgccagtccactcctcactccttgagggaggacatgaggaaaggctgcttacgaggctagcctgcttggaagatgctcgtttcaagctctccatcaacagatgtcagttccttcaaacatctgtgaaatacaaagccacgcactgtctcacgcaaagggagagaatgatgggaagaaggtagccacgctggccaccatgccctgtctcaggtactgtgggaattccggacagtccactggcatcacattctcctcaggtagcggggaaaaagactcacgagaagaaaagtggcaaaggggccagagggccctgctctgggaagggggactccatcctcaactcccaacagtcagcagctcagagctggaatccagcccaggtgaggaggaaacatccctggatagcagacaaagccacaaaggatctcactgcaagaaagtccattgtcagaccctgctcagaagaaatccccggtgattctcagaagaaagccccggggctggaagaagagcagccccggaggtagccgtggccagttcccctgagcagtgctgcttctgcatgggctagcgacctggccgtgctagtgcactcacttgcgaggtgcccagcatgtggtgccggtaacagtgaagttggtgactgtttgacttgtccaaaatgagagaatcatggttatctgcatgagtcatgttcacttgctgcactccacccctctttctgagagggaggtggccattgggccagtggcctgggagttgagcacaccagggcctctcttgtctgtgctacagctcagtatgggtggtggtggggtcagcctattaccaccctgacacccgttaggttagaggactgggggtccaagcacatgctatggtataccatcacccagagaggaggagccgatgggcaggaggctcgggggcctggagcagccgtcccagctaaccatcagactcccaccagccctgaaattgggcccctggacagtggacccgagatggccatcaagaagagctccttcctgggaggaggacaaaggcccctgggcaggtacgatgtacctgctgcaatgtgtgagggcggccccacactacccacaggtactgatgtcacagagcaacggctgaccatggaggactgaggggatcttacaaaggaactctgggcctcatctgactttattaagttgattacattgttgtctggccaacgggcaagaagagctgtggtcagagaataggccatgcctcaagggtggggagaaggttggaacatcaagtggatacgggaagtgagtcttctaagacagagaggctaaaggagaaagagggtgcctccccgcgaagaggctgaacaggaagctgcacgttgccctggaaaggctcactgctggggagtgcatgtgagaggaaagccagagggccgcccacggagcaagcttggagcatggactcttggatgctgcagcaggtcacagagcgagtttgcaggggcctggctggagccgcagaggagactgtccagtcgagagcaaacagaaggctccggttgtgtcctggtgaatgacccccaggcccaacatgcaaggttgcccacaattctgtgtgcacttttcacgtggacttgccgtggactatctgggctgtacagtgtttgctatgaaacatctcagccccatgctgaggcaagtgggcgtgcctggattttaatcatgctcttgacactggaaaaagggtgaacactcaataaaaagttgaaagaattacgcggagacttggagactctgaggggtgctgtgtttactggcctggcagctccaggtgtgcttgtagtgtggccgaggaggctggggaggagttggggagggagggaggttgctctgcgggacttcctgagctaattgactatgttgtcggggtgctcttgcctccttcaggagcatctggtctttcaaagctgttgctaaaatttaacccttttcctctgaagcaggggacgtctctatgccaccctggggcccaactggcgggttccagttaggaattctcccagaacccggagctgtgtctacaggtattcatgtgttcatgtgttcatttgtttgacacatagcttgttatgtggccttttggatgccaagcactgtgctagaggctgccgaaagaaacagacacagcctttgcctacatgagtctactgccaggtgcactggctgtcccagaggaggtgaggggcactcaggaagaggagggggagcttacttggttcgggagatcagggaaggcctccctgaagaagagactggaagaatgataggaattcgccaaataattggaagtggaggggcaatgagaatgttcccagcaaagggacagcatgggctatgaggcaggaagagctgggtgattcgagtgaagggaagggagtgttggaaggaatgagagagggcagggacatgagatgagctggagccacatccagcatgcatcatccagcaggggtgagaatggtggctcagatcttaaaagcgacaggaagccatgaaaggggcttgctgtgggcaggtggaggagaggagagggggagggtggaggcactggccggtgtggacccaggaaggcccgtggagcgcactgggcagtggctcgaaggaaggtccagtggcctgaggtgtagtgggatggcgaagatggatggtcagacatatttagtgcctgatccccagtgcatccttgggattgattaggttgcaggggcatccgagaggaagaaaatccccgctttctggctgaagcagccagtagggggtggtgccattcctgaggcaccggcagatccggagctcaggagggaggtgtgggctgccatgcccttggacgccttcatctgtaggtggtgcttgagtccccaagggagagggtgagtgaagagcccgggaaagatgtggggaatggtgcgtgtgggctcgcgtccctcctgtccctccacaccacctcttcccttcctcgctgctctctgaggctcctgccaacaccagaaggaggggctgctggagctggggcttcacaggcaccagctcctcaggtgtggaggagcccacgccagccccagggagcggccaggctgtagccgtgacaaaagcatcccttagggtgggggtgctgatcagggcctgggttatgaggaacttggtcaccaagcctggagctttgcagccccagagacaggtgtgggagtccttggcggtgggcccttcatgtgcgttatcacctggccctcccctccgggccttgctctgcgccgttaagtctggactgctgggatgtcatggacttggtagtggggcacctgtggtccccagtgagtgagagggtgcttgacctcagctcctccagggcgatgtctgactggtagtctctcctcagccccaccggcccgtgcatctgttctctggggaactccgcagctgtgcccaccatggaggggcctctgagaagaaaaaccctgctcaaggaagggcggaagcctgcggtaagtacagacccacatccaccggggcagcaggggcttccacatctgtaaatagtgcccactcctagaggtctcagcaaaagtcacatgcatggcagaggctctgcttgcagtgggcatgcagcgagctgaactctcaggaattatacctgacactgccgtaaaatgaacaaagggaaggctccttgagtaaaggagcaagagacgggagggaagacgcctcctgtcttggtcctaggtggaagttggcattgccagggggtggtggagggccagggaagagatggggcctgcactggcattgatgggatggctgggtctgtaatcggccagggatcctctacccccacgacccctggtggcatcactcagcctccccttcctctgtagctgtcctcgtggaccaggtactgggtcatactctcaggatccaccctcctgtactacggagccaagtccttgcggggcacagacagaaaacacgtaagtcccttgaaaggactctagtgctgggacttcctctagtggggaagggacctctgtgaactgtggaggatgggggtgggaaagggatctgtgtgaactgcggaggatgcaggtgggaaggcggcaggggagggaggaagccttgcctggcccacgtcggcctcccttgtggagtggagggctgggccccggtctccggatgtgttgttgctctcctccagtataaatccacacctggcaaaaaggtttccatcgtgggctggatggtgcagctgcccgatgaccccgagcacccagatatcttccagctgaacaaccctgacaaaggtaggcagcaggccagagctggcgcctgcagctgctctctgcccatttcctctcttgcacagcgtgcattttgaaattattaggagcttttgaggctgctgccttccctttgctttagattctgacgttcatggggtccatgctagtccacaaaagctgcatagatcatggttggcatgtccattgagaagggtatgaggcacagggtgctggaatcctttttgcagccttacctatggctgctggggcccatcactccaggagctgtagtcttacggtcttggaataaatagtaaggctggatgaggcagggccatgaggctggaagggtcttggctctggggagatttcagggatcccctcacatgcctgtgccataagactctggcagtgtccagttccaaggccaactcagagaagaacccttttaacttcccaaagctccagccttctctagctatctcccagttcctcccggttcccacttcatgatcatgctgggaaggaggagagattctggatgccatcctgtccagtagccctgtcttcactgacattcagaacagactatggtgggtctcctcagtaacccatgtcacatgacaaaaacccaaaattgcctgggtcagttggattccaaccaggcaaactgatttgggctggaaaatccccacgcattttcacaccttaacaggaatgttctactgtagggttcatgaacacacaaatcacctggggattgattaaaattcagatttggattcaacagatctgggggtagagaccaagattctgcatttccagcaagctcccgggcgatgcagatggcagtgctggtggggagaccatgccttgagtgtcaggctctaatgttcttagctgagaagcagagaaacaaagggagcctccaggagcctggaatggggaagagataaattaccaagttctctgctccgtgtctgagtgactgaagccacatttgttgcacacatgtggcagtgtgtcctgagtttggataccatttgagtttcttcctccctcaacagtctggaccggattagcagtggtttcttaaggaaatgtgacacaaggggtggccagggtccatggatggaattcaagaggtctgtgaacttgggtggaaaaaaaaaatgcatctttgttttcagttacttgtgactacttcagttatgagtataagcatccatcaacaaaaatgttagcaatacctgtgatttttatctccaagaggaatcacatattgttacagacatttcaaaatgtcacttatgctcatctcttttacagtgcagtatcggaccgtactagatctgtttttagtgctttaatatagaagcacctatagaattatactgctggtttgttttttagttgtttaataactgtatttgagtattatcgatttcctttgtattttatacatttggaaacattattctgaggattgtccacaggcttaaccagacagccaaaggcaccatggccccaaaatggttacaagccatggtccaaagagaccactggagggagccctggaggctgctttctctgcatgttccagctcacctggggccgaccttcccactttagttacccgtgtttacatttctctttatgccagtcaccagctgaccctcctacgtggccctcttcttaactcatggtttctctacccatcaggcaatgtttacaagtttcagactggttcccgatttcatgcaatactgtggcacaagcatttggatgatgcatgtaaaagcaacaggcctcaggtaaagtcatcaaaatcctgcttgtcacctgaaatatcctctcccacccttggaactaagggtctttagaaaacagggttcccttcttctttcagagcccattagccacactctcagataccctcttctgatcagcatcttcccttgagacaaggcacccccttgctcagcttagaactaagcccagctccagaccagaactttgaatctggttcctgtgtctttcccacaataggaaatgccacagaaacacccactgggggatgattatgagcagctgtgatatcaccccaggatcaggttctagcatctatttaggtcatccctgccaagagctgacttcatgggaatactccagactcactaaagggcctccctgccccacaacccttgggaataatgcggctagctaacttactgacagccagccatggaccacgcaaagctgctggtgaaagggggtccctagcttctcagtgtgtttgagccagcaggatctgtcttgacataggccctctctggcctggctcatggtatggccccctcccctggtcgcccccagccgtcccacgaagggtgttatgcgaaatgtttcccatgcaggaattggctgaattctctcaacatccctgtgaggtagattctcttactgtctccgttttatgctgagggtcctgaggctcagaaaggggcagacacacatttaaggtcccacattagtgagcagtggagctgggattgaacccaggtctgcctgactcccccgattgtctgcttgttgcccctgagccctcctgcctctcctgcctccacttccctggtaacccctgcagctgagcaaaagactggaagcacatccccagctgtcaaggcttatgagagaaatggctacctgagccctcagcagcagatgggggcgggctgaagcctcctgctccctgggggtcaggtgggcagcactgatgctcctgtccctaagtgtccatgtgtgttttccccagggatcagccagaggaggagcgggggaagcaggagtcctctcctagcccatcttgggagggctaggcgcatggcatagagggtggcgcttcaaggaggacagttaggcgtagtgcctgggagtagactcagcaggccccttgcaggcagcagctctgaagtctgggggacctcagcaaaggcaagttcataccaggcatttgggtccaggaggatggggacttcatggtgccacgtggcacagtcacagacttcctggtccctccaagtggttctggaagctgaagggaggtctctagtgacagtgacaggtcctagggctctgtgctcagctcggtctgtaacacagatgaggacaaatacaagaagctgattgcaattacagatgataagttagaaagcagaattagcaagttctcagaattagtcctcgaccaactaaaacaggacaagaccaatacaagaataaacatgaggtgccacagggaggttccaaatagattgcacttgattcccttgactcacccatctgacttcggggaatttgtcatagggatgtgtacacacatgtgctcaaagatgtgtttaagaatgttcactgcagcattgttcttgataggaaccaaaaccctggaagcctctgtgacccttagggggaccctattgtgtgacacttgatagttattagaaagaggcagatcagggcaaaaacatttggaaaggatgatctcatctgtataaaagttctaagatgatacacaagaaatggtaattctgtagcttctagagagctttatgtatagtttgtacactgaataaatgtaattggccatccgtatgacaggaagacaagggttttggtcggcagccatctcaaggtgatccattgagacaaggtgccaagacctgaacaaggctgccgccgccccagcttgcattaagagaggaagagcatcctggcctcctccatactggtcacaccatgtgtgtctggggtccctcagtagctctgagggccgctctcttaagagcatagcacactgaagctcccctaccacacacaggaagccggagcagctccaggtccaacaggaactgacagccacgaggtggaccacctggagggcggtgcggggaaggaggcagggccctgtgcctgaagcctgggcaccatggtggccccagtcaggagcaacagtggtagccctgagtaaaacccattgtccctctttggaggagcggccagaggatgacagcagccccagcaggcagcagtgcctgggcaggctgatccagcagagcactaatgggtcagtttcatgtattggcagatgtggtgtagcatggcaaggctacaagttttaaggatttttgtctgattttcagacctggaggaggggatttttcttcctactttcccccttttttatttctaatttactttcaaccaaatattcccactatgtgctatatgtaataataaaaagttgacaacaactgaaatattcaacagcagaggatgatttaagtgaatcacagtacatccgtgtgatggaatgccaggagggtgtaagaaagagtgtgacagaaatgcatctattcacaaggaaacatcgcagtgactagagtgattttctgttctgtggaactgcatgtcctaaacttgtttttattaacactgaatacacttaaaccttatctataacatatgtataggtataaacaacagcaataaaacaccttattgccaccatgagcctaacagcagagccaccagggccttggaatgctgtccctcaccatggcctcttcctaattcggtttctctccctcccacctgtgccccagcaccactctcctgatttgtttgctgattattcctttagaattgcaggtcacgtacttgattccttcatgtgttgtctggggtgcatttttaaactttcttataaatagaaccataaagatgca

SEQ ID NO: 68 - DNA, 998521 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaagtaagttcttcccccgcccttctcttatttttttcaaatttaaggcagcagtgaaccacagagaaagttaagatgttctttcagtacaatgatctctgtcatgatgctactttctgtcatgcttgttgaaagaatagagtagtaatgattgcaagtgattatttgctggaagagtgaacacaactgcctgtcctttcattcttcctgattactgtctggtattgtaattttgtttagatgacaatgtaatctttacaaagacacaagcttttgaattataactctggtttgttatttaaaagaatttttagtcctcaaccacttcttctacttcctccaacctgaaaaaatacagaaaaatggcatcagaattgactttttgtttttctgtgtgcaaatattgatgatttgttttatgagtggttgttgctggaggttatagttggcagttgagttaaagtagctaattctgcctcacaatgaacagtattttttgtcttttgtgagtatactgatatttttactgtggatgttttagtttattagaatatttacttcctttgtgcgtatctggaagcattaaccatttagaatttgaatctaggtcaactgtatccttctaatacagaattaatgctagatagtattaacagctttcccactttgtgatgtggcctttactttaaaaaatatactttggtagctatagagtgggtgggccctgaataacaagtttcaggttcagtgtgttgatactctgtgtctctagtacacacagatggccatcgatttgatggacttgtagcacgtatgcagaaagccattgttaactagagtataatatgatggcctcctgtaaggttaactccaagtcatactcatttgctttcacaaaagagccaattgtcaaatctagtaaccaaatacttaagttattatgttgcttaacattagagaaacaaataatctgtaaaagaggcatattttgagcgcaaaatgcttgctgtggtttgcacagcaggtatgaagctttgttgtatatgctcatgtgaactgtttttttgttttcttttcacagaaaattggttttactattagtttctttagtttgcttaagttgtggctaagtgtgaatgagtgaatgtatctgtacatgtgtgtcttcaagtttcagcaacttgatccccttgactgtggactcattctcctatgaaataaaagtgccatttaatgggtgcccaattccactgagtggcgacctcctaacccctcagctgttgcaattatgtgctgagcaggaaatgtgaatccctacaactttgccccccaaattacccttaaacataatcattaagtgacctgaacaggtcagagtttgtgctacctaagtgtcagcaacttctctggaaaattatggcatgaagttttgaatattattcacaaaaagatttaaataaaacatttcattttctaggaaatgtttaaaaatatggtatacccactgataatatttgataagtatctgaactatagttttaaaaaacactaataattatgctttaaaaaaacccagtgaaaaataaatgtccattacaactttgctcttaatttgttcacatttaaattttgcatggtatgtgttgtatctttttattatacaactttcacagcagataggcagacataaattgtttttatgccacttgcaaaaattctccagtatttggttcatagcttatgtttgaaattaaaggcaaaaggtaattattatttttatcaaaggaaatcactataattatttgatcacaaaacgtacgtcaagcaaatacatgttgaggaattaatgattcctttgtgttatcactttatcatgaggacttttactccttagacaaattatgaaccttctcaaaatagtaaaatgtaaaaccaaaaattataaagtaatttcataaatgtgactactttattgggtagatgagtgtactccccctttctgtaaatgtgcagatacaatttcagactgtaggaactttttttcctacttaaatggtgtaaaacaatagcttttcataaacgagctgttatattaacttcttcctaacacagaagccccccatatacatttacattttattgtagccctaatgctgggagaaatacatggttttaagtttcactcaggatttgaacacaaggaaaagttagcagaaataataatctaaacaaagagaccacactacttcataaaatgatcatatttattatctaaaagtttaattttacttcagactctattttaagagtgggttttggtcatagtcattttgtttgtatttttccattttttaaaagagttcttagtatcgggaccacttgtgaactagaatcattttgtcattctatgtatctgtggttttcacatgcaaaataagactatacaattataatattgaaaagattgttttacttgtcagggatggcatccaaaaactatttttgttactctcaactaaaactttgtttgaggtttgatatattttcttttgtaatgggattttgttgttgtcgttaacactatagcatgagagaatgtggattcaaaactaacagtgacctgtggggcttcatttattagtttcagactcaaatatgactgagttgcatccaagggtattggaaggaagtgtggtgactcattagtgctcatagtcaattttgagtgaggaaaaaaaaaaagctaatgtgagtaatttatggccagattattttctcttgatagagtcgccatagaaattccagaggtgtaaatcacccagaaactgtaacgtttatttaaattgaatactggaagcacttaggttgaaatggtgacaagaaccgagaatacacccagaaattccaaatgcacatgttaattcgttgcatgtatggatggcaggggcaggatgggaggtagttttgaatgtgagagcgactagcttgaccttaaaatacaattttcaactgtggtgtataaactgaagtgagagacttggaagaatatgtagacgagtatgacttaatctcagcctaaaagtcagtcacgctgagtaagatggacacaccccgctccccccctgcccacacatacacatgtgtgctatttattaatataaggagcatagaaacatcatattctgtccgaaggacaacaattattttccttgagaacctcagcacaccctctaaacatttgttcctcagtgtccacatttaaaatacataacttataaatgaagccagcaaaatgaataagaaacctgtaaattgctaaataattttaaatacaattaattgttttaatcttgtccaattacttcctaagatgatcgtgtgtgtgtgtgtgtgtgtgtgtgtgtgtgtgtgtgtgtgtgtttcaacaataacagcaacaaaataattttcacctaaagagtaaaagtttctgagcactgtaatggacaaatttccttttatatcataaaccttgtttaaaggttgcattcacccttaaaattagatcatggctattgaagctataaatgtaagaggcaaaagcagtcattatttcaaaaaactaaagaaaatgaagcatttctttccttcaagttggtaaatggaaaagttcaaagcttgtttattgtgttccttgatggataagaaattgataggaggtgtaactttctgtatggcttttagagtgtaagcattctcaggccatggcagatgtgtagttcctattactttgaaaagtcattcattctcatgcctagtgaaagggcaaacttccgatagaattaagcactgtttcctgaccgggggaggacagcggtgtgtgcaatgaagtgcatcattcaaaaggaagcccagctaatgaatgctctccctgttgttttcatggaggtgtcagaatgagccttttctgattctgcatcactgaatccttatggaaatgcaaattgtttatccaaggacagtgacttttctttttgctttatcatttaagggacttatttcttcaactttgcagcacatcactggaatccagaaaagggtcattaaaactggatgagaggtttttattactttagaatcttacatctctgtccgagagacagagacagacacagataagtcacagaaagatattcacagagatacaaactcaaagagagatacagggatagtcacacaaagaaaatgagagagactcacagggaaaaacataataaaagttagagacagtcaaatataagaaaaagagaaagggaacagaaagagaaactgagatatacacttagaaaagaacagaaagagagagaagtggagataggttgagacagaaaggtagaagcagagtgacagacaggccgggaaaacacagggtcaagaaagacagaaatagacagattgccagaaagacaaataataatcaaaatgaaacaaaaaaatgtaaagagatagggaaagggatatagagacagaaagtctgagagatagagacagaaagggagactgagacaggcatacatacagataataggaaggttgatatatagatatagatacctagatgatgatgatagatagatagatagatagatagatagatagatagatacatagatacatagatagatagatagatagatagatagatagatagatagatagatagataatgtagaaagacagagaagagagcctgtgatccaagcatggagaatgaaattaaatgtgtgtatgtaagagagaggctgtgagatgggtcttcaagtttcaataactgttgctatagagaattgatggtaaagaaaagaatacagaaccagatggaattgagctttaattctattccactcccttaccagcaaggatcaagttgtttaacttctctgagccttggtttctctctgtaaagggtgataaaaggatgtaattcacatacataaagcatgcaagcacaggacctgaaaccaaggtatatttcagtaaatggagattgatacttatcatcatcatcatccttgacatcaacataattatttaggtataattcttgaaagcaaaagcattgtcatcagaggtcaaggcatcagaggtcaagttaaatccttgtttcaacccttattctgcacagaatatagtgagtaatttaatattgataagctatagttgcatcacctggaaaactcaggtattattttctatctcatagtcttgctctcaattaaatgaaaaagcatatttcatttgtggccttgcacgttgtattttagtaattccactaactagctcagtgtccaaaatttggtaagtactcaataaatatttgatgaaagaatacatatttgctctgaatattagtttccatagagtatggaaaagctgaaatgatgttttggttttttaatatgaaacattgcaatgaaacaatcaatttcctcctgtctgctttgcagagaatggtggtattgatttgcagaattactagaaaagatatctccctactgtccatcctactttcttaaggccaactgaagtaatagttttgagaatggacatttattttgtcctggtggtgacttggtcatttttatttaattacttaatataaggactggttttggaagagagaggcggtaggaatttttaaaaagtaagtgaatgtttatagtaagatgagtgaagatcgaccaaggacaaggaaaagtggaccattaagttagaaaaaaagtataaaactaagaagtgtggagaattttaaatgagacacacatatacttctttttctgaatttcaagaaaagatgggagaaatatcatcataaagaatgtgtatggtttgtaagtgaaaatgtataatatgaaagtactaaggctatccctagctataaggcagattatgataaataaagagatttgccagaaagtaaagtactcaaattttgattttcaattttatgttaaaaatttgaacttaaacaatttttgaattttacaattcagaactttttactaaatttgttattactactgtttgactatgttttaaaaaaagcaatctaggaatgaatgcaagagtttggtttgaatgtttattttcctactttctttgatgtgttgttgaatttatcttataaatgatagaaggaaaaaatatttagagtctactgtgtgccaggagctatgaatggtgattttaaatatgccatccatttaacctctaccaggtaggtacagattttgcccctctgattaattttacttctgaatgtgtgtgcatgaagcccttcatttaagaggtgttgaaagtctgttaaccttacattccatctgatacggtaagcatgaaataaaatactccatttggaacattagctatagttgcattggtgtgctaatatttttcaaaaaaatgacagcaaacatttcaggcatatttataaggtttattgaaaaatttccactcaggatatactgagctttcaatagcatacattatattaattattattttgtatttgtaaattagggctaaggatagaacaatattcagctgagcttcagataataaggtttcattgtgagaaataagattttctcaaataactttttaggagatggtaacttgaatggaagatattgtgtaattgagaaaatgccaaagcaaagagcattgctgtgtgtttatgtaataaaatgcatgtttagtaaatagttgccattttgatgtagattatatttcctttaagatatatataagatatatatatatcttatatatatcttaaaggaaagaaatatatatcttaaaggaaatatatatatatctcaaagcagtttcttagaattcatgattattttaatcaaagaaatagctgtgcattgttttcaaaaaagaacattaaattgtgagtataatgaaaaaaaaaagaacacattcctgccccttagtcaagttttcctatacaactttgtaaacccttttttgtgatgtttcttattttatttattcacatatttttaaataacatgattatgatgttatcttttgatttactgattcaagatattgttttcttcctattacgctatttaacatttggttattttataccatcagctcattttttatcctaccccaagttctaagcacagttttacatatatatacacaagtgtatatatatgtatatatatgtttatatatgtatatatatgtgtgtatatatgtatatataagcatatatatacatatataaattatggctactttactacaatatgcaaaaatagattgtgattcttttctaattttttatttttctatcattaattcatgcctttttcagcttactttgctgaacctgtatctttaaatttttttgagacattccacagatcatgatagtcaatagataaattgacttagaaaaataaatttttctaagtcttcaaaaatgctggccactaaattccatgatttttcagaatggcagtcctcctttcagcagttttaagacccagacttatactgcctcattgcctctgggtgggtgtataaaatctcagcttccctcctgtatcccagagccaccagagatattgaaaatagagaattgacttgcaatacttttttgctgcagaatgggtgtggaggctcagctactcaatatccctgacaccaagggtggggataaagcgcagtgctaactagcctagacttgcaacacagtttcaatctcattgatgcccaggtggggatgaaggttcagttcccctgagcctactgatattgggtgctggtggtgacatggagtagtggagtggagcctacaattgacaagatcatcctcatattgcctccttaattaagtcagcttggtactgggtaggaatagaggctcacctagctcacctggtggtccaggtggaggactctgctaacagcatgatatgggtaggagttgggaatgggggactcagtacatttccttctttctggtagtgaatgagatataagatcccaccctgccagtgctcaacctggctatattactgtatttgtcagggttctctggagatacagaatgaataggaaattagataggtgacaaataggttacctatttgtctgtctatctgtagatagatagacaagaaattgtcccaagtaatcacagagaatgagaagtccctagatctgcagtcagcaagctggagatccaggaatactgatggtattgatccagtctgagttcaagtctgatggtaaaggactcacgtcccagcttgaagacaggtagggagagcaacttttgttctgttcgggacttcagtggtttagataaagcgcatccacacttgggttgtcagtctgctttactcagtttaccaattcaaatgttaatgtcattcagaaacacctttacaggcacacccagaataatgtttaaccaagtattcgggtatcttatcgcccagtcaagttgacacacaaaaccattcatcacagctccttgagtagatgaatttagtggcagctacctgctttctcagaagcaaggttgtcatttgtgaaaaatctgctccctacttgacattgctgaagtcactagtggggtagagatggtgcaatttttgtccttggtatttggctggagtaggcaagtatttcccaaaactttttctgtttttagaccaccatttttctggtcctttgtttagagtaaagatatttttcttggagctttttggacctgcatctatattccagtccattttggagccctgccccagattatgggccagaataaggaaacccagagggctcactgccatgttgttgttggcccttaggtctctagccagttcaccttgttctttctacttctcagggtcattctatgctcattaattgtgttgtgtacagggcttttgtgttgtaacaagaggggcttcttaatgaaatcagaagtcttcctaatgcacattgtaaaggtgctactctccctgctctgtggaaatagtcaacaggtagatgagagcagaaatgagaaattaaggagcccaagcaataatttaggcacaaagaaatggtggctcagcctaaggtattagcagtgcggtggtcagaagtggttttgattctgaatacattttaaagatagaatcaccataatgtattgatggcttaaatgtgagatatgaagtagagagagagattggatgacttcaggatttttaaaattgtcactgagatgggaagattagcatgagcttagaaaggcaaattaagatctcatttttaaacatgttacgtttgagatgagtataatgcatacaaattagataaccctgcaagtttagagcttagaagagaagttgggctggatataaattttaagaaaagaaaaggtctgtggaccttaaattttaagaaaagaagaggtcaaggtttctaagggactgtgattctataaaggattagattctccagtttgaattcaacttcaaactcagtgacccattgagtgaattattaatgcaattccactctctctactgcaatcttgcttccacctttgctatttttctgagatgccccatacctgttgtcaccaatgacttgctaaattcaatggaagatttgacctatctggactacttgattgctgagtactacctcatatttcttttattttaagaaaagaagagctctgggcccttataaggatcaattgtttcaaataccattaatgattccaaaaagacaggaactgataaataattactggtttcaaaaatggaggttattagtaaacatgaaaagcagttcaggtgctgtgttaggattgaaagataattggtctaggagtattttgagtatttttgttgttattgttatttttgtttgtgggtcttaatatttttctctcaagatctcattcttatcctctaagtcatttgcttttttaaaattatattttcttatctttgtgaggatgtttattttaaagcagttttatttagctacctctctattatttcctctccctattcccaccttttattttttattctgttttattttccatttttagggtttcaggttttattcaaagaggctgattaatcctgcttctccattcacattaaattattagatgagtatgtaggcaatggaaacatatatatcttcacgtgtaattgttcagtgtttattatttttcatgtatctctgtgtgggtggattttaagtcaacaggaccttggggccaggggaatgatctgcaacacatggcttccaagctcgctcagaggatttgttaccccagacaactttctgcgggaaaaaaataagcagcctgcaaagaaggtttcataaatcaagataggatgggatgtggcacatgggacttctcacctgcctttgtctagaactcagtcacaaggccaagtttaactattgggaagttgagataaatactcttgttgtgttctaaaagatgagggaaatacatatatatattttttacatatataggtatatatatatatgtaaatatatacatatgtaaaaatgtgtgtgtggatttttaatagatagttgtcactgtcactagtggctgggcactgagatgctctttggaaatcttctgtgtatgagcagagcttgtcagcaggtagacattcctgtactcaagcaaagaattggccttactttctttgacttaaaagtctggtggctctctgacaatttcttcagaaaataaaatcttagttatggggaaggagaagtcttatgggaaaattgctcagaacttggggaaggatccccctaatttacctatacttttatttaatattttaactgacaccactaatctttcttgattttcatgctacccttatttgttaagtttgtcgtattttctccagtcaatttgatagtgtatgttatccatactcacccaattttgccattttcaatgtgatatttttgtattctgctttaaataattatgaccttccatttactttcaaacattaagaaacttgctgaatcacatatttgcttttatcacttttctttcctgtggtttaatactttttacaaattttaaactgagctatgtggaagaaaacaaataagcactttggtcaatctaaaatcttaaactcacatatttgcacttcaaaattaagaaaaggtgattgtgggatgattgatttataaatagttgcatttaaacatggaatttaaacatcaatatgcttactgaatatcttaatgtcaacatatcataaatatgccaattttcactgtaaaatagtgattatgattgttgctaaggaaatatttggttttgaaccaaagtatatgttaattgcttgtcagtgatttatatttgtagctactaaatcactcaagcctctgtcttttgcttaaagcacacacacacatacacacacacacagtcatctccgctgcagtgcaatttaatattgaacatagatgttgaggacatagcaggaggaaagaataagctgttagacaactcatcaggaaattctctctcctgcagcttctcagcaagtcatagggtaaaaatttaacaagggacaaaatagaaacaagatttttggataacttataacattcacacatagtatgtctttaaggatttttgtttttgtatttgctttggtgttggtcataccaaagacattcttataaatgttatgttatatattggttgtcaaatgaattttaaatatgaatgttttgggagccattcactatattagacgtacttatgctttctcatagaaaaaaaatcagcaacaattcctgagacattcaatgtgaccccatattccatgtagttagtattattctcatggggaatataaatatcttctttgaaagtttcatataggaaatgaccaagtttctagaggaccttgattctataaagaattagattcataagtttgaattcaacttcaaactcgatgacccattgagtgaattattaatgcaattccactttctctactgcaatcttacttccacctttactatttttctgagatgccccataccagttgtcaccaatgacttgctaaactcaatggaagatttgacccatctgcattacttgctattgctgacttttcccccatcttagaatctctcctctgcctacttttacatagcataactttcaccttttgtttattttttgtttataattatttacattttaaatcttattactgaagacagattttaggtttactttcaagctcttcttactctatgtatatctcacacgttaatgttctcagatatactttcttatttttttcccctccagccttccatattacttctgatttattttatctaccgttaaattcttaactaatttctgtctatagatggcagctaaaattgtatctctgacatctccaaattttattccatagctcagacctgcataaccaactgtctcttggaactttcatttggatatcccatgattatttcagattcataaggtgtaaaactaagttcatgatctcttctccatccctgcttcctaacctctaatttttcttcattataatcttatttcgtctactaataacatctaatatcatattacaagcttgaaacccatatatcagccctgttttatccctgtttgtttctgctcgtatttcaaatgctatattttttcctgttaattctatccccttaatagctttagagtcaaaccttcctcccatatgttcctgaaagttctcattatttttcacctgatggtcacccttcctattttttgtttctccccttcctgtgcctctcttctttcttactctgttttctctacagtgctgccagtcttatggtgtcattgcgttgctaagatattccaagttttctcatgctgtttattcacgctctctcggatactctctttctgcctaaataagtttattcaaaagagaagataaataaatttattgttctaactaattgaaaacctagtgatatataactggcttgctacaagcttcgctgaacttaaggctcaaacatgaatttgggatgcatctctccattggctttgctagttgaatctgtcctcaaaatccgtatgttggctctcagcagctttgagccctgaggttcatgccctgatgattaaactgaaaatctctgatttcctgaatgtttttctgccccatgaagggaaggtgaaaagtccatactggctcatcctgtcatgttctgcactcttgatgcctggagaagagtcacttttagataatatagaggtagtgtaacttgccttgcagaagagaatacttaagagtaactgaagtgagaaacattgcagtagcctctcacattgaatcaaattgtttagaattttgacactattgttgactatcacataatgatatgtaaaaacttagacatattttctaaaaagtcaagttcaaaacttgaaaaataaatgcttttagataaaggattgtatcatacactttatatatttgtgtaactgtcacaaagcatacattaagatgatttttgtaaaaattgtttttttttcctttttatctttatgtagaatattttggaaaccttttaaatgttggcctatatttataccctgcttttagcatatatttgtcaaccatttaggactttttccacatttttatagataattaatgaaccaattaactgcattatgtgattcacatgtacagcaagatcaagttttttagaatcaaaattggcattctatctaaagatgataccttcaaagttagataattaaaggccatggactttgtaggataatcttctaggttagacaagtaaaacctagaacaaacaaatctagagatattatatagaaatataatatctttacatagttaacttttgaggaaattagcaaagaaaattgcaatggatacaagttataaaagaacaattgtaataataatatgaagacctgccataccctatttgattttattctcattattataaaatactataaattgttttcttagtaacaggaacagattgataagaagaaaacctaaagtcatatattgaagactaaatgataagaaactacggtttgtcatttcattgtattgacataaattcaaagatctataaaatcctattccacaaagcatacccttcatttaaaattctgctttaataaaaacgtatctttcttatgactatattcccaacagtactgacctgcatggtgccaacaaatgtttattaaatgaataaatcagatttgtttctcaagacagctgtttcttgtgaataatctgtactttatgtctttgacttctataaacagagcattatcatggatacttgaaaaataacttgcctgaattctctgaaaatatttttgggactattgtgtctatgtttttatctgttattttggaaaagtcttgtatatgaaagatcttctcctaggagctcaaactttaactggtggaatagagtgaagtagtagaatcatgtgtctgttcttgctgattatgtatgtcatatatgattcattcaaaagctacattcgagactttaactatggactcctcagatgatattatcctagcattgatatacagatgaatgcatgactgctatgctctcatcaagctgccggttttgtgtcatatattctaaaagcacagaattataactgacggtgattatgggactttcactttcagtaattgcaccaatcagtacaatttcttatattactttacctggagaagtataagtgcatattatatcataagtgtggacactcaatacatttattgaatgaaaaaatgtagaatccaaaataaacacttcagtctatagctctaggaactcaataaattatttattagaaaggaaacctttaacaacgtatcagagagaagggggtgctgatggcaatccctggaacttccctgaggtgctccatctctagatggtgatgaagatataagtgaggatttagagtcaagcataggatgccttttaaaaaaaaatgtctgtctctgcagaaacagatgacggtaaatcttagctctgatggcagaatttaagatttatccagggtgctacatgcttttttcccccttgtctcagcctaagtttacaaagaattagtatagaaggtcttgaaatctgaacagccatttgcgttcatgttgctacccaaagttattgtacaagggaattttgagattctgcatcaaaggtggaagaatgctagaaaatcagcactccctcaggaacattaattaatccagatcaaaaggggatccaggaaactcatcaaaggtatgcaagggataactctatgggttgtttcttaaatagtctctcaggaattgtatacataatgcttattaggtattaccctacttgggagttaattagagagctaaaatatgaagcttaagaaaggaggaggggattgtgaaagaaaagcaaaatacattttattctagtattaatactgaggtatgcagctaggtagaacaataagagaaaaaaatgttgaggcaggctccaggctcctatgtatcagaaagaaaaaaataaagttattttttttttctgatcaccaaaagtttgagaacaagaagttattttccaagaagagtaaaaaagaaaggcatttttataaaatggaactgactttatgctgcctttcctttttgtgttttgcctgctctgtatcttcttctgatctgatatttgggtcatatcgggtagatgaactctgtgttccgttctgaaatgcaggcacacttcctgtcttggtcagggatgtcttggggcttagagaaggactgatgactgacatgatggaaatgaagccattaatgggttcagtatgcgatgggggttgggagctgggtgaagtcagaggtagaaaaaataaaatatataaaaattaattcattcacatagattcatcttcagattattcaagaccaaaaccagcatgtataaagatataaacaaaacaaaaagcagtaatatattatatgattatgcagagttatacaaatatatattgcctttttcccagtatttatttttgccttctgatcatagcaccacaattttccttggattacatttttctccatcagtaattctacttttgcatgatttcatgatgttagatatcatctgtttgcttccagatgttggactcccttaagcatttattttcaggccaatctagtggtgatgaattgattctcttagtttttgtccatataggaaagactttacttcttcttcatggctaaacagtagctttgctggacatagtatttttgaccaacttttatttttttctttcagcactttgaatctattatcccattattcctggcttgttacatttctaccgcgaaatctgctcttagtctggtaaaaattcccctacatgtgacaacacttttctcttgcttttttttttttattattattattctaagatctttttatttatttttttattttttaaaatttcagtagctttaggtgtacaagtggtctttgattacatggataaattgtatagtggagatatggttaggccgtgtgtcctcaaccaaatctaatcttgaactgtaaccctcataatccctataaccctcatgtatcaaggaagaggctaggtggagctaattaaatcctgggggcaatttcttgcatgctgttctcatgatagtgagtgagttcccataggacctcatggtgtaataagttcttctcccttcacttgacacttctccttcctgccgccgtgtgaaaaaggtgccttgtttcccctttgccttctgccatgattgtaagtttcctgatgcctccctagccaggctgaactctgagtcaattaaaactcttctttgtaaattgcccagtcttgggcagttctttatagcattatgaaaacagattaatacaattggtaaagtctgagattatagtgcacccatcacttgagtggtgaagattgtacccaatatgtggctttttgtctctcttattcccctcccagcctccccactttggagactccagtatccataattctctttgtcttttacttttgatagttttactataagtatcgataagaaaaccctctgggttgaatctactaggaaatctttaatctttctgactctggaagtccatatctctctgaagacttgggaatttttcagctcttactttattaagcacgttttctatgaattcttatcttcatcagaaacttcataatgcaaatatttatttgctgaatgatgttccatatgtctcacaggctttctttactatgtttactttgctttcttttttccttttcatcattctttctttccttgtttctttctccttatttgatgaggttatttcaaaagatgtcttcaagtaaaaaattcctactttatggttaaagccctcagtagtatttatcatttcagtcactgaattttccagttccagagtttctgctcgattttttctcatgatacctatctttttgttgaatttctcattcagatcataaattatttttcttattatttaaacattttttctgtgttttcttgtatctgtttctttgttaattattattattctttttcaagcattccatagatttccttttagagatgggttctcttactggaaaattattttgttcctttgaaagtgtcacgtttccttgcatttacctgttttgtatccctccattgatatctgtgcaactggtggaatagtttcttcttccaattttatggagtagcttttataggaaaagactttttttcctgtagatgtgtcctagagtgttggtttggtagagtgctttggcttgggttctggtgggcacattagtatagtctccatgtgatttctctgacttcaattaacatcagtggtatgggtgagtgtcttggtagcatagactacagttgtttgtagagactgtggtgaggccttgctggagagaaagatattgggctggccagctctcctgtgtgtggcagtactaccactggatgtgttggggactccagtggtagcaagcttggtgggctagttcttaggtccctgaggtcgtgtataagcttgtgccagctctgccactaaaggagatgggggttctcttttggattatctcagcaccaaagatattagcaaaaaaatcagcctgaagggagagaacaattgagagataacagacattcttgccactaaagttaatggattcttctgtaatcaattagaaaaagaacagatttggtaggttagtacttttacgttttacattacttgacacataaaattggagcaatactctttgccagatgacaggaaaacaatagcattgattttagtttatatttctgagcatttcacaacacttacataggcattattagcctaattttaaagatatagaaactgaggctcacagagttttaagtgaaccacagcagtgtaaattatggagtcagaactggaacttaaatacgtctagctgcaaagtccctgcttgttcacagtattgtactactagatcaagcagtcatatcgcatcctcaaaatttaccttttcactgtatcaccgctgctattggagtatcaatagttcttttcacagtaggttactaaatcagctgttctgcatggaatactttgaaagatttctcaattctattttatagatctgtctcataactttgcttattaaagaatgtattttgctttttttaaagccccttatctctgagacttacaagcctatttgaattatttgccaatgagtttttcttgcactgtgacaaatctaaattacttgaaaaagcataatacatctttgtaaggttttgtctttctaaatgtaaacgcatagtaccagctgttaggtaattgaaagcaggaacctcgtgtttgaaatatgtcttcctattggtaatattctttcaaagcaccattttatttccagaagaaagaatgtgtttagaggaagcaaattgtaaagatgtttagtgagctatgatattcaaatccagggaaaagaaaaaagatagatttagagaactaatatcttacagttcagatatttagaaaataataatttttattcaaaacctttttccataggctaagtcattcacagtatatttattggaaaactatgttagtgttattgcttcattagaatgacttcatttcaattactagcttttcatcagttgtagagtatcaattttataatcacatttcaggagaagataaactgtgtatgaaatgtactttgatacacaggcattaatatataaaaagggtcagtatattcaaagaaatatgttaagtgtcttcctatatttgacaatgtctacatagatgtattaaattttgtgagtactatggatctcatataaaatatatttgacttagggcctgtcgggggatggtgggctaggggagggataacattaggagaaatacctaatgtagatgatgggttgatgggtgcagcaaaccaccatagcaagtgtatacctatgtaacaaacctgcacgtcctgcatatgtaccccagaacttaaagtataataaaaaataaataatctcttaaaaagccaaaaaacatatataaatatatttgacttttctcacttgggctaggtccaaaatgttttatggtgtgaactgttgatgatttttattaaaaagtggcttaggtagaggtaataaaatagaatccaagataaacttctccatattgcagctcttatcccttaccataggctgtgcgtgtcattttctcccacattactgtatttgagactttatagcaatgctgtttttctaaggagctttacattttattgggccattttaagtttctgatttagttttgatctctgttgacaatcgggcatctatatcattcaaagctactatgattaaggaagctaccaaatatctccaaagtaatttgttctcattcgttaaaagataatttatattctagaattttcttttttttttttttttttacacaattgctttatcacctgatgagtgtaaaaatgcctcatttttattcatacctcaaatcctgatgtgtggagccctactctttggccagaaacttgatagtgttttcctaagctttccttcctcaaaatgtttccaagaatgtctcaatattatgaggaacagctcatttttgtcagattatgttgattgtgaaagaaaattacatagattttagtgaaaaatataaagaattgtacattaaaaaatcccatcctcaagggagatatttcgggtttcacgtctcctcttgagaacaaacagttctcccagttcccaagccttgcaggttttgcagtaaacagctgacccacagctagctaatgctgacatctctcaccatgtcccaaagatttttgtatttacgttagtaaatgtaatgtaagctcagactgataactgtccattgcatataagctatcaaaactgattgactcacatttctctttctcttaaaatatatcctccttgtggtaagggctttcttgctggcttgctcaaaagtgatgaagtattccctagaacttatgtgtggcacctcacacgaagtagtgtcttacttatcttacatgaatgacagcaagaattatttgagaacttctctgcggaacattttgtaattctatatagaattcaagcaaaccaccccaaagggctaaacaatgtagaatttaccactgctgtttataagaataagtgcaaatatttcttatatgcttgccatgtgctataaattatgattctgtagttgcatgaacataaaccaatagtggccaatttaatcataaaaggatcttttctggagaatattagcccacacaaatgttgagaaggtttgagaatgagactagtttataaaaatgctgcagtaaagcctcaggggtctatgtaggaagcacaaatcgacaatgttgatagagcaccaccaattgaatgaatgaagtccatttatttttctcattcttgtgtcattgtactcacagttcaaattattgggaatgacagtaggattcatttacaccctgctaactctctgctgtgttcacattttggctagggaaggcaggcctcttgatttacataccagcccggagcatcacatagtaggaaagaatcagtgtgctgtattgaacagaaaggggaagaaatgctatatatatgtgtgtgtatatatatatacacacatatatgtgtgtatatatatacatatatatgtgtgtatatatatacacacatatatgagtgtatatatatatacacatatgtgtgtgtatatatatatatatacatatatatatagagagagagagacagataaatatatatattaaataaaagtgcttattactgaatcctagtcctgattactaccaactctgacagagttgaggttataaagaatttggctttatcctcaatgcagagttctggtcagtaacctaggttacttacttcattgtagtggattttgactcatgaatatatttacccttggttacttatttcattgtagtggattttgactcatgaatatatttatcctttcctagaatcttgccttagaaaagtggagtgaggcctattttgtttttatagtcctgcaacttaaaagggtattagattctctatctctaatctctctcctgaattagaggttgtaaatatgtgagtaaaaggagaaatcccttcacacacgagcagcataagttatttaaaagcaatagataggctggaacaggaaaggaatgaaacccaactctacctttggtagtaccaccatcactgccaacatgccttttttgtgtatttttttctttgatgcctcaacttaatgtgaattataggttagagttcttgaacctctttataaatagcgacaattgtaactatatatttggtctgcaattatcaaggcctcttaaatttattttagtaatgaatgtgagattcaatacgaccagtcaagagtagataaatatttaaagagaaactcttttagaattatatttaatgaatcctgaaataattaatatgcctgaatacatcccaattttaaggagaatgcagtgttacttcacaatgatttaccactgtacattattcccaaattatagtaaaaacactaaccagaaacaaaagtgtaaattaaatgaaacctgactttataaaatttttacagtgtgcaaaaacattgtctacagactttgtggtttcattccatagtgcttctgtatagcagaaaagcaatgtttgataatacttattcagagaaacaatagctgataacgcccctccaccccgggactattgatggattgtgtgaatgacatttactgaaatcatcatatcctcaagatacttagttaatgtaatataaatagggaatctacacaaaatgtgtctctcaacactagaaatttaggctagcacaaaagcaaggacatttatcagtaatccacactgagactggattcccttgttgaactcacccatctcgatcagtgcaaatacataacatttgtgttagcaacattctcatttgcttttctagcatcagaagatgagtgcaaaattgggtaaagggaacttgcatcttgcatatggcaatttcaaagtttctcgtgaattcttccttgtttcataatgtcttggccagtatcttctgattctgtctgcacacagtatgcacataattaataactcctttcaggatttttattcttttgctagctcaactctactgatcttctgaactgacttcatatttccagcaggattgattgcagtaaagaaaagatctaaaaccccatgctactagctgacatactttggaaaactcttaagaggccctcgtttccagctttgctataaattaccaatactttcttttggcaaaaagaaatctgttttaattttctcaatttttttcttttcaattattcttcaaataagtacaaaaggcagctacagaaattatttaaaagtaaaaactctgaatgaaagtttatatggaaatgtacagtactaaaagaaaaaaaaagaactttgaaacagcaaaagaacccatgtactgaaattggatggatgcttaagatgaagcaactcaagtcttatataagtttacatcatctttcatttgcctgcttctgtgactgttgggaatgtctgctttattgtgatgagagcgcctcatatccttgaaatcctcctctaacccagatgaggtaatcctcttgtaagcagtcttagtttttgtgccaatatttccttgaagttccgcttccctttttcaaatggataccaccaagattgttctttctttctcctaaacgtcaactcatttttagtgtagaaactgtctgcatctcaagagaaccactatggctatggtcaagtacacatccgcaccctgctgagcagccagcgctcgatgattggtatggtggtggagtgaaatagatagtattgtatagatgtgcgcaacgattgtcttaaggcaggacagctcacagtgctgattctgaaatgattgcatgaaaatagtcaccttactcatcgtaaatacccatattccagaataaccacctaagtcctctttcgtggtatctcttaaaaagcacaacgcatcaaccagaaattgatattttaatgaagtttgagtaaaaataatgagaagaggattcacattatactataaacagcatatttttccataataaaagaaaacatttcttttaaattatgtctcttcttcgcactccctagttctttctttgtataaacctcctcttaactctgcatttttatttctcacattgcctccagtctccttctgttatgatactgggacagcttcttggtcctctctatgccgtgtggtgacgtcacatactcccatcagcaagagacatatgaagccaacaataaaacctaacaaaccgagcataaaacatgacaaaaccaagccttccttcaggggaaaatcctacttgtagtaatattttaaaccaactgtttaatttatttatttgcattttctgtagcctaaactgaaaactcaagctttccatggtatcttatatcatgaatggcctccacttaaatatgttcttttcctccacattcactctaccaccagcatgaagacattttataaaatacaggcagaaaatcattgccctaatgtttaactaattagagggtaagcttaagtctgaggctacaggtatgaactgcttggaatcttttttttttttaattgtatggttagaactgtgtctcatgcaaagtatataaacagtgcttctagatcccagatatcttaagctgggactagttaattttatcaaccagtttgatgaatacctccttaaattaaaatgatcataccagtaatctcactattgaccatttatccaaaggaaaattaatcagtacatcgaagagaaatctgtaccccaatgtttattgcagcactattcgtgattgtcatggtatggaatcaacctaaatgtctatcagtggatgactgaataaagaaaatatgacacatatacacatgaaatactattcagacataaaaaatgaagttctgtcatttgcagcaacatggatggaactggaggaaattatgttaagtgaaataagaaccaaaagttaaacactgcatggtcttactcatatgcagaagctaaaataagttgatctcatagaagtaaaatgcaaaacaggttactacaggctggaaaggttagagggaaaggaaggatgtggagatatttgttttttttatgtgtttgttgttgtttgagacggagtcttgctctgtcgcccaggctggagtgcagtggcgctatctcggctcactgcaagctccgcctcccgggttcacgccattctcctgcctcagcctctccgagtagctgggactacaggcgcccgccaccacgcccagctaattttttgtatttttagtagagacggggtttcctcgtggtctcgatctcctgacctcgtgatccgcccgcctcggcctcccagagtactgggattacaagcgtgagccaccgcgcccggccgagatatttgttaaggaacacaaaattacagctagatagaatgatcaagttctaatattttatagcactgtagaatgacaatggttaacaataatatctatttttaaatagctagaagatactaaatgttttcaacacaaataaatgataaatattggagataatggatatgctaattaccctgatctgattactatacgttgtgtgtatctaaacatcactatgtactccataaacatgtataactattatgtgtcaataaaacaataaactaaaaaactatcagttgatcaagcaatttcattgtatagagttcctattaactgaaattgcagtgaaaacatcagtcattaatctcgttaggataaagatataataacaatagtaaataaaattatgtccaggattattcttcaacttaagattttcccacaggtatttattaccacatttttgaggcattctctcctttgggtttccaatagtaaataatctattttttagtagactctaacagcatctgtgtacttccctcataattcttttataatatgtcctgcataagtgcaatcaagtttaataatacattgatataaaacagtctaattgtcttaaaggacaaattacaaaggtgacgcttgtgtggaattacaaaggtgatgcttatgttcaagtaaacctcaaagtaaaaaagcacttttttttcttctttattaaatagattatcttcaaggcaggaggacatttaataaaaaataaaactaatatgaaaaaaaggagtaaatgtcaggtactgaaagtagtaagcccctaataatgacttacctaagatttcaggagacgtggtttctaatatttatccactcattaaacattgtgctaagttttgacatttaggttttacctactactggaatttaaatgaaaataatggtccctaaggcttagtaggtaatactgcctgggataactaaccactggtgaatttaagtatacagagtttgttaaaacataagttttatttaatattaatttatatgcatgtataacaatacgcctgtgtttggatgtgtatgtgattgtatgtatgtgtgcttgtgtgtgtgtctattcttttttaaatgtatattttaaatttgtgacacttatttatgttttagtttcaagatatagtagatacatagtatctcattcactctatacttgaatctgtcagtgtgtagtaactgctgattgttttactgcccttaatgagtattacagtaaattatttataagactatgaagtggctgggcgcagtggctcaagcctgtaatcgcagcactttgggaggccgaggcagacagatcacgaggtcaggagatcgagaccatcctggctaacacggtgaaaccccgtctctactaaaaatacaaaaaattagctgggtgtggtggcaggcgcctgtggtcctagctactcgggaggttgaggcaggagagtggtgtgaacccaggaggcggagcttgcagtgagccgagaccgcgccactgcactccagcctgggagacagagcgagactccgtctcaaaaaaaaaaaaaaaaaaaaaaaaaaaaaaaaaaaaaaagcctatgaagtatgccagttcatctagacttgacttttatgaagtgttaagcagcaaatgttaagtaacagattgtcagagataagaattgggccttacacagttttgaagctgacttcataagaaatcagttcatttttattgtatgatgctcctagattttttttctttaggttatttttgcagcattgaatgatattttcttggtattttagaaagtgagaaaaataaaaacagctagaaaaaaatcaataagaactcttttaaaatagtgtttctagtcaggggtgaaaagggcaggttattgacctattggtaatggtttaacatattcatggaagaatccaaaagtgctagaatcaacatgtctcagtgtgacaagatgacaatcatctctgttacctccaaagtactcatagttaaaagatttagtgagatctctccttctccatgtgatatcaaaagtaatttcatgttgagaatgcatctgcaggtgttggtgattaattatagaatctaatgatgtaccatcagccaaatctcaatgacatcaatgctagctgtacctgatttgtgaaggtagagaatttaaatctttcatttataatttttagacaatcccacatgaactgataagcatagttttaatttattaaaaatgacgtattaggagaattaagcatttgtattcatttgtattttatgactcatttagatctagtttctccctctaagaaaaaaaaaagtcttcagcttttaagttcggggtacatgtgcagcatatgcaggtttgttacataggtaaatgtgtgccatggtggtttgctgcagagatgcataccatcacctaggtattaagcctagcatccattagctattcttcctgatgttctccctgccccccaccccttggacaggccccagtatgtgttgttccccatgtgtccgtgtgttctcataattcagctcccactttaaatgcttgcttttctgttcctatgatagtttgctgaggataatggcttccagctccatccacgtcccttcaaaggtcatgatctcattcctttttatgctgcatagtattctatggtatttatgtaccacattttccttctccagtctatcattgatagtcatttatgttgattcaatgtctttgctattgtgaatatggctgcaattaacatatgcatgcatgtgtctttatagtagaatgatttatattcctttgggtatatacccagtaacaagatttctgagtcaaatggtatttctgcctctaggtctctgaggaatcgccaccctgtcttccacaatggttgaaataatttacactcccaccaacagtgtaaaagctttccctttcctccacaacctcaccagcatctgttgtttctttgaacgttaataagagccattccgactggaatgagatgttatctcattgtggttttgatttgcatttatctaatgatcagtgatgttgagctttttttcatatgtttgttggacgcatgtatgtcttcttttgagtggagcttctgcacaacaaaaagataagacaaaattttaaggtgatttttccaagccataattgtattatacattctgaatgcagttataatacaaggaatgtcttaaattatttattttacaaagactttacttttacatattgaaaaatatgtttgaacatgaacattacaagtaggaaaatatgcctgagaacgtgcatttaatggctcttcctaaattaacttgcttaagttttggaatgtagccgaagagccaataaaatacaagtaactatttaaatgtatgtaatattatatagctataaaaatatgtatgtttcatttatttgaaatttgtaaatttccatttcttttatatattcctcaacagcttataaaacagacaagaggaaaaattattatctgagtggactcatgggtggcttttctggtagatgttttccatataacagctgacattcatagcatgttttgcattgcacttaattccaccgaatacttataaagaattacaatcctttctattttgcaatgtggtacaataaggtagatttttaagcctgagtttgcctgaatttacatatacagatactttcacttattaatttatattcagatagtgatactgatcattcttcatgtgtaagcaaataaaagatgtcttttgaaaattttaagacggaagtgtgaatataaatcaaacctcaacctgtcctctgtctgctgagtttaaatattagtataaggaatatttataattatgtgtaatttgtacttattaaaataaatgtctgtttgcttggtgttttttttggattggcaattttgttaaactctaatccctttggagtttgaggaattactactagcatgcaaaatttttcatgacgtctgaaccaattcaagcctaatgataaaatgtacttataaataaagctgtatattttcatcactcaattctgactggcttgaactattagattttagagtgatttgtcttatgataataaccttgaaatgatggtttgggaaaataacatatgatcaaatgtctaaccaaaagatattcagttacatcctgatacagaaaataagaagacataagtatgtttttctttaaattgatcactttgacaacatgatttctataaagtctccaacacatttgacaaggctaggcctatctaaaatagtttattttcctcctttctctttgccaacatctctcaaagcacaaacagatagaaatttaacttcaaatagagttaacaaatattgggggtattaaagcagtattttggcagaaatagaccatgaaggttaaattattctcaggcagatgaattcaaagtacctatctggttcatgatgagtgtgtcaatagtgtggtaggctaccaagacagataagaaaggggtaagcgtggcatttcagaatatcaagaacagatgtaatttgaaaaagttcccaagtaggtaaaaatatgggcacattgatatcatctaatacttttgcaaaagccaactggctattctaaaagcaaaatctaaaaattatcattaaaatcttgcaggaggacacatatgcaaagtaaattttgaacaatcaaaactcaggaaggacaaaataagggcagctctgggggtctagtgaaggggaactcatgagcatatatttgggtaatttcgttgagattaagtaacttcatttaatttccctccttgtaagtttctacagcataatccaattggttaattgtttcctaagtcaagcacaaggccaggggagagtgagaaaataacttgactgacagaagtaccaagactttgtatactaggggagacttcaaaaattggagtactcttagtaaaaggatgggaaatgtatgctaggcaggtacatatcctaaatgtccacctcacagcctgcatttcaggtatcgttgaactaaaatgaacactttaacatagttggatgtactttctgaaaaggatggctctgttagtgtcagccttcagattttactctggagtttaatatcattcatgagaaggtaactgggaggaaaacttcaatgtttaggaatgagtagtaatgagattaaatttttgttattctaacaaaatgagctctgaatctaatctgatcatttgtaaacttacttgcaaaatcaaaatgaataatagagtgaaagatgaatgtaatatgtcatggtatcaaggtcataatttgaaaccattaacagaatcagttaactcattaaaaggggattctctgatgtagatgcagaaacatatgccctagtcaaattttctatgccttagagcagctctttctgatagaactttcttcagtaatggaaatgtttctgtatctgcattgtttgatgttgttgctggtagctcatgttgctattaagccgttaaaatgcgttcaggatgactgaagaagtaaatttttaattttattcaatttgaactaatttaatgtaaatagatacatatgtgtttagactacaatactggacaacagagtattagtttttactttcagttaaggagggaaccaaaaattgagaactacagacaaaaaggtatttgctaaagaattagagaaacgtatcaccagaagaaaagaaggattgtctatcagtgctctgagttgcaaagaacagatttcaccctaactggcttatgcaggaagaaatactgttgagggatacagacaccagagctggactgctgaccctcaggcactggattctagaaactttgtcacaactacttcccaaagatggatgctctgatgccacctttagcagaatggattctgtacacagtctgctttctcatggcattttgtgatgatgtttcctgtaaatatatcacattttgggatcccaggttgcatgctagcatcccacccataagaaaatatggtctatcttggtgacgcacacactaatttggtgagtttgcaaaggatgctggtttctttaaagtcactaatttttgaaaaaaaaaaaaatctcaggatgttcctgagaaacatccctgcaagtgttttaagcatcctttcacttaacaaatttaattatgtatgcttgataaaatagaaaaagagtgggagatttaaaaaaaaaaaaaaaggcattgcgtactctgctgtcaagcatgcctgccattctattcaataagcttacaccctggagtgagcagtgacaccaggtcgctgttaactttatctatggctgtgtctttgtagttctcaacatgaagtgtcttgcaactttgattattattagtgtttaacaacagatttttaaaattcctgttggctcctatacagaagttaacaactcactgaaatctgatatattatatacaaaaatttcatctgttttaaatcatttgaatgattgagagaaatgttgggtgcatcatttctgcaggctcagataatcaaaacaaactgaggaattaaaatgaacgagcatttccaaaccaagtccaaaagttttacacttctttcccagacagagtcctgtcctggcacagaacactatttaggtttcaaactaaaactatagtctgtgcaggaaactaaagacagctcaggactgtgctaatgcagatcactttacaagtggcatgacatgggtttggaaaactaacaaggacaatgtcaaggaaggtgggatacaccatgtaaggcacttgggtttcatgctatatgtgataataaagcatagagggatttgaaggaatattttaccccattcagaacctaaaactgaagcaaaaggagaatttgctgtaagagtcagattccaattatttgggatatggggtgtccttcacttcttcattcatattttccaatttttcaaaatggtccttaagtctcgcttacttcttaagtatttcataatgctgcttagtttctctgaaatcctgagaatatgaactacatagaatatgatcccagccttgaactatgttcctaaatatgttttgatttgtttcaatgttagcaagtttactttctcaagtagattgtaatctctctgagggtgacatcattttgtaggtaaatcaacggacaacagagctcagtggggcctcagaactcttgtagtcctgttcattcatttcatagcaaaccagggaaaagaggcttaaatgacttatctaagtgtgcccaagcagcttattgcaaagcaagaagacttcttgtcaaatcctctggactgtgtaatttgcattctctctatgctctcatgctgttatgcccttcagacctgcatataatcacattcatatttagactctttggttaagttatttttattaatagacattttaatagaaaaaaattagatttacagaaaaatagaggagattgtacagaaaatccccgtatgaccccagcatacaggttcacctattagtaacatttttccattagcatggtatatttggtaaaattagataataaatattgatgcgttattattaactgaaattcatagtttattcatatttcctaagtttttatgtaatgtcttctatctataccaaggtggcaccaggacactatgttacatttagttgtcctaactctttgggcttctcatggctatgacaatttcttggactttgtttttgatgaccttgacagtattgaggcatgctagtcagatattgtagaatacataccatgtgttgggatttgttggtgcttttcctattgataagactagtgcttgggggaggtatattacagagggaatttgttattttcctcacattgtatcaatggtacatactaccaatgtaatttatgactattaaatttgaccttgatctcctggatgaaataggacttgtcggatttctcaactgtgatgtcactgttcttcccccttcccatactgtactcttaggaaagaagtttcttacaccagggcacacttaagatgtaaggatttatgctttccctcctttagtgtggactgtctatgtaatttaattggaattcttctaaatgggaggcttttcctctactccctcatttattaattgatctaaacacttattagcatggactcatagattctgtttgatactttcatttaatcatcattcttgatgactaataggtttagttttaataggttcagttttaatttcatcattaaaattaatggaggagttttctccagtcctcttgaatatttaaaatagcttttcaatactctctgtttgtattcagtatttaaaaatatttttgaactcgtaataaattttgagccaaacagttacgtattttgcaaaagcctgaaaaggtgtctgcagattagagaacatgaagatgttgtcatgtattctgtttaagtaacaaccctactaagtctataatgttaaaatatagcatttatggttatagacgttagtaaatatgattgtgtattcagtgggaagattatattaagaacacaaaaaggtgtatagtggatagatttttttttttgtttttttgagatggagtctcgctctgtcgcccaggctggagtgcagtggtgctatctcggctcactgcaagctccacctccggggttcacgtcattctcctgcctcagcctctggagtagctgggacttacaggcgcctgccaccgcgcctggctaattttttgtatttttagtagagatggggtttcaccgtgttagccaggatggtctctatctcctgatcttgtgatccgcccgcctcagcctcccaaagtactcagattacaggcgtgagccaccacgcctggccctacaaactactttttttaacttctgacccagtctatttgtagtgtataaaaagttgtatcactatgtgatacatttagagaaaggaactcctttttttttttcttgtatcaattgcattcacctggggaatataaatttatatttaactcttatgcctgacaagatgctgacattagtaatgatatataaattaactaataataagctttaaatggtaattaagcgttgatataatttaaagcagaagcatcaagtaagaaattcaatttagtatacgcttaaactctttaatgtaaaagtgtaaaattttttcacaaaatgcaatgatgttaaaatgaaacttttttcaactttatttcactaatttatctctttctctcattgttttcatcatttctcctctgctgttgttttgtgctacactatttctctttcataagttctattttgaacaatttttctggcaatagaaatttaaacgtattactcattttattgtcctatttttattgttgctgtatttttttcttattccagatacattgcatgattaattttctcaactagaagatatacaatgtatatagctatatttcacacaaagacactgcacatcttattacagaggaaaagtgatgattcttggtgttaccatttagacaacagatcatggagtatttagtgtaaagttataaatcctaacattaaagatcagaatgttattgccatgtgaagcatgaaaagtaatgtgaacataaccttctcttcttgtctatgaaattgtgtttccaatggcaaagctttctcaatatcattaccctctggaggttatgccatgtcctaaagtaaagagtctgtactttgaagtcagcatggctttggatgactttcttaatagatctgaacttctaatttctcatcaataaatgattatctttctctgtggttttaacagtgattatacaggctgttatatataaagtactttgcataaagaatggcacattgtagaaggtcattaggtatttttcactgtaatacaggtaatacttttgatgttttaaaatgtgtttactcattcactaaatctattgagtgcttactatgtccaaacaaaattctgggtaccagggtgagagtagtttaaaaaataaaagacaaaagtttttgctctcctggagctaatattccagttttttcttgacatcattttgaattttcctttctatccatttgtgattgctctctctgaacttttttcatcttttaagatattttgcactaaacaggtttgagaattatagcgcatgtaatttattccattttcccaataaatgtcagcatttacgattttgatacattctattttttgctaaaaaggtatttagctcaacagagtaaagttagtatggatacaggaattacttgccatataaggtataatggcaacataaaaatatttatgcacgtggcctatgtgaaattttgtctaagagagttgaaattagtatagattcttaaagcagtggagaaaaacagatttctatttattttctccacaacttgtgggtaatttcttttcaagtatcaacctcaaacaaatgttgtatgtcatagctttttgcctgttggatctttttataatttgagtttatgcttattttctcattcatagttaggatacagaaatatttttataatatgcctaaataaaaagatttgcctctaaattttttttctaatgaaaaataagcaagacttacaaaaattcttcctcttaccaggctctttgagggcaacagttgcttcttatctcatttattttgccttacgcattgccctttctcacttgaattgcttgcatggaactattcattgtcttcacttccctgacatatactcagaaggcatcttcatctgggaccattttgaattgatcctgcatgcttacctcttactcagagcatattttttccttggtctatcgtatcaacacatgttctaacagatgaggtcatgaggtttaccctatgctacatgaccttctcagcttaatagttctctaatagtcaacactgaaattgcctgtaaactgggttgtcacaaagaggtattttatgcagcaataaaaatttggtaatacatcatttacttagtttggggcattcttggaattaaaatctttattttttattttcttactcccagctatattttctaccctaaacacaatgaatctggcacacctttgcataacagtggttcataggagtcacatttctctaggttttgtaatagattctaaagggaaatagatgaaaaaacatgccagtgaatttaatatactcacaggctcatgtattctcttactatttactgtgttcttgtactttgaattagcaaatctcaaaatttctatatctgatatggcaagctcattcagtgaaccaatttttgatcagtttgtgcctggaataaagctagacaagagacataacaaagtttataagacatttagagaccactgaaaaaaatatatatttatttttctttgccttactttctattctagtttgctttcatcattacatgttgagcccaggacaagaaaaccatggtaaaagatctttttcttcttcgagtcgattaaaaaaatccctttttacttttaaaaattagatctaatacgttatatttgcatgttaataggctatcataagtttccctaggaaatctgcagatttctcatgaaacttagaaaaaggctaaatattctgtactaatcattttttcttgttctatttgttaatctattcatgtatttacatttaatggatacataagagttgtacatatttatatagtatatttatatactatatatatatatatttatatagtacaactcttatgtatccataaaaagtaaatgtgatattttgatacatgcataccacacgtaaaaatcaattcaccatatttaggttgtccatcaccacaaagatttattatttatttgttttgggaacatttcaaatattctcttttagctatattgacatatacaatgaattagtaactagtcaccttagagtgtgctattgaactctagaacttatttcttctacctaactgtatgtttggtcccattaaccaaataaactccacacagttccatgattactctccagagttattttctccagttagcaatataagtacatgcagttgagaaagggtattttcaaggtggtattacattctacccttattgaaatttgaaacttcctaacatctgtattcttagtgtctcatggaatctgagctacaaattgtgaaatgtgttctggctttgcacacatatatgacatctcactgttttccacctgttgtagtgcaccaatattgtaaaggtttgctgggaaagccctgcgtttctttttccccggtattaccctttgtgtttatctctaccaaccacctggcactctcctgctttcacaaaagagcagggtgggttcatcctcaaaatgagcctccctattacccagaagacaaatgaaatagtgtcctctcacagatggtctgtgatgtataccttagctgaatatctaatcatgacaagtaatcagggattaactgcaagtttctagaatgaatttaaattgtgacacaaacttatgctttaaaagcgaaaaagaataaaaagattatttcaagaaaacaaaaacattggcaactatactttatataaaatatgtgtttcacaattgtatttcattttattgccacatgtataaacagttcaaatgtatgaatgcaattatgaaatatttctttcattataaaaccattgtttttatgattgcactttaaaaaaggctagctaaaatgcttaagcatttcataaatgttcaatttaaaataaacattttaatcctttagaatgatgaagttacaatgcttaagaatttcataagtgtttactctaaaaggaatgttttaaccatgtaagatggtttaacaaaaaatattttggggttttgaagtattttttcaaacaagacaaacataaagttatagctaaaatctcaatagtatggtgtttgatttgagagattgaaggtatttgtttcatttggttttactgaatgattcatcagctatgccataaaagttacaaatatcaactcttatgttcataagaacactttattttcttcattgtcactagttattatttgagatattgcaatctactttttcttcaaaagactgtgttttcctaaacatattcaacccagcctagaccaaattcttgcatttttttaagtacgacatgttctgctaatatctccagcaaattttttcttgaagtatttatatgtaaatacttttataacatgaatttcaccctaattagcatttcttataagacaagaaaaataagctatgacaattttaatctgtaatattcttgctatatggttatgattaatatgctctgacattatgctatagctcatacataggtaaaatgtgattcaaggttaaattagttggagagtatatctgagttctcactttatggtaaggagaatggtcctctaaccatgtccagtgcctgctgtcagtggtatggactctatgtttagactaatgttaggagatacatatacatatatatatgttgttatcacttgttgtcattctatttccttaacttttactaatatctattccccagaatactccaattacttatgaataatatttcagttatgtattaaaagctcctctgcaaagcttgcactttgattatagacacaggttggtttgactgaccagcatgcttccttcattagtttgataaaataatgatagttttcctttggagaattaccccttaactgttttgttttgttttgttttgttttgttttgttttgttttgttttgtttttgagacagagtctcgctatgttgcccaggctggagtgcagtggcatgatctcggctcactgcaacctccacctcccaggttcaagcgattttcctgtctcagcctcccgagtagcttggattacaaatgtgtatcaccacgccaggctaatttttgtattttgggtagagacagggtttcccccatgttggccaggcgggtctcaaactcctgacctcaagtgatccacctgtcttggcccccgcaagttctggaattacaggcatgaaccactgcgcccagctacttacctgttcttaatccattggtttcaaaacctgatagcctagcttcagagttgagcatattacctaggtcattcggtttcttggcaactgtgactaattagtaggtcataaacatgacccaaactacacaaaattagtatcagttttaaaatttggactggaagtgcctgaaataaattatttttgggggggcaagattcaggcagaaaggcaaggagtgtagaattttagagcttgttgtgatcatatttaccaacattattaagaaacccagcctgaaaagtaagccatcgtagaggaagccagacaaagaggcaggcaagtccctaataatgctgtttgaggctcagaatctagttggtctttctttgaactaccagtgacttaaactaccagttatattgattcgagccaatatagttgaactatattgtattgtatagtattgtacagtatttcatgaattagtttggcattgaatttctgcacagaagagtagcatgtttattattctatcttaacatgcataaatttgaactcagatacttcagtttacccatactcctcagccatttccattatgtctgggaaagataactgttaacaaagagataatatatacatgaaaatgatgctcatcaatttacctaactttgcattttttctgccagctaaaatcaacatttaattctaaacatctcaaattgtttgtgatgttcacagtcctgataaataaacacaaaggatggatcattgaactcagtaacttcaaaaacagaaaatgatcaagagtgccaacatcatcaaacactgctgttaaaaacacagtctggggcagcagttcgtgaattgcatggatacttccacatttgcactcagatttgagttaatttgaataagatatttagtatccacttctgttgttctcattatccaaagtgttaacacattagatgaggcacagggtggtgtgtgtgggaggagatgttcctcacatcagtgaggcaattgataaaaaaaatatatatgttgtgttatccagatgttcatcccatctgttttaaaacagttattcaaagagctaatggtgaatagaacttcaaagaactagtgaggtaaattaaaaaggaaatgtggtcagttatctgctttggtaatttgtaaagtatattctgggaaaacagttggaggtattgttcccttgatacattgcatattagtttttaccactttatgattaaggttgtcaacattttataagcaagtactcattaaaattcctgaaagtctgtatagaaaaacttcaatgaatggttttgagcattttcttagtaaatgtaagttatgccctatgagccaagtatctgtttatatcgctatctgctgagatcagtatgaactgactactcttactcgccctatacatgggataaggtcatgaaataaagggtgcaggaaacaggagaaggcactaattcactcctgtaacccaagactgtttttgctcagggcatagtagtgaaagaatcattctgggttgcagctgtacagaggcacccattacctcaaaaagttcagcccccaaacgtcagtgtaggataggtgataaaacctaagtgtgaatctattccctaaagaaaacgtaaagatttctcaaaaagttagggaagattttatgtcctgatagtgtgcattattgattgaaaatgtctgtacatcttagaaaggattttgtcaatttacttattcataacaattttaaaaatacgctgccgaaagacaaataatgccccaattctgctcccaggcatggccttgatattttctaaattaagatgaatgaatcatatatgcctaaggaactgaactgcatacatgcaggttgtttctatatcaagagagagaagacagaaatatcaaaaggaagtattgaaatggaaatttatttaggatttatatatattagtacagaactttattaatatatcctttttaggaaacattcatatttaaatctattaaattgttcatttttattttgaaaattgttttttgctttattcctgagggttcacagcaaatttaggaaatgctcacattttgcaacctgaacaaaggaaaatttaggtgtttgcccggtagtgttcaagtggaattgaacacttctaaaaataattttctttaaatatcatgtcacattctttattataaagaaaatgatgatagtacttttcaatttcctactagaaatctaattgataattttaagtgattttatttcacctgtatataaggatgctgagaagtagtaagatggagggggagggaaggcagagacaggaagtgaagtataagaagaatgacaggcactgaaagacatgcccaaggtcacatgccatagagataagaggcgagtcagtaggagaccaggaaatgagaggacagaagaagccagacctataggaggcaaagataaaagaaaatacaggcataagtcagaaaaattggaaagatgaaatcataaagagaagtcctataacccggaaagtctttgctgatgataagccttaaagaatatagtctaatatttgtcatcataaacacataacacatgttaattcattgaaaagagatagttccaaacacaacccaaaagttcaattggttaggtttttatttgggtttcctttgtaagggtatcatccaagcttttctacaactagaattaattcaagtactctcattgatctggtttcattgcctttatttaaaggaaaaaagtagccacaaatgaagtgtaaaataaaactttacattaatatgaagagatactcaaaattatatacatattgtgtatatagaggctgctcgatttatgatggagttgtggcctgataaacacatcatacatttacaacactgtaagtcaaaaatgccattttgtaaacatgatgggatgtgaaaagacaatatccaaaaagcgtcagcaacacaatacactgtagagtatcacttatttacactcatgatcttgtggctggctggggtctgcagcctagcatcatgagagagtattttaccatacattaatagcctggaaaatatcacaattcaaaatttgatgaaacatttctactgaattagtatggctttcacatcacaatcaaataaaaaattataagtcgaaccatttaaagttggaaaccatctgtatttacatactaaaacattttaatttgaggaactattaaagttaacaaactacatggtatctaatttgcatgttaaaatattttaggtaaatttataccaaaagcatattcatgtttttctttttcgtgtatattcttattaatattctacttagccagtatttgtcagtggtcctttgattacaagggaaagaaaagcagctcaaataatataaagcaatgaagggtcttacagtgagtttttcaggcatggctgtattcagagacccaataagacctcctgaggaatctgtttcttttgatgccttttgcttgcatcccatgatgtttggctttaactctcagtcaatatttgtccatgcagctatatattaaggctgctgacaactcaacctaaattcataattgcaattactaaggaaaggagcccttctctctctctctgtctctctctcggcataaataaaactttaaggaataatctaattggtcttatttaggtctcttacttgtcattgttggtgggcatagcactgtgactaccataaagaaggcaaatgaagtagttttctaaaggaaagccaatttttaagaaggtagaattggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcgagatcgcgccactgcgctccagcctgggcgacagagcgaaactccgtctcaaaaaaaaaaaaaaaaaaaaaaaaggtagaattctgagcaagccaaaaacaggtgatatagacagaaatttctcatttcttagcagtttggcatacacatgtatgtttctaataaggacagttacaaattgtccccagctaatagaacacaactatcttaactacaactgaatataccccggctggaagcagaacattcataaagcaaatttttatatttctcctttatatctcatgctatcaaaagacatttactatcatgttttttgagacatatggtaatccaattgggagcttgcttcataaagccaagcatcctctgtcttcaaatacaataataggaagtccaaatactaatcacgttaagacacagctccctcctacttaggaatttcatttttattgacataaattgcactgtggatgtatcaaagtgtaactcaaagacagttaaagtgccgagaatttatttgcatatatgtagaaaaattgtgaagtctgttgtcctgttctaaggcaaggcaaagccagaatttataaaggaagtatccatagtttctctctctctctctctctctctttcacatacatacagacagacagacagaaagacacatacacatacacacgctcacataaatgactggtttgtttagcatatcctagtttgtcaggtgggttgcagtggagttctgtacaaagccattacagtttcaccaagcctactaaatgtatttttccaagatctgtgtgagcccattctactcattagggtacagatttttaatagaaactatgtctatgcatggcttattctatattgatggaagaaaagtctaatttgagcagagagccaaacaaacatggagtcctgcactgtagtcaagatatttctccgtatttacatattgaaaaaaatgactgatgggctcttattacgtaatggacactatataaaggatagggacacgtcagtaataagatagcttttctttttgcactcatggtatttactattttttgtttttattttttacttttttatttttttgagacagagtctgtctctgtcacccaggctggagtgcaatggcgtgatctcggctcactgcaaactctgcctcccgggctcaaactattctcctgcctcagcctcctgagtagctgggattacaggcacctgccaccatgcccagctaattttgtgtgtgtgtgtgtgtgtgtgtgtgtgtgtgtgtgtgtgtttttagtagagacgggggtttcaccatattggtcaggctggtcttgaactcctgacctcaggtgatccacccgctgccaaagtgctgggattacaggtatgagctaccgcgccttgtctcatggtgtttacacgatagagagagagaaagtaacatccagttagcatccattgtgctctacgcactgtaataagaactttgtatgcacttattattataaatattatccttaataacccaatgaaaaaagtgctgcattattctgatgagccaacagatatttttagttcatttttattaatcttatacagtagattatgtaactaatttaactgatttaaaatgaaaaatacacagttagatctttatgtatgagcatgattagattaattcataattcatatatatgtttactattgtgtcataaagatctctagtatctttattttatcataagaagatgtatctttctcttccctgtttattccattcaaattctcttcctaaaacgtgtctaggattataaataaatttattctccaattaatataatttgcagtaaggtgtgactaagaaatataattctagagctgcacccttaagcattttaagaataagacatattagcttaagtaaatgtttgcagtattttagttggaataaacttgatttggctcagtctctagaaaaattaatacaatactaagctatatttttaagaacaaattatattaattatttcccgtactatactgggttcctcctaagaaaattaaaccaatattagcattgcctgcaagctgctttctgcataaagggaaacctggctgggtgcagtggctgaaggctgtaatcccagcattttgggaggccgaggcaggtgcatcacctgaagtcaggagttcgagaccagcctggccaacatggcaaaaccctgtctctactgaaaatacaaaataagccaggtgtgatggcaagggactgggaggctgaggcaggagaatcgcttgaacctaagagacagaggttgcagtgagccaagatcgtgccattgcacttcagcctgggtgacagagtgagtctgtctcccaaaaaaaaaaaaaaaaaaaaaaaagaaagaaaaactctaagtgtgaaaaacatggcaaataaattatcttaatctactatctacttagaatatttagaagataatagcttgaatctggaaagaacacatatgcgacttgtgtcattttttctggcatgtttataatcaattgttttgtgagcagcagcacattataattggttatgtccataaacgttttgttttttaaataatgcattctgaaaaaagctgaaataatcatatgggatatagtctttgaattggaatctaaggtaatctaatcttctaaatataactaaaatttgaaaaaataatgataataattaaatgatgtactttatatcagtgtcaatacttattcaaaatttctttgtagtgaaaatttatttctgtattaccaatcaaaaattgatacaaaaattttccttaatttaataattagatgtgtgtcggcatattaatggtgtattttcttaatctaccaaggcttaataaggacttaattttgattttatattttaaattatatttgatatgtagtgatattagatattttttatgtagctttcaatcatggaacgagtctatctttatttgccaaagagaattgaccaggaatagcaccaattcatccttggctcaatgttcgttgattgcagtatctgaatccacaagaatttcactcaaactagagttttatagtgttagcaatgttataatctaaaggaactaatctaaaggaaatttgaaagccaaattatccaaaccactatgaaattactaaacctgtcacttttcttggcagtaaagatttggggagccgggcgcggtggctcacgcctgtaatcccagcactttgggaggatgagacgggtggatcacgaggtcaggagatcgagaccatcctggctaacacggtgaaaccctgtctctactaaaaataaaaaataataataataaaaaaaaaaaatcagccggccgtggtggcggcgccactgcactccagcctgggcaacagagcgagattcagtctcaaaaaaaaaaaaaaaaacacaaacaaacaaaaaaacaacaacaaaaaaaaaacaatagaaaaaggatttgggtaatactcttcagattacattccagatttagggaagtgagccagtacaccctggtgccgaggtcacctttctgtgctcaggaaggtgctaccaggggaaaccatttaacctcttcttgctctagtgtatatagagcaatatagaagtgctttaggattttcagaccattttcacatatattgtggcattttatacttacaacaatatagtgggaagaaaagtcaaatgtttttacactgtggttaaaaaatggaagatagagatgaaatgacttggtaagatcaaataagttgatggggtgagaatgtaatttaagtttttttttttgtttgtttgtttgtttttaattcatgcctctgccggacctggtggctcacgcctgtaatcccagccctttagaggccgaggtggacagatagcttgaggtcaggagttcgagaccagcctgggcagcatggtgaaaccccgtctctgctaaaaatacaaaaagttagctgggcatggtgtatgcgcctgtaattccagctgctcaggaggctgaggcaccagaatcacttgaacctgggaggcagaggtttcggtgagcagagatcaggccactgccccccagcctgggtgacagagaccctgtctcgaaaataaaaaaaaaaatcacgtctctattttcttattccatagcacccaacatcctctggtgctagatgtatctttataatatataccatggatgtgcaaacattgatggaatatttatatgtgggtaactccttacttatttgtatctttagtatgtgataaataggcagtcagtatatggtgctgaattcaaaactactcattggcatagaattatattgtcaatatatatttagatcatggagttttaaagattcttcttttgtgtctgttggtaattattttcgaacctcatttgtgactttatttctataagactgtctgaattttaccctgttttagatggccacactatgcgttactcttcctgtggctccatgtatgccattgataacaaggggggaaaggtggaagagtttgagtgcaaatccttcctgacggctgataaaccagcaggaaataagtgaggtcctgtcagttggctttatatactttcattgctttcaaatcctaaagatacactcggcatcattttttttagaaacatgagggacatcaaagaatgtaatagagtcactgagttgaatatattcatgcagggatttatacacttcataaaagctgtaaagaagttttttctgacatataggaaaattgttttattgtttttttttgtttgtttgtttgtttgttttttgttttttgttttttgtttttttttttttttgagacggagtctcgttctgtcacccaggctggagtgcagtggcgtgatctcagctcactgcaagctctgcctcccgggttcacgccattctcctgcctcagcctccagagtagctgggactacaggcgcccgccaccacgcccggctaattttttgtaatttttagtagagacggggtttcaccatgttagccaggatggtctccatctcctgacttcatgatctgtccgcctcggcctcccaaagtgctgggattacaggcgtgagccaccgcgcccggcctgttttattcttcatggtgttgaaaatggtgttagccttagacaaattctgcaacaatgtttagtgcttatacatattcctgataatacagatgtagctttcagaacaaattgaaagtactataaatatcctttaatatccatttatctggaataaaatatattgaataacattttcacaataaaacaagtcttttcctaatattttattaattataatagattgagaaacatgacggtaagatttatttgtagtaggtaatgttttcttaatagcattaaatggcagtataatgtgataccctttttataatattgggaaagccttttagtcaaaaagttttataacatcacttttgtaaatttgttgctaatctgatgggacttgataaagatactgtctaattctcttttcttcttatgtattacagagaattagtatctttcatcctttagattggacaaagaaacataaacatttggaaaaaaatctgttttcttgatgtaacacagaaagctctagaaatggattcaaagaagtgatttttgagtctgaactttgaaattttctagatagtaaattggctagacatttaattctatttgtccaatttttctctaacatagatgattgaactagacggttttaagggttttttctgggtgcaatatattgtgttgcaaatttctgagctctttgtgctagattactcttgagtatttgaaaatatcaagatattattgccagttatgtatttagcaggtgccatctgtttgtgcatattttataagcaaatttaaaagcacacctgtttgagcaacagcaagataaactggaacaatcattgacttagaattacacaaacctaattatgagtcctggccctcctaccaagtggtgaaatacgtcagtcaaaattttaaccatcttgagtctcagttttaattcttcaacatagtagagataaatcttatctggcaaagttgggaagaataaataagttctaaaaatattagaatccttctaaatgatactttgaaaactatgcagcacaaatataaaatattgtaatatagtattaatactaacagttttataaagtacttaatttactactttatagagaccatatgctcgctaaatgttataaactcttctggtatttcttttaaatgtgcttttaacacgtatctgtttattagaaagccataaattgtttattactgttgccagtgcatgtaaagctggtacttcttggcaactacaaactagatataaccactattaataaagttcatatactaagcttttattgctgcttaattatatttgtgtttggaagaacattttgaattttatatattggtaaatttgctgcttgcaattgttaagcaatcttttgtttgtaaactgacaaaaatttaaaaataatttactgtgaaacaaatataaacttgtaacattattttagaaaacaatttttctttggtatttgcattttattttgaatacaatgtatatgcaatttgcattaagcataaagataaattcattatttaaataaacttagttgataattcataataaaatgtttgaattgcctccaacttattgtcttcaaagaaaataaagtgaaacatttttaactaactttcaacttgaaaatagattgtatagtacagtgaagttaaattctttatgatttgattcatcacagtagtaatcgattctttacaatttcactaccaaaactttgccctaacttacctgtattcaccaaaaaggtgtttcctttggttagttgactagagtttttaaagaggaatgactatagctgtgggagttaattatttactgtttaactctttttcttttatcctgtggataaactaacaattttaattatttactgtttaactctttttcttttatcctgtggataaacaatgtcacataaacaatataagccatctctacggttttataaatgtaaaataaattgtttgagaataataaattgatttctccaactgcatttttaacttgctgttaaataaaggaaactggaagaaagagaggagagaaagagagaaagagagacagagcaagggcgcttcatgtacctaggtagtaggaaacttgacaatgaagtaataatattatttattgctaatgagagtagtaagacccctccttgtctacacataaatttcttttaaagtatgagaaaactgagatcagggaagttaaaaaaaagttttaattcataaatataggtagtggcaaaaatagaattctaatctacatctgatactccagagtctatgctcttaactttacagagcaggctgagtagtcaacaattgctcaagaaaacaaaagcaaaaccaagcaagcaagcaagcacgtagggttttaaacttcaaactctgctaccacatatttaactttgtcaattgcatttgcctttgtatcactgttaaaggtaaaatcaaatccaataataagccaaagtactcagctggaaaatgtaactggagtatttcttttttcaattccatattgaggagaaaactatattactctgcctaattttagttcatatctaaaaagtatgtatggaacaaatttgaagagattctaaaaaagtatagccattcgaatgagtaaatggaactctgggtttcacaaaaggaactgggatgctgtaatattacagaatttcagatataaattatcttcttgtggcttctactaaaccaaagaattgctagaattttggattctttgaatatgctccctagtgttaatggggtaaacttttatcatcattcaggatccaggaaacagtttatttaatactaactactttgtaatatatatttcttcttagttctaaaaatctttgtttttacaaatcgtcatcatgtttaaatatatgttcacattgcagtgaaagcattacattttttaatggcttaaataaattgttatttgattagttactgacgctgatttggtgatggtggaaacactttggcctgggaattataaggctaagttttactccacacctaactaggtctttcttcctacagcactatcaggtttattatgttaactctgtgatcttagtcaaggtactttttcaggcatttactgagcccactcacctttataaaataatggatacagaatatagttcccttaaggtacagtcattcacaaagaaacataaaatagctagctcagcaaagaaagagagttagaaagcataatatacaaacaaatccactgccagggcaagggagcaacgcgtcttatctgtctcatctggaataatgatacattctcaagtacagcatttaaaagaaaaatcctccacttaaatgagtgcttttccaccctgttctcaaaaattacaaatgcagaagattataatatgagcctgtttatattagagatttctggtacagtgttgacaaactaaggccttaccaggtcctggttaggattttatgaatggtgtcagagtgcaccggaaacccttttttcgcacactttacaatcaaagaaatcaatcctgtaaagggatggtgctttatctttattagattttgatttttaaaatatagtgtttgccttcaaaataaagatcgaatataccgtggggacacatggggtatggacagttatctctctgagctttttcaaaaaaatcattttaacagattcttgttaaatactctttactacatcctatgcaaggtcctggagagacaaatgtgaattaaaaaagagcacggaccttggtctcattaaatattcaggaggggataaggggtgatgaccagacaataattaagtaataaaatctaaactaacaattttatcccgtgtataaaagagggatgtgtggttatgggaggtgtttcaacattaattatcataaaattaatgtgcatcatattttctcaaaagtaacatgaagtttattttctcaaagcatcctattaatctaaagcagatcgtcttgagtgaagggctctagacaactccatatctcaaataagaatgtaaccattgagtggtcgggcgcggtggctcacgccttgtaattccagcactttgggaggcgggggcgggtggatcacgaggtcaggagatcgagaccaacctggctaacacagtaaaaccccgtgtctactaaaaatacaaaaaattagccgggcgtggtggcgggcgcctgtagtcccagctactctggaggctgaggcaggagaatggcgtgaaccctggaggcggagcttgcagtgagcggagatcacgccactgcactccagcttgggctacagagcgagactccgtctcaaaaaaaaaaaaaaaaatgtaaccattgagtgattttatttttaaaaataatattggctccttgacagaaaatggttattcatggagtcttagattcaagaaatttaaattcctctttctcttagtggttgcatttgaaagttacatcgaccagaatattaccatacatcattttcttttcactgaaaatgagttcctcccattggatcttgagttgtttgaagacttttctggaaatgcaggttaatgctggtacaatttgattaactaaaattttcctctattataaaactgtagttatgctttattatgtggaacattttcctctttgtaggtgtaagagtccttaggaacaaacgtgtcaatagagacatttaaggaattctaactgaaaacatcactggttgattaattagttcacctatttattgtataagtctttgggtgcctaaaatgcagctgacatgtcacaaaacattttgtaggaaagcatagagaaagggttaacataacagacctgagactgctgtgattagaatgatctttttgcaaagttgaccagtggctggtgtctgggaacttggatttctgaaagggatctcgtcattccctaactgataagcatggtgtgtagtacctaaacagtttgtaaaaacaatgatggtttttctaaacaattgctttatttctgaaagtctggaaatgtggtatgtgctaagcagttagcattaagtctctaatgaacttatctagaggacattccacaactggtgttacaactcattgctatgaatcacagatgtttcttgacctacagtggtgttacaccttataaaaccattgtaagttgaaaatattgtaagtcacaaatgcctataatactctgataaacccaatgtaaagtcaaaaaattgtaagttggggaccatctgtactctcatctgtgcgactcgaatgggagaggtttcttggaaacttgtacgtggtgtccgctggactttgccccataagccttttccctttgctgattttgctgtgtagcctttcgctgtaataaaccatagttgtgaatatgtatatcatcaaactttagagtggtcctggggaaccctgacacaagaaggataaaaatatatatactggttgtgaccactaagattataattatatttgcacatgagtcatagaaacctttcattaatttttaatttttgtggatacataataggtgaatatatttatggggtacataagatattttgatacagacataaaatgcatgataatcacatcagggtaaatggggtaatcaccacctcaagcacttatcctttctttctgttacaaacaatccacttatactcttttggttattttaaaatgtgaacaaattattgcagactgtagtcactctttcttgctatgaatactagatcttatccattcatctaactgtatgtttgtacccattaaccatcgccactacctgctctcctcccctctttctttttgagcagtatatcttaacagacaattattttgcccccaaaaggacatttgacagtgcttagaaacatttttggctgtcacaactgggagggcgcaaatcatccagcaggtggagaaaggccaggatgctgttaaacatcctaaaattcataggacacccccacaacaaggtgtcatctggcccaaaatgcgaatagtgctgtgcttgagaaaccctattgtacataagagtgcaagataacattcaatcacctaacaaattaataggtggaaaataagaattatttatgaatgaaggatttagtaaatttttaagtatttatctcacagttcaggaaggagattttgactactattccaataagttttcctattatctaaaattgttccttgttagactgccatatcttcaagaaaatatctaataaaagtatattcttttctaaaattcttggctcacttaatgctataattagtgattaaaattcccagacatttggaaactgttaaagaaatgtactggcttatatttgaaagcactctggccttcgctgcagattaattttatattatacacttatatattatccagtttctgaatcagtgagttttaccctcccccattctttaacataataaatccagtattaactgattaaaaactgtttctaaacctggctagaccaaggaaatcccatgagccaacagcattatgtggaatccagccagaaaccccttaccagtctaactgatttcaagttcactgtcagatttgctatgttggaaaactaaaacacactcattcagcatacatcaatagcaacatgcctacttaaagagagaatttaccattatcagagagatcgtataactgttggttcttcttgtctattttttgtaatacttctgattagatcactttcactttcatgtttttttttctgtgtgtatataaaaggatttggttctcatttaatcttttctttgaatagtttttcctatagttaaagtcaatcagcaatctaaatttcatctgagctccaatcacacgtaatttataaaattttggaagaacacaggtaggtactcagagtaatcaacttagctttggaagaagaatttaattttttattatctgccacaaccataacccggtgaattgatttaaatcattgagctataattgctttttgaagattttttatttttccccttcttgtgaagtagtaattaacaaaatgtaaaaatctaaattcaaaatataattcatgtcataaaatatatgttacgcatgaaatatagttaatggtcaaataaattctttgttaagactggtggggggcctttgcaatttgtgagaaacattcacacacacacacacacaaaatgtctgtaaacaaagataaaatgtttttgctgaagaatgtaattgtcatttcctgctcccttactgaaggaaatccaggtgtctgtttacgtggattgctgcttaaatcggccacaaaacagttactcaaaacctatttattatattatagcaaataggataattactgccagagaaggagacatactttttgtaacactttacatttttcttaaaatacaaattctgttatataaattttgattttgaatcttttaattatcttttcaccacctcccatacattctataagttttctttgtctttttcaactttggtatacagatttcagcgatactctaattttttactgagtaattaacatatataagaaaaagatacttcacaatttccacatgctgtaatgaaatatgatgagttttgtttatgttaactgtatctagttcttgcttgatttctttttttcctctaaagttatgttttatcttgcaagtttgtatatgtatgtgtactatttatttgtttaacagattattcaaaatcttactggataaagcagcaaacatttattatctcagtttccatgggtcagaaattaaaacaatgcttagttgcatcctctgtttctgaatatctcacaaggctaaaatcaaggtgtcaattgggctatagttatcccaaggttcaaccagtgatgggtccacttttatagtcactcaagtagctgttggtgggactcagttcctccatggttattcctaactggtggttggcaagaggcctacttcactattttaccacatggatgttatccataaagcatctcacaacatagaagcagctttgacagggctaataaataagaaggcaaaaaagaatgtgcaagagaaaagtcaaaggcttttgtcatctagacttggaagtgattaagctcaagtgtgattaatctcaagccaactatcaagctgaaaggacaggatatgaatattaagagaagaggatcactgaaagccattttgaaaactgcctacaaagtatatggatatggatgttttatgaaaataaaattccttgtgttagagtggtttctttttactttctttttttttcttttttctaaatctaatattttataacccaaaacatggggataaagacaaattttagcatgttatccttaatatttaggagcagtatttaggagcacagtgtatgtcatgttaaggatgctactatgcctctatattatgttggaaactatatattcatctctggctctctttttttctttcaagtggtggtaatttgtatagagtaaagtatacttagaagccaaattaaaactgtactttagtgtattcgtataagcttaataaagtattaagaaatactcctgtttgcatcttcatgatctccaaacttttttctccgattatggcatcttttcgtatttgcatgaaccaaatgtggccttctaaataggaaattttggatggaataataatccacaatgaaggagtcatatagttaatgtaaggagaagtgctgacttacgagacctaaatatatttttatattcttcaatactactataccttctccttaatgtacccagaacatatgtctcagatttcaatagtccttgaagtcacactttcctcaaatgcctgaataaaaagatgaatctacaatcttgctttattatatataagaacttaataatttacttgatgttccaagatatccaggaacatttatcttctggaaaatatatcccgattttcacttgccattccatttatcatctggatccagatcagaacctttatctacttttctgctggttactcacttctggctttcttagtgcttgtatggctctcttttaaacactccgcactgtgttgtggacacctatcccttcttttttcaaacggttagataaagaccagtttgtaacttttaccagacttatggtgaatattgtaagacattgatgaatatttctacacaaggtcatttgaaactcagtatgcaatatgactgttcctgaataacttaagtccataaatttccatagtggtttcctactgggcaatgtattctttgtgacgaagacttcttccctcaccccaggctgccaacttaacacaggagctagtgtaccatgacattaggaaagtacccttgggactgtctctcctttctagaatgcaggccttaaagaaaagcttttgaagaaagaacatgtcccgacttcaccctggtataaagtcagtctccacaatccttatagccttactcaggatgtgtcactctacgtcatcagtggaaatctattgtctcttcaggagaaagccagtattctaggacctttctctacatcacttaacatggcaaggtcttcaacattcaacgatctacattagaaaattttctaaggctaccttcttcagtcttgagtagcatcatcattccatttaggtagatacatttaccagtctgtaatataatgaggggtaacaactaggctggcacgtatgttaactgtcttcatgttctgtattcccaatttccccagccatcatcttatgaaaaataatacacttacccatacacactgtaggaataagtgagactaaatatttatgggtattctagattcataatttggaaaagtctcccacatagaccacttctttcatgaccacacagataaatacaataataaggacaaagcgctgacatgttagatgttttctgtaaagagtcaatgacctcataacaaaaattaaatgggatagccttgaaatagtgatggtacatattctgctatatatattcacatagattctgacaaaagttatgaggaaaggaaaagacttatctagcatcccatcacctcaaatttatctcaccatttgtagtaggcagaacattagccactcaaaggtgttaatgtcttatacctcacaattgttgaatatgttatagcccatggtaagtgggaattaaagttgaagattgagttaggattaccactcaagtgacttgagataaggacattaccctggattgttgaggtgggtccaatataatcacaatggtcttttgaagtcgaagagagaagcagaaatagaagtcagaatgatgcaaattgagaaagactcaggtggccattgctggttttaaagatagaagggggccatgagccatgagccaagcaatgtgaccagactcaggaagctagaaaaggcaaataaatggattctgcctcaagcctacagataaaacacagccctgtcaataccttgattttagtccagtgagacctattttttacttctgacttccaaaattataagatacatttgtgttgttttaaaccatcaattttgtagtcattggtaatagcagtaataggaatctaccaccccattcttcattttttttctgccatcagtgattatgcttcactaatatgtaagccttcctttcactttctatatgtccttgaccatgtgacctcatctgtaaatgaaaaattacttatttcatggcattgagaggaatacacaacataatacttggaaagagaaagagtacatttttagttactaaatatgtatgcatggctttatttttatatgtattagttttatatattaatatatagtttttgtatactagtatatagtatgatttagttttaaatattagtatataaaaaagagaatgtataaatatatttctgtttatattttttcttttaatattggtacataataatacatatttatgtggtacatatggtattttgatacatgcatacaatgtgtaatgatcaaattaaggtaattggggtagctatcatcttacacatttatcatttctttgtgttgagaacattccaaatcttctagccatttttaaatgtacaataagttattgttagctatactcctgctgtgttattaaatgctagaaattgtgccttctatctatatatatttttgtatccattaaccaatctttcttcatccatcctctaccctacccttgccagcccctgataaccactgttatagtcattatctccagaagaccaagttttttagctcccgcatattagtgagaacatgggatatttgtttttctgtatttggcttagctcaattaacataatgacctccagttctatccatgttgctgcaaatgacagagtagcattctttttaatgtattaatacgccactttgtatatatactacattttcttaatctgttcatttgctgatggacgtagattaatgtcatgtcttggctgttgtgaatagtagtacaattaacacgagactgcagattttttgtggatattctgatttcctttttttggacatacaccaaggaatggaattgctggatcatatgctaattctattttcagttttcagtagaaccttcatactgttctccatagtggctgtaccaatttacattcccaccaagaatgtaggagggtcacatttttctacattctcatcagctttggttatttgttgtctttttaattatagctactttaactggggtgagatgatatttcattgtggtttatatttacgttccccatggctagtgattttgaacattattttcacatacctactggtgtatcttctcttaaaaatatctattaagatcttttgcccattttaaaatttgattatttgttttttaccattgtcttatttgagttccttatgtattctgattattaacccttttgtcagatggatagtttacaaatattttctcccattctgtggactgtctcctcactttgttgattgctttctttgctgtgtagaagtatttttagctcagtgtaatcccatttctctatttctgcttttctttcctgtgcttttgaggacttgcccaaaaaatctttgtctagaccaaagtcctgaagtgtttccccaatgttttcttctagttattttatagtttaggttttacgtttaagtatgcaatccatttttatttgatttttgtatgtagtaagaggtaagagtctattttcattgttctgcatgtggctatctagtttacccagcaccattcattgaaaagtatttgtttatcagcatatgtccttggcaccatttttgaaatgagttggctgaaaatgcatggatttatttctgggttctctattctgttacattggcttatgtgtatatttctatgacggcatcatgctgttttttagatactatagctttgttcttttagttctggattgctttggctatttgtggtcttttgtggctccatacaaattttagctttttttttttttcgattttgtgaagaatgtcattggtatgttgatagggatagtattgaatctgtagatcactttagctggtatgaacattttaactgtgttaattcttccaatcccaaaacatgaggtatcttaccatgtttttgtctcctttttaatttattttatcaatcttttccagttttccagtaaagatcttgcacttttttggctaaatttattcccgggtttttgtttgtttgtttgtttttggtagctgtgtaaattgaattactttcttgtatttttttcagattgtttactgctggaatatagaaatgttattaattgttgtatgttgattttgtagcaactttactgaattcatggatcagttctaacggtttctagtggaatccttaggtttttttcaatatttatgttctaaatataagatcatatcatctgcaaaaaaggacaatttgacttcttcctttacaatgttctttattcacttttattgcttcattcctctgtctagaacttccaatgctgtgttgaataagagtggtgaaagttagcctatttgccttgttacagaccttagaggaaaggctttcaatgttttcccattcagtattatgttagctgtgggtttgttagatgtggcccttactattttgaggtatacttcttttatacttagtttgttaggtgtttttaatcaagataataaccaaaggaaatttttttttaaagaaggaaagttggattttatggaatgccttttcagcatctattgaaatgatcatatgttatgatgtatcatgtttattgattagcatatgtttaactatacttgcgtctctgggatgaattcacttaatcatggtgaaatatctttttattgtgttgttgaattcagtttgctagtgttttttgaggatttttgcatctgtgtttataagagatattggattatagttattattattattgcatgtttgtctggttttggtatggtaattctggcctcatagaatgagttttgaagtattccctccacttcaattttttgaaatagtttgagtagaacttttattagttgttttttacatgtttgtaaagtaaattcatgttttacctactttaaaataaataaaaccttttaaccaccctgacgaccataaaaatactaaattaaaacacattttagccacattgttaccttacagaaattatgctagatgtgtcttttggaaactatttatttccatatctctgtttacacacttgccccattataatctattctcaatatagcagccaatttgatcctgatccttttataaacctaaatcaagctatacatttatctgctcaaaatcctcaatgactcattctgagtaaaacccaaatttctcaaaatgtcctagggtgctacatgatctgtccttcttaactctttggcatcatcctcataacagtctctaacttctatcatgtggctcaagtcaaagagttcgttattctccagaacatgtgaagttcaccccctgctcagacaatggcctagagtgctcctcccccattatccatttggctggatctttcagctcagcttttcagtgactcctaccctggccacccgagtaaacatgcaatgcagttctctggcctccccacttctaacatattgcatagatatttattttgctttgtgactctccacattaggatttaaactcgaatagggcagtattcatatctgctttttcattactgtattcttaggaactggagaggtgcctaactcacaatttgtactcaatcatacctaataaattaatatttaattatttatttgccatagattcagaacttcaaacacatcagtttcaaagtttgactaaaatcttaaatgtcatcaaatttatgcttttgacttcacagatgaaaaaaagtgaggcccagagaggtcacacagctgttttcactaaaattagaataagaaaatggccctgacttttcagcaaagtatttgtataattttgtacttacactagtagttaacactcttttcaatttcatacatttggaatttactaactcattaccttttctgtaagcaggattgctcacctatattgtgagcattcactcttacctttccattatacattcttagaaatcttatttatttagcaagtattttaataattgatgtatacaccattttgtagtatagtgggtgattcaaagatgaacttcagctttatggttacagctttaccacaaatgcatgctcaatcagacacctcttatgtgccacttcaggttctttcagtgtcacctatatccagggcagatagccactgggtcagcgccagcacctggagcaacgaatatgagtgacctctggccagtttcgcataagaagcacccggcaggtctaacatcaggtcctttctgtgcttctttcatgtcttctgtgagaattcagtgctgccactgaggcatgtaatgctttgggacccttgtagcactcatggatgtgcaatccatttgtacaggaaggtagtgctccctctggtaaaccttaattcagagagaaacagaagctggcctatgattttgtcccccctggaaagagattatttgacctttttgaagacagtccttcaaaatcaagtgattcgttatacctgatgccatcagtgaccagctcagtaatgcattgtcatattgaccctgcttgcttcctgcctcactctccttttccctcacaccctattctctagaatcatagttcctaacaaaaatatgggacatgaattttcgcctaaagttctttctcaaaaatgctgatatactgtctttaagaaccttaaaacctagtagaagaaggtatattcagacctacgtaactactatgaagtaccatctaatatatcttactaaactcatacaaaaactacacacaactgcagaggaaagagttctccttttgccgagatgaagaagagtttttgttagaaacatgaattttattttgtactaaatgatgattgaagtattcttagaaagaagataagtacaacaacatgtgtaatgctggtgatggtcatagcatgaccaagaaagcagcatggggcacatttataaatactgagggctgcgtttgttgggggatggggtgggtgagagagaaagaaatatgttgaaatcatcttccaaaagctatttttttgaaaataattctaatggattattgatcatttgaaacttgtgattgataaaatcaaatggcaaacctgattctgaaaggaaggattgtctactaaaatgggaattacagcatttatcaagagcaaggtggctgttttttagagaaataatgtgatgatactgttgtctatggtcacatgctacagagttagattcagtctccagtttgccaattgccaggattattgcagcttctaagtgctcaagagggataactctaaaatgcagtttgacctaaggaaagaaagtcgagatcttgacattcagaaagtatatttctttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaataatgccgcaataaacatacgtgtgcgtgtgtctttatagtagcatgatttatagtcctttgggtatatacccagtaatgagatggctgggtcaaatggtatttctagttctagatccctgaggaatcgccacactgacttccacaatggttgaactagtttacagtcccaccaacagtgtaaaacacatgaaaaagtgctcatcatcactggccatcagagaaatgcaaatcaaaaccactatgagatatcatctcacaccagttagaatggcaatcattctgactgacacagaaaatacacagaatatttttcaagacactcaaataataaaatagtagaattaaccaaattggtcaaaagcaaaatcctcatggacaaatatacttttgagactatcttttcttgtagatttttctatgcataaaatatatagatttaacatgagaatttctataaagggatagtataataaagtggttaatataccagatgttttttaaaagtcagttgtattatgatttagttttcatataataagttgaaatgtatagtttaatgattttaactgaattttatatagtaaaattcacactttagggtatgaaatattatatttgacaaacatgtagtcttgtaaccaccatcacaataaagatactgaaatagtttcattaccccaaagaaacttccatgctgctgctttgtagcaaaattttctctttcttatagttttgctttttactgaatgtcatgtaaattaaatcatgcatgaccctttgaatctgacttttttcagttaggatatccatttgatactcatccacatggattgtaggtatcaatagttggttcgttctttttttaccactcaatagtactctgttgtatggattaccagagctcatttttctttttattagctgaaaggcatttcgattgcttaccatttttcaccattatgaataagggcaatatagccatttgcatagatttctgagtgatcataagttttaatctgttttgggtaaatacctaggggtggtgatgcaaggtcatttggtagttaaatgatcactttttaaaaactggcagactattttccaaagttgttgtcttatcttgcattttcaccagcaatgcatgagtgtgtcaattgctctacttcctcactggtatttagtgtaacaaggttttgttttctttgtaatcttagcctttaaaaaaatattataatgtggtttcaatttgcatgcccctaatgactgttgttgagcatcttctcatttgcttagttgcagtccatatttcttctttggtaaagtgcctgtactgaactttgcccacatattttccttattatcgtgtcataattgctctttctctgtgttgaatgcatacagtttgtcagataggggattgacaaatacatattttttctaatctttgactagtcttttcactttttaaatatgttttttggcagagcatttttttaagtgtgttaaagtccaattaataatgttttttctcttgatattctttctataaaatggctgcttaaacttatgttccaaattttctttgtttttttttgtaaagttttaacattttacattctatattatatctatatcctttactgttgattttgataaaaaatgtgaagtacaggtgaaggtccatttttgtttttacgtttggaggtctaatttttctggcactatttatttaaaattaagtctttttattattgtctttaaagcaactttgtcagaaaataaacatttgtgtggttctatttatattctatttattttattcctttcatatgtgtatctacccatttgccaataaaatactgtcctgattactataactttaaaaaagtttgaatatcaggtagtgggagatcttgaaataaattctttttcaaaatgttttggatattataattattttccttttctatgtaaacttataatcagttttttggtatctaaaaatatcctgctaagaattcaattggaaatgtatagaatcaatttgggaataatttatctcattaataagtcatcaaatacatgaacacagaatatgtatacccatcacttaggccttctttcatttcttttgtgttttgtatttttctgaatatagatcatgcatatactttgttagaatttaacctaaatatctaattgttttatgatattgtacatggtatggttacagtttttgacttaaagatgttcattgttaacattcagagatgcagttgatttttgtatcctgtgacttactaaattcttttgctattcttgaaagtttattttcttttcatttttgagatttcagatattttctacatagataatcatgttctctttttaatagagagagctttctttccaatctggaggattttattaattttctttgtcttattttactgtctaggttccaaaacaatgttctatagtagtgatgaggaagagatatacttgctttgtcagtctttcgccattataatgttagctgtacgttttcgtagacaaactctatcaggttaaggaagtacttatagtttactgaaagtgtatatcataaacaaatcttgaattttatcaaatgcttttcttctgaatctattgatttttctttttattctgataatattaagaattatgtagactcaatttctgatgttgaaacaggctctcattactggaatctgctccacctgactgtgatgtagtatgttttgtatatattgccatattcaatttgttaataatttgttaagaaattctgcatctatgctcatgagagagattagttcattgttttacttgatcatgtttttgtctgactttagtatcaggacaatgctcccttgtaaaatcaggtgagagttgttacttcctcttctattttttggaagggattgttcagaattgttaaaattccttcttcagcatttagtggaattccccagtgagtccatccagacaaaatttttctttgttggaagaatttttaagtctaaatctaattgcttgactaaatatatgacatgtcttaggttatccattattttcttgagtgagtcttgtgtctttcaaggaaactggtccattttatatttgttggtgaatttgcaaatgtagagttgttacagtatttccttattatatttttgttatttttaagttctatagtgatgtcccgtctttcataaggatattggtagtttggatgttttttcattctctgtgtctgacttgctctgtctctggctctggctctctggaggttaataatttttattaatgtgatatgcccccgatcatttagctagaagtctcctaatatgaatttgaatttaagtttgtctgcttctcattccatgctctctgtattctactgtgctgctttgattacctttattcacagcattgttggtatatttatttttatttttaatttttttttccaatttttgcattgattcataatagatgtacatattttcaggttacatgtgataatgtcatatatgtatataatttgtaaatatcaaatcagtgtaattgagatatccattaaatatttattgtttatgctagaaacattcaaattattcttagtattttgaaatatactatcaatcattgcaaactataatcaccctattgatctatcaaacactagatattatttcttctctcaaactgtatatttgtgcctattattcaaactctcttcaccctcccttcccatctacctttcctggccactggtacccaataatcaaattcctatcttcatgatagtcacttgttcagttcccacatatgagtgagaacatgcaatttgtctttctgtgcctggctaatttcacttataatgacctcctgttccatcatgttgctacaaatgacaggatttcattctcttgtatgacttaacaatattcaactatatatatatgtgtgtgtgtgtgtgtgtgtgtgtgtgtgtatatatatatatatatatctatctcacattttctttattcattgatgggcactttggttgattccataatttgggtatagcaaatagtgctgcaataaacatgggagtgaagatatctcttcaatatactgcctttttgtgaatgtatacctaatagtggaaatgctggatcatatagtagttttatttttaatttttttgagaaactgtcatactttttttcatagtggttgcactaatttgcattcctaccaacggtgtacaaagttctcctttcttcacgtctttgccagcatctgttattccttgtcttcttgataaaatcaatttaagctatggtaagataatagctcattgcacttttgagttgtatttcactgaagactagtgatgttgaacaatttttcattgttcaacatacaactgtgggccatttgtatgtctctttagaaaaatgtcttttcagatcttctacccatttttaatttcatctatttttgccattgagttgcttgagctccttatatattctggttgttaatctcttgccaggtggatagtttgcaaatattttcttccattctctggctgtctctttactttctagattgttttcttttctgtgcagaaggtttttagcctaatgtaatttcatatgtctatattttgctttggttgcctgtgcttttgagatattacacacacaaagaaaactctttacatagaccagtgtcgttaagtattttttcaatattttcttctaatagtttcatagtttcaggtttaaatttaagtctttatttttatttgatttttgtatatggtgagaaataggagtccattttcattcttttacatatggttatccagttttctcagcatcatttattgaagaaaatctcatttccccatttcctgttcttggtgcctttttcaaaaaatagttggctgtgaatgcatggatttatatctgggttctactttgattactttcttatgatttgttctttccaacttttattttaagtttggggtacatgtgcatgttttctacaaggtaaattgcatgccatgggggcttggtgtacagattatttcatcacttgggtaatgagcatagtactcaataggtagctttttgatcctcaactcccaccctctaccctcaggtaggccctgtgtctattgttcctttgtctgtatccatgtgtactcaatgtttagctcccatgtataggtgagaatatatggcatttggttttctgtttctgcattaatttgttgaagataatagcctccagttccatccacgttgctgaaaagtacatgatttcattcttatttaaggctgtgtagtattccatggtatatatgtatgacattttctttatccagtccactattgataatcatttaggttgattccatgtcttcgttactataagtagtgctgcagtgaacatatgcatgcatgtgtcttcatggtagaatgatttatattcctttggatatatacccaggaataagattgctgggttgaatgattgttctattttaagttctttgacaaatctccaaactgatttccacagtggccgaacaaatttgcactcctaccagcggtgtttaagcattcccttttctctgcaaccttgccaggatctttgtttttgactttttaataatagtcattctgagcgttgtaagatactatctcattgtggttttgatatgcatttctcttattattgatgatgagaatgtttttataggttgtttactgcatatatgtcttcttttgagaaatgtctgttcatttcttttgcttattttctaatggggttgtttgttttatggttgttcaattgtttgaattccttataggttctggatattagaccattgttagaagtctagtttacaaatattttatcccattttgtaggttctctatttacactgttgatagtttcttttgctgtgcagaagccatttggtataattaggtcccacttgtcaatttttgtttttattgcaattgcttttgtagtcgtagtcataaaatccttgccagggacaatgtctagtattttctagattttcttcaagaattttcatagttttaagtttttcatttaagtcttaaatccatttttatatgtggtgaaaggaaaggatccagtgtcagtcttctgcatagggctagccagttgctgcagcttcatttattgaatagggagttgtttcccattggttgttttagttgactttgtcccagattagatggttataaatgtgtagctttatttctgtgttctttaacctgttccattgatttatatgtttctttttgtaccagtatcatgctgttctggttattattgccttgtcgtataatttaaagtcaggtagtgtgatgctttcaactttgttgtttttgtttaggattgctttggctattcaggctctttttggtttcatgtaaattttgaatagttttttgtaattatgtgaaaaatgacattggtagtttgaatggaatagcattgaatttgtagtagctttggacagtatgccctttttactataatgattcttgttatccatgagcatggtatgtatttccatttgtttgtttcatttctgatttctttcagcagtgttttataattctaattgtaaatattttcacctccctagttagctgtttttctaggtattttatttatttgcagctattatgaatgcaattgtgctcttgattggctctcaccttggacactattgatgtatagaaatgctacaatttttgtgcattaattttgtatcctgaaactttgctgacgttatcaattctaggagtgtttgggcagggactatggggttttctaggcatagaatcccattgtctacagagatagtttgaatacctctctatttggatgcattttatttcttcctcttgcattatgcctctgtttaggacttccaatatcatgttgaacaggattggtgaaactgggcatccttgtcttgttccagttctcaagaagaattcttccagcatgtgccgattcagtatgatgttctctgtgggtcagtcaatagaaggctattatattttgaggtatattcaaaatgatgtcttctttgttcaggatgtgtaccataaagggacactgaattttatcaaaagtcttttctgtgtctattgagataatcacgtggtttggtttatagttctgtttatacgatggatcgctgaatcattttattgtgttgcaaatgtggaactaaccttgcatcccaggaataaagccttcataattttggttgattaactttttgatatgctgctggattcagtttgctagtattttgttgaggatttttgcatctacattcaccacagtaattagcctgaagttctcttttaccttcatgtttctgccaggttttggtatcagaataatgctggcctcatagagtaagttagggagaagtccctcctcagttttttggaatagtttcagtaggattggtaccagattttgttaagccactttgtagaattcagctgtaaatatatctggtatagggcttattctggttggttggtttgttactgctaattcaattttgtaactcattaatgctgtattcagggttgcaatttctttctggttcaatcttaggaggttgtgtgattccaggaacttatttattccttcaaggttttctagtttatgtgactagaaatctgcaccagattctctgagggtttgttttatttctttgaaatcagtggtaatatcccctttgtcacgtctcattgtatttagttggatcttctgtcatgttttctagtctagctaccagtctattaatcttattgtttcaaagaaccaacatatttttgttggtcttcagtatggtttgatgcatctcagttttgttcagttcaggtctgattttggttatttcttgtcttcttctatctatgggattggtttgctcttgttattctagttcctgtcagtgtggtgttaggttgttagtgtgaaatctgtctttttgatgtgggcagttagtgctagaaactttcctcttaacactgctttagctgtgtcccagagtctggtatgttgtatctttgtttcattagtttcaaataatttcttgttttctgctttaatttcattgtttacccaaaagtgattcaagaacagattgtttcatttctatgtaatggtatagttttgagagatctcccgtgtattgatttctatttttattgtgctgtggtctcaatgtggttgatatgattttgtgtgcatgtgttttttttaatttgttgagaattgcttcatggaaaatcatctggttgattttagtgtaccatgtgcaggtaagaagaatgtatattctgctgttttttgttggagaaatctatagatatctgttaggctcatctagtcaagtgtttgagtatagttctcaaatgtctttcctgagttttcatgtcaacctctctagcaatattggagacatttccatggttaatgttaatacccacaaaaatattttccaagtttcttgcaatctctctctttctttcagagatgcaaattaatttcaggtttggtctcattacataatcccatatttctcagagattttgtttattttgtttactctgttttttttttcttctttttaatccgaatgagttgacctgaagaaccagtcttagagctctgagattttcttcagcttggcctattctgctgtgtagtgcttttgattgtttttcaaaatttttgtagtcagctttttagcttcatcagatcagtttgttccttttataaatgaatattttgtctttcagctcttatgtcattttgctagattccttagattacttggattgcatttatactttgttgtgaatctcgatgatcttcattgaaaaccaagttctgaattccatatctctcattttattatttgacctgtgccctctcatcattctctttctctagcattttcggtcctgtttcataccactttattttatagctattcactgtcaattcaaatacacacacacacacacacacacacacacacacacacacacacacccctgatgggtagaaatgtgctaaagatgaaactgattttgaggtatgactggagaatcaactttattattttacaaatattttaaattcttatctcctttttcaaaatagtttctctataataataattattttcttaggaaactaaatttaaactaatttttttctgtggaatgtgtgtcttcattaagtatatttgagatcatactccaattttctaactgttagtaaaactgtggtcaatatatttttagaaagggttataaaaggcatgtagtattgctgctcactcacaattccacaaaaaggggagggagaatttaaataaagataaaatgtaaagctcttattctatattctgatcttgggcaagtcctttttagagaggcagagctatgccctgaggtttgaatgcatgtacttgtaacagctgcctacattaatttagacaggtacctgcttaaatctttcttcatttacatgctaacctgtgacaatcaagttagtgcatatcagcagtaatttttttttaccagaactgaattccaacttgaaattattcagcagaaaacagtttcccaagaattccagttccaactttttgtgataatatttactgcaaattattactaggctcagccactcacatggatggtattattcccattttatcagttttagcttgaatgtgctcattttgtgctttaaaaaactgtaaaaataaaattttcaagctcctaaatgagttgcttagagtgaaatacaaattgtagactatttctttatgaataatgaggttgcagtgttttattaattacattcctttgtttaatcagagaaatgagtttccaattatatatatatataattatatatataattatatttatataaacataaacaattgtagagatgaggtcttactgtgttgcacagactcgtctcagacttctgagttcaagtgatccttccaccttggtctcccaaattgctgggattactggcatgaggaatcatgcctgatctaagctgctaatttgtaattttgaattaaacttcagttcattactaaatttcgctcattactgtataatttaaatattcattcatttactaagaaaatggacattttcttcaatgattttaaggtttttagtgtctgtgactataatgtaaatatttttacaaattagtaatattaatatatagaaaatttcgcaagaaatggttaaagtattggaatccattattggtgtaatttatttttcagaatggctcatgaacccacagtgttggaatattctacaactcaatgtgatgtcttattctggcatacaaattcataaaatccatttctgtgtttcggactaatgggaacatgcttttaaaatatatgtgtatgtaatatatatgtaaggtatacattagctgtgtttttaaatatatgtatgtatgtgtgcataggtgtgcatgtgtgtatctatttatatatctatatctatatctatatctatatatatatgtactatttggctaatgggtagagtagaagcccaatccccaccactatgcaatataataatgtaacaaatatgtatatgtgccacctgaatctaaaattatatatatgtatatatgtatactaacacacatatataagaaacctatatgtatatagctttcttgtttacctttagtcttgcttttctgttgagtcgtttattccagaaaccattttaaaaggaaatatatattttgttacaatttttatgtactgtaaatatacttttatatattctggtgcaccatacaaaattaacatataacttttcagtgaagatatactactctctacagctaatattaatttctttttttaattttaattttattttagattcgggggtatatatgcatatttgttacataattatattgtatattggttagggactgggcttctactctatccattagccaaatagtgagctttgtaaccaataggtaattttcaaccctcaaactttttctaccctcgctcatttttgagtctctgaggtgtgttatttccatctttgcatctatatgtacctcttgtttagtttccacttatgaatgagaacatggaatattttattttctgagttcacttaggataatgacctctagttccatccaagttgctgtaaaggacataattttattctttttaatggctgcacagtttgtcatgatgtatacaccacattttccttattcagtcaactgctgttggacacttaggttgattccattactttcctattatgagtagtattgtgttgaacatacaaatgcagatgcctttttcctacagtgatttctttacctttgtgtagatactcagggatgagattgctgggttgaacggtagttctacttttacttctttgagaaatctacatactgtttttaatagaagatgaactgattaacattctcaccaacagtgtataaacaattgccgtttcttgacatccacaccaacatctcttgttttttgacttttaatattaaccattctgactgggtgagattatatctcattgtgattttaacttgcatttctctgatgattactgatgtttagcaattttttatgtgtttgttggctgtatgtatttcttcttttaagaaatgtccgtgtttttgcccactcttcagtggaattattttttttcttgttgagttgttcgagtttcttgtagattctggatattagtcttctgtcagaagcatgatttgaaaatattttctcccattgtttaggttatctgtttaatctgttaattatttattttgttgtgcaaaagctgtttagtttaattaagacccatttgtctattttgtttttgttgcatttactttcagggtcatcattataaattatttgctaaggcaaatgtccagaagagatttttctaggttttcttgtaggattttatagtttctggtcttatgtttaagtctttaatccactttgacttgatttttgtacacagtgagagatatggttccagtttcattattctgcacgtggctagccaattttcccagcatcatttattgaatagagcatctttcctccctatttacttttgttaacattttgaagatcgactgattgtaagtgtgtgctttaattctgagttatcttttctgttccattgatctatgtctccatttttgtactagtagcatgctatcttaattactatagacttatagtattatataatttgaaatcacacaatgtgattcctctagattcgtcctttttgcttaggattgctttggctatttgggatctattttgcttccatctaaacattaagattttttttttataattatgtaagaaataacattgctaaattgataggcattgcattgaatctgtagattgatttgtgcagtatgtttactttaatgatgttgattcttccaatccatgagcataggatggttttccatttgtttttgtcatgtataatttctttcatcagtgtttgtcattcttcttgtacagatatttaactattttgcttaattgtatctctaggtattttattttattttttgcagctattttaaatgagattgattcttgatttggttctcagcttgaatgttattggtgtatagaaatgctactgatttttgtacacagattttgtgtcttcaaattttactgaagtcatttatcaagtggagaggtcttctgggggagtcattagggttttctgatacacaattatgccatcatttaacagagataatttgacatttttttttttttttggtcccaattgcaatgccttttctttattttgcctgaagaaagatcaggcaaagatcatagcagaactatataagatcaagaccaaataaacaacacaaaggatcaactaaacaagcaattagttatttgagtggataaacagaattgactgctagttaaattaaccaagagataagagaaattcccagaagaataatgataaatggtaaaaatgacattacaagtgacttccactactatgttgaataagaataagagttgacatcctgtcttgttccagttcttatggagattgttttcaactttcccttattcagcataattttggttgttgacttgtcatacatggctcttattatattgaggtatgtttctcaatgtttaatttgttgagggttttcatcataaaggggtgttgattttatcagatgaattttctgcatctcttgagataatcatatgttttttctattttagttctctttatgtggtaaaccgtatttattgattaccgtatgttgaaccatccttacatcatttggataaacccactggatcatggtgtattgtatatttgatgtgctgttggatttggtttgctagtattttgttgaagatttttgcattaggcacatcaaggatattggccagtagctttcttttacattgtcgcctcgctcgattttgttatcaagatgataccacttttgttaaaagagagaaggaggagtctttcctccttgatggcttgaaatagtgtcagtaaaatgagtattggctcttctttgtatatctcatgaaatttggctttgaatctttctgttcttggactttttgttgttggtagatgtttgttgatgattcaactttgttagtcattatgggtctatttaggatttctgttttatcctacttcaatcttgggaagttgtctgtttttctagaaatgcattttctctaagctttctagattatgcacataaaggtgttcatagtagtctcttataatcttttgtatttctgtagtatcagttttaatgtcacttttaccacttctcattgtacttctttgaatctctttctttccttggttaatttaactagcagtctgtcaattttgtttatcctttcaaagaactagctgttaattggtcctttttgttatttatttggtcttgatctcatttagttttactataatctttgttattttttttcttctgctagatttgggtctggtttgtcctttttctagttgcttgaggtgcaaaatttggatgttactttgagatcattctttttgatgtagacatttaacactataaactttgcctttagtacttttctttgttgtatcccagagcttttgaaatattgtgtctgtattttcaattgcttcaaaaactttcctgatttctgccttaattttgttgcttacacaaatgtcattcagaagcaagttgtttagtccatttacttgtgtagttttgagaattactcttggtattaatttctaattttattccactgtgatccaagaagatacttgatatgatttattgttaaaaaattatggagacttgctggatggctaagcatatggtcggtttaggagaatgctctatccaaagataaaataatgtattttctgtggtttaggatgaaatgtaatgtaaatacctattatgtctacttggtctatagtccagtttaagttaagtttctttgctgattttctgcttcagtgatcagtctagtggtgtcaatagggtgttgaagtcctccactattattgtataactgtctatctctattcataggaccagtagtatttgttttatgaatcagagtgttctggtgttggatgcacatatatttaggatagatagttaaaccttgttgcattgaaactttgttgtgaagaaagttgtactgaaagtttcttgtaaggtgatctggtagtaatgaattcctttcgtttgtcttggaaagactatttcatcttcatttgtgaatcttcatttggcaggatataaaattgttagctggtatttttttttggaagagactaaaaatagtcttccaatctcttttggcttgtagattttctgctgaaaagtcttttgttagtttgatgcgattttctttataggtgattagatgcttctctcttgctgattttaggatttttttttccactttgactttgaaaattctgatgactatatgcattagtgaggcttttccaatttatctactaggaattctctgagccttttgtatctagatgtccaaatttctcccaagacaatccaagtgctgcaataaacatgcttgtgcatgtatctttatagtggaatgatttatattcctttgggtatatacccagtaatgggattacttggtcaaatggcatttctggttctatatccttgaataatcaccatactatcttccacaatggttgaactaatttacatacccaccaagagtgtaaaagctttcctatttctccacagcctcaccagcatctattgtttcttgacttgttaataatcatcactctgactggtgtgagatggtatctcattgtggttttgatttacactatttacaatatcaaagacatggaaccaacccaaatacccatcaatagtagactggataaagaaaatatggtacatacacaccatggaatactatgcagccataaaaagaatgagatcatgtcatttggaggaacatggatgatgctggaagccatcatcctcagcaaactaacaaaggaacaaaaaaccaaacactggatattctcactcataagtgggaattgaacaatgagaacacatggacacacgaaggggaaaaaaacacaccggggccagtcggggggtggcggctgaggtgagggagagcattaggacaaatagctaatgcatgtggggcttaaaacctagataacaggttgataagtgcagcaaatcaccatggcacacatatatctgtgtaaccacctacacattctgcactcgtatcccagaacttaaagtaaaatttaaaaaaaaaaggaaataataaaaatagctaccatttgcacaaaaaagacaatcccatgggagttttgctgaattatttcttcattttccttacattttactttttcttcatcttcctctggaatacttacagtttgtaggtttggacactacataatcctatgtttctcaaaggctttgttaagtttttaaaaaaactctttgttaatttttatcttactggattaattgaaaagatctgtcttccagctctgaagttatttcttccagttggtatagcctactgttaaaactttcaactgtattttgtaattattttaatgaattttttatttctagaaattctgtttgttttttaatgatatctacccttttttaatattctgaattgttcttctgatttctttgtgtttttttcagctttgtcttggatttcattgagcttctttaaaatcaatatttttaatttttcatggggtatttcaaagatttcatttagtttagattcattggtaaagaatcagtgtggaccgggtgcagtggctcatgcctgtaatcctagcactttgggagactgaggcgggtggatcaggacgtcaggagttcaagaccagcctggccaacatagtgaaaccccgtctctactaaaaatacaaaaattagctggacatggtggtgcatgcctgtagtgccagctacttgggaggctgaggcaggagaatcgaattgcttgaacccaggaggtggaggttgcagtgagccgagattgtaccactgcattccagcttgggcaacagagtgagacttcatctcaaaagaaaaaaaaaaaaaaaaaaaagaatcagtgtgatctttcgaagtgttgtggcactctgtttttcatactttcatagttgtttctctggttctttatcatctagataagctatctctccttattttttgaatttgttttaatttggatggaatttttctccttcaggaggtgtctataatgtatgatttgtagggtccttctggctttggttctgggtgctttcagggctaaagagtctgtataagttctttggttacatatagcctttgtatgatggctttcctgaatgttatttttagtagcaatgcactgtgcatgtgagcaggctcaatgcttcctattggactggaatcatggagatctcaggaagcctatctcattccccactgctgttgacttgtctgttgacttgtgtcagctcattttctttttattattattattattatacttcaagttttagggtacatgtgcacaatgtgcaggttagttacctatgtatacatgtgacatgctggtgcgctgcacccactaactcgtcacctagcattaggtatatctcccaatgctatccctcccctctccccgcaccccacaacagtccccagagtgtgatgttcaccctcctgtgtccacgtgttcccattgttcaattcccatctatgagtgagactgtgcggtgtttggttttttgtccttgtgatattttactgagaatgatgatttccaatttcatccgtgtccctacaaaggacatgaactcatcattttttatggctgcatagtattccatggtgtatatgtgccacattttcttaatccagtttatcattgttggacatttgggttggttccaagtcttcgctattatgaatagtgccgcagtaaacatacgtgtgcatgtgtctttatagcagcatgatttatggtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgcgttttttggctgcataaatatcttcttttgggaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatagctagccagttttcccagcaccattttttaaatagggaatcctttccccattgcttgttcttctcaggtttgtcaaagatcagatagttgtagatatgcggccttatttctgagggctctgttctgttccattgatttatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccagttctgtgaagaaagtcattggtagcttgatggggatggcattgaatctatgatttaccttgggtggtatggccattttcactcagcccaaaatctccttaagctgataagcaacttcagcaaagtctcaggatacaaaatcaatgtacaaaaatcacaagcattcttatatatcaataacagacaaacagagagccaaatcatgagtgaactcccattcacaattgcttcaaagagaataaaatagctaggaatccaccttacaagggacgcgaaggacctcttcaaggagaactacaaaccactgctcaatgaaattaaagaggatacaaacaaatggaagaacattccatgctcatggataggaagaatcaatatcattttctattgtgttttgcatttcaaactctaggccagtaggtgtcacttatgggtatgagccacctgtggtcaaaataggtgggtatatacctaatccttttttaatgggagaagctctctgttgcctcagaccatgggttgatctgtggaatgcacagtggtatcaccttcctccttaggaaagatccaagatgtgtgggaccagactgagcaggcccacccacaggtttcccaatggcatgcacatgcatcagctttgaaaagggtcccagtgggcagcctgtgagaaccaggagatgtgcctaggcatgaattctagaaacttctgctgcctcaggttctctgcatgggaagagtgaggtggcctaaatcataacctagaagagtgagtgctccaaattccagagatatgtctgggcatcaagaagagagagcaccaatgtaccacaatctctgcacctgaagggaggggcagcacagattcctaagccaagagaatgtgtgtgtcaaatgcctgcaaatataccctggccaaaagcagagaaactgctgctgtaataaggtctttgcatgggaagggatgaatggctcaaactactaatctgtggacgtgtgtgtgccaaatgactggaggtatgtctgagtgtgacgtggagggagtgctgctgtactaaattgtctgtgtgggaaaagaatggcaactgaagctcctatcccaggagatatggtgcatcaaaagcctggagatatgtctggccatgaaagaaaatgttccactgcacccatatcgttttaccagccaaacgccatcagggggtggcttgcccactatcttctcccttggatctggagtgtcctttgttattctggtgaattcccactttccttcgtgaattaaagctcacagtgtcaatctttatgcactgttttgctatttccgagtggctgaggcatgctaacagcctctaacccgccattttgactgtttctgcaacaagtgcatgggcgatttaacaagaccaatctacacttgggggaataagatggagggtgagcagaatcaatctgcctatgcctccaccttcccttaaggaaatttattttccatattggtaatttcttaatggatagaaaaatcaaactctattcaaataatttctatatagtcagttaccttgcataaggaaaattattttaagtctaaaccgagcattgcacttgaaatatagtggtgaactaaaacagatatatttactgcatttgtggaactcactatagtttactcttggagaaaaaaaaatgagtatcagcaatctcaatatttctcttggcaaacaaatatgtgcttaataatttctattagcttaatcatgaaaacagttggttttaaactttttaagaatacactttctaccccaaaactgaatgtaaataaatttaccacacaacatgatgttaaaatttttcacacttgaatatatttgtttataccacaaagatagaagttataaaaattataacattaagtgaatagaatacatgaagatttaaaaagttttatttttgacctcaaaaggttatagtttgggaataaaaacaggagtcctgtgaagtttgaaaatatatcaaatggatggtcttgaatgttaaatctattagccatgggcttgaagaacttaacttcccaaacctcaagaccagttaatgaagccaattcactatgactctaaaagatatcctaagatatgtaagaagcctataagatgacttttattatgtactttagaaaaattgaatcaaatggatctttttgaaagttatgattcctatattggaattagattatactgctattaattgaatgtttaaggcctttttacaaaacagttttgttgaatcctaatgaggataaagagtgaagcttaaactgtacatatgtgtttgaagtttacatgtatgaacctatacattgcgactggacacaaatacaatctgaatacgtgctgtaagttctattatttcatattacctatcagtctctcttctcatctctacactgctgaaaaaggctaacttttagttgcgactggtggagctgtttagagacaccagtgatgtttgcgatagacagttcacttcacaggatatctgacacctttctcaaaaagagatctccttctctgattacagttcagtgtcccactttagtctgtctgacattgttctttctaagtcctgtataactgtgaagttgtgaaagaaaatataaccgaagaataaaggggctgctacgtggccagtgtttctgatgtgaaaactgagtctcacagaggtgaagtagcatcagtcagagacactttcaacttcaaagccttgattctgttcatcacaatctattggttcattgataaacataagacacagaattaatgtgagccatttggttcttctgtgaaagcaaaataaaatattacttcaatgtttatcaagggaaaagtcaaaatggagtttgtggtgaaaggatttaacctttttgataaaacatgttttgccttttcaggtctagggaaagaaattcagtaaatttagaaaacgcaattttcaaattttaaataaataagatacctgtaaaatgtaatacaaccttacaggcatatggccagatatattaaaatgttcttagagctttgtcaggaaatatttaagtgtttcgtcatgaagattttagacatattgattatttgcccagacactgattatacagatgaatggaaatatatccagaattctaaaatcttccatgatctgtggaatactgactacttaatcaattcggaatttatttaaactgttacttcttaaacgttttaaaaagccagaacaacactaattagcataaagctgcaatttgaacaacactacggtgctactatgaaaggtagaatattgttctccaacctgtacaagttttatttacctaaatatattcctctcgtgcgtctgttcacagtattaagttgtacaatgactcatgtaaggagttttgaaatttaattttgttgaagaatattttctttaatgtggactattaaatgtaaaaaaacttgaaatcaggccctgtgtgtgtatgtgtgtgtgtatgtgtgtgtgtgtgtgttttaacttcattcagttacaaacagccacatctatgaacacatgccaaattgaatgaattctatgaaataaagtctaaagaaataactgttctagatttatgccaaggcattgaaggaatgttcacacttacctgcttttgcagctagtgatttatgatgcccattacctatggcataaagagataatcttttaaaaatttgaggtagaaattaaaagctatcttcgtaattttcatctgtgccaacgttttctatcatacatctcttacaggtctatttaaaacatggaatactaaaatctgttttactgcatagtgaagttcaaagtttatccaaactatccatctgtttaaaattattatgataattaaaatttaggacatgaatcttgctataactcataagatgattaattctttctagtgtttcagtttaaactggtaccaatcttcaacccagttggttagctcttctcatcatcttagggggtgctaaatgtagcctccaattctagtttagaatgttattttccgtggctatatgaactaaattactgcccccttagttttgtacacccaaagccccaactacactttttccagctggagaacagggtgcacccatcaacctataattccattatttgcattgacatctgagttctttctaacctctgctataaatatgagacattttctatagcactcaaactttttcaaaactctccttatcacaatcctgcttcaaatgacatgttcttttcatcattgtctcttccatcagtgtagtatttcttcatatgtctcttctactgcttgttgtgtcttagctgttatgattttttaaatctcttttaaaatttagcaatataaattaatgcttaaaacaatgaatttcgaaatgctttgtttgaacttggagaacagattatttcttttagcctaactacccaatgatgttttctgcttttttaaatattcatttttctactgacaatagattttctttgtctctccctttttgaaactttgaagattaagtaaaggaaaagaattgataattaaattgtaccttgtaaagggaaaaagtaatttctatactctttacattcaaatttaggagtgcctcagggaacaaattacactactacgtatatacgagaaatacctgtaagtatttcagaatttaaggatgtgtaatattcatttgtataatcaaaggcagaaaactcagaagcaattaaacattatacaaatctcaatacaattacttatgacatatctggaagttaatccatgataattatagaaatagaagatattatacattgcaaaatggtttaatacaggtttgcttagtcccactacttaaggattataattttaaaatctgagtaaactctacagcattgttcaagacattagaagtaaggtttaaaaaaataataacttttattagtttttcaaattaaggttgaatgaataaactcctgtatattttcaactgggctttcttttgaggaatttatcgacatttttggacatttatagtcagaaaaatatactcataaattatggatattataaaggtgattatttttaataaaatgttggaaaatagaatgaactttaaggtctatacctactcagaattctatgattccttagttttcatccatgtgatacatgagcagatttgattttgtacgttgtccttattgttttgccctaggaatggatatctatggcatgaaaaaactcatagtgacaatatactccctataaatcaagaagtcctcttattttcaagtgttgtatgttcatgtttgtcagattaaatatatgaaagatgtcactagacctagtcacattatcagcattcaaaagatatgttatcaacacttccttaatgctgttttactgatatgttgcaatgacttgaagtatcagaggaaagatatcatttttgtttgaaacgttaaatgatagattatctcaatggtacacacagctattcaatgaaactcttctgagtatttgttcaggtctattaagtatgtgaatagcctgagttgtgacagcaagcagcctcttacccttttagcagatgtaattaccacatggcaagggaagtgaccattaaataaacctaaaacattgctaaatagagtgttgccatgctgtcaagtactgaaattgtagtcccttatatacaggtgatcatatatactggttttcccaaagcaatccggtttatgcctgctgcattattattaacaataccgctctcaccctcaaaagtattctggtttgaaccataaattactgcatatggccatcttccttccaggaataaaatttgagtaaaaataattaggtggtagacccagaaacctcccaaaaagttgagtcatcaagtaaaaaagaggtattagaagactacaacttttcactctatgtattttttattgttcattttttcctgctaaaataaattaattcctcatttttttctagatgaagtatttcttgcaacagcaattaggaaaacatttctgttctgtctcttctactttgtgcaaagggtgggagcaaaagctaaaaatgaagtataattcaaaatccttttgacacaggctgaaatctagactgtggtcattatagaggtgtttattttctgcagcagccagtagaaaataaataggctaataataacataatatactgctattctaaaactgtgtggtgggcaacatagtcttgagagagaaatgcttcgctcagaaatttaacctacagtaaaaatctaatcagtattattaaacaatattaaactaaatatgattaattttgaaactaacaatatccttcacaatacttttccagcactatttattgatttctcagtgtttgtaaaacccttagatacaagcttttgtcactaggaaaactgatgtttcatttaccaattttgtaaagaatcattgcatgatcgtccacttgagtgggactgattgcattgatctgaatgaatacaattagaggaagaaggattactcaaacgtttgcttggtaggatcacgtcagtagcattgtgaattgctacatttatgcaggacacatttaaatgtgtatatagatgcagatttatatttttatttaagtatatatgcaggacacatctaaatatgtaatatatacatatttattacatgtctagtacatatttattacatatattacatataaatatgtaatatatatatacataaaggtgttaaaaaacacttacacacatatacacattcatatacattatcctagtcaattgcatgagtggaaaattcctaaaaatctggttaaagtaaaaccataagttcagcaatctttcattctgtgtttattgactcattcaatgtaagccttattttatatacatattaagatatgtcctgcacatatatttatgaatatatatattttagatatgtcctgcataaataatatatatatacacacacacacacattactcccataactatacattaatatgtattagaattgttttaaagtgattttatatatatatatatatgtatatatatatatatatgaattatttgtaattgctaagacttgtgtgtttccttgtttccttgtgccaggcatatactaaagaccccctgtcatttgatcctcacaacaacaatggaagtagatattattacaattgttattgatattattatcctcatattcatttacagaaaataaaactgaggcttaaatagattgtgcagtataacttttgaaggaaatgtgtatttcttcattaatgtataataatgtatggagtaggtgtatttccttctctcttcaatcaatccaagaataagtggagaatcttggaaccgatcatagtattctttacttacgtataaaattctgtttctatacgatgtgattaagtttcaaatactaaaaagaatgcatttgcaaagatcttgtttcagtgcttgagcaactgatttcttatcagagggaggtgtaagttccatatagtaatgaattgtttggttttctcttctttttctttggaatgaaagaagataatcagtggtggtaagaatttaaagcaaatatccacggtcaggttttgatagtcaatcttgaattattcttccctaaaactaaggcactcactttacaacatgatgtctaactcaagcgataaaaattgtaaaactcctctgagaaaataatgaaaacaaatgtttgcttctgatattttgtttcctttttttcagagatcattagagctattattgctcgttatctgagggaacagttatgaaaatctatttaagcatgccaagaataaagatgaccacacgcacgcgcgcgcacacacacacacacacacacacgttattctggcctgcattggggtgattctgacagccttaaggttgcacaattaggagtcagatatttgaaatagttcagtttaggcctaagaggaggccaacactatagattaagtaaaataaaagctgagaaataatctagatactcaggtaaaatcctgactataaagagagaaaacaaagagaaacagtaaaaccatgtaactgcaaaattcacatggctgctgtaatagaatgtcagatctaatgtccgatctatgtaatataatgtctaatcaaaaattttcttcattttctatatatctacatagatggaatttttgccattcaatacattatatgttttatcatctggataaaaaatattcaactctgtaagattcagcatatttgtcacagtccaacttgggttagtctattttacttgatgcaaatataataccaaatatgagccatgaccttttgctttttatcttgcactcttgaaattcaccatccgcaatgttgccatagtgatttatccacaagaaaaaactggccttattccacttctatttagcaagtctctggctctattgtgattatccatatggcatacaacatgtcctctgtgtcgtggtcttggcctgcttctacagccttttccactaatatgcataacttgatgtttatgttacaattatatagaatatagttcctacaacatatgcatgttattttataattgcatatattttctcatgcttttcctgttgctaaaacatgataaactctgacttatttacttacttaactcattacctgcatttaaagattatgttagaaattatgccatcccaaaagtgatgaccaatctagtgattggggctaagcagtcctgctctgagtttatatcatgtcctttattccccttcttaaaatgatctctttatgggtttctttattcttttaggtttctatgtatttgatgaaacagccagcatgtggttttttttatctttgtatactcaaccctaagcattatgtctggtaaacatgtaatgtgtgtttgttgaaatgaaatagccagtttttcatgaagtgagaatcacagaatactgtcccaaaacagttttggtactggtgaaagaccttgtattattttgaaataaatgcaggcttcaaaaagtcagataggctgtgtattttcaggaatcttaaatctacatgctgctttatttttactattttaattattttattatttgtgtatttatttagtctccatttgttatttttgtaacttctgagaataaagtcttggtagctgttgcaaatggcaaactggacagaagtagttgtttcaaatttcaagtttctataccagcaagttacttccaatggaaaatatatcaaaatatgatttatttagactcctttcctctcaattttatatggacctgggcaagaacagtggtatctatagtactaagttactgttgcatgatgtactactcatttttcctaagaaactttactgtccctggagtttgcaacaaattttgtcagttgagtcttacttaatttctctgacccttctttggggctgatcaggcaagcctaccacctcaatttactctaggttctgtagcttaggtaagtagtccatggtccagtttcatttattacctatagaggtcagcctctaggagtataccaagtacagctacagtgttccacatctcttactattaacatgtgtaaaccctattagaattatattagagaagtaggtctgtataacatcatgaagattgcttctatgttctcaacaggatttcctgcatcttattttctaagatttaaaatgtgtctttctggctgggcgccatggctcatgcctgtaatcccagcactttgggaggccaaggtgggaagatcactaaggtcaggagtgtgagaccagcttggcccacatggtgaaacccgtctctagtaaaaatacaaaaaatagccgggcatggtggcatgcactggtagtcccagctactcaggaggttgaggcacgaggatcgtttgaacctgggaggcggacgttgcaatgagccgagatcgcgccactgcactacagcctgggcaacagagcgagacaccgtattgaaaaaataaattaaaatatgtcttcctcgcccccatttcctgtggttaagtcttcaaatacctacatatcctattctccaggtatggtaggtgtaaaacttaaagtaggaaacatggaaataattctaaaaatttatattactatcccataccatctaaggaattttatctactaggataatctctgcatgtcatatttcttcaagttttcaatgcaatttaaattcttataggcctattagccctataattgactaaataacatgaaacccaatacactcatttttactttatatttgatttctaacagtacttttctagggttgagttatagctaaaagtggggatggtaagttgtgtattgacttggaagttagaaagatcagtttgttttctatattaaagataatttaaatgtacatatttcagccatactatcatgaaaactatttggaatatcaaatgcattttattttaatggagttccttgtaatcagcattactctggaggtgatgaatgtgattaaaatactctgctaaggcagacaaccattcatatttagttggatgagactcagctttatacatctgagcattcaaaatatctggctcactgttaagagtaattatgctgtttacctctcaatatgctcttctctttttaagatgcctaatctccactctctgagaaagagaaatggcaagtttcactgtaccgttgataccacatctatcaatactgttcagaaatttttgaaaaaaatccatcatcagatacctgtctataatcacctataatttgagtaaaactatcagacttatgcagtagtgaatgatagaatcaaaatgtgaatccatgccacctgaccaagagccagtaaatattaagtaatatttgagaaagtaaatattcttcaaatcagataaagcttaaaatgttcatgataatctattatagtcaaatcactgttctagaagaaaatggtctctatgcactttttgtagaacaactcatggtatggataatagtggtgctatggtcacttatgtcataaacaaattcaaaaggttgtaaaaactgattatagatcaagaagtacaacctatgaaatattacgcttaaaatattttatatgtgatgaaattgaggtttggggagatgagataaactgcacaaaattgcatatctaacaagtgatggagccataatttgaacccaggcattctaactattctttcaattatattaattatatctctaccacattcaaatgacagttctggaaataactgatatggattaatcttagcatgtattttttttaattattttaggttcataggtacacatgcaggtttgttatataagtaaattaggtgtcatgggggtgcaatgtacagattatttcatacccaaggtaataattatagtagctgataagtagtttttcaatccttaccctaaactctcaagtaggcatcagtgtctctgaatcccttatttgtgtccatgagtactcaaagtttagctcctacttataagtgagaacatgcagtgtttggttttctgttccttcattagttcacttagaacaatgacattcatcaatgttgttgcaaaggacataatcttgttctgtttttatggctgtgtaatatgacatgctgcataagtgctgcattttctttatccagtccactactgatgggcattttgattgattccatgtctttgatattgtgaatagtgctacaatgaacatactcatgcatgtgcctttatggtagaatgatttatatttctttgggaatgtgctcaattaatgggattgttgaaccaaatggtagttctgttttaagttttttgagaaatctccaaactgctttccacaatggcttaatcaacttacattcccaccagcaaggtataagtgttccttttctttgcaaccatgcaggcatctgttattttgactttttaataataaccattctgattgatgtaagatggtatctcattgtgatttttattcacatttctctaataattagtgataatgagcgtttttcacatgcttgttagctgcatgtatgtcttctttctgaaagtgtctctgcatgtcttttgcccagtttttaatgggttgtttatttgtgtggtttttgtttgtttgttttgcttcttaatttaagttccttagaaattccggatattagacctttgtcagaggcacaatttgcaaatattctctcccattctgtaggtttacactatcaaagtctgtttacacttgatagtttcatgtactatgcagaagttcaaactatcaaagtctgtttacacttgatagtttcatgtactatgcagaagttctttagttaaattatgtcccggttgtcaatttttgttttggttgcaattgcttttggcatcttcattgtaaaattttgcctatgtccagaatggtatttcttgggttatcttctagggtttctaaagttttgagttttatattgaagtatttaattcatcttgagttgatttttgtatgtggtgaatagaatgagtccaatttcaatcttctgcacatggctagccagttaccccagctccatttgttgaacactgaattgtttcaccattgcttgtttgtcaattttgtctaagagcagatggttgtaggggtgtgtggctttatttctgggttgtctattctgtcccattggtctatgtgtctgcttttttaccaataccatgctgttttggttattgcagccttacactgtagtttgaagttaggtaatgtgatgcctccagctttgttcttttaaattgctttgggaagtattgcactttttacagtattgattcttgctatatatgagtatggaatgtttttcccgttatgttatttctgatttatttcctcaatgttttgtaattctcattataggtaccttttgcctccctggttaactatatttttaggtattttacgtttttgtgactattgtgaaagcaattaccttcttgatttggctctcatcttggatgttgttagtgtatagaaatgctactgatttttgtacattgattttgtattctaaaacttttctgaatttgtttatcagatctaggtgcttttgggcagagactatggggtttcctacatatagaatcatataatctgcacatagagacagtttgacttcctctcttcctatttgtatatttttattttttttcccttgccttattgctctggctaggacttgaagtactatgttaaataggaatggtaggagtgggcattcttttcttcctctggttctcagcaggggacacttcctgcttttgctcattcagtatgatatttccggtgggtttgtcatagacggctcttactattttgtggtatgtttactcaatgccttatttggtggaggtttttaacctcaagggctgctgaattttatcaacagacttttctgcatctattgagatgatcatgtggatttgttgtgaattatgttgatgtggtgaatcatatttactaactttgcatatgttgaaccaaccttgcatcacagggataaagcctacttgatcatggtgaatgagcttttagaatgctgctggatttggtttgctagtttttgtttgtttgtttgtttctgaggatttttggatttatgtccatcaagaatactggcttgaagttttcttttgttgttattgttgttgtgttctgccaggttttgatatcagaatgatgcatgactcatagaatcagtgaggaggagttgctccttctcaatgtttttggaatagtttcagcagaaatgatgcagctcttctttatacatctggtagaattcagctgtggatatatctggtccaagccttttgctggttggtaggcgttgtattacttatttaattttggaactcattatttctctgttcagggttgcaatttcttcctagttcaatcttgcaaggttgtatttccaggaatttatcagtttttctaggttttctagtttgtgtgcatagacatgtttgtaatattacttgaaggtttttttttttttttgtatttctgtggaattggaagtaatgtcccctttgtcatttctgattgtggatattcagacctttatttttcagtagcctacttatcaatcttatttattttttcaaagaaacaaccactaaatttgttgatcttttgtatggttttcaggtcttaatttatttcattcagttcagatctgactctggttttttgttgtcttctgctagctttagggtttgtttatttttgtttaacactgctttagctgtgtcctagagattctgatgtgttgtatctttgttattcatttcaaataattccttgatttctgccttaatctcattgtttacccacattgtaatccaggagtagcttttttcattttgatgtatttgtatgattttgagtgatcttcttagtattgatttacatttttattgtgctgtggtctgacagtgcagttggtatgatttcaattttgttgcatatgctgaggattgtcttatgggtgattgtgtggttgattatatagtatgtgtcatgtacagatgagaagaatgtatattatgttgttttttggtggaaagttctgtctatgtctgttaggtccatttggctaagtgtcaagttcaggttccaaatatatttgttaattttctgccttgattatctgtctaatactgtcagtgggctgttggaagtctcccactactggtgtgtggttatctaagtctctttgtaggtctctaagagcttgttttataaatctggatgcccctgtgttgggcatgtatatatttaggatagctgggatttcttgttgaattgaaacttttacaattatgtaatgctcttctttgtctttttaattgcttgtgtgtttaaactctgttttttcttaaattaaaatagcaacccatgcttttttctcttttctgtttgtctgattgatttttctccatccctttaatttgagattctgtgtgtcattgcttgtgaaatagttctcttgaagacagcatacagttgggtctttcttctttattcagcatgccactctatgccttttaattaggttatttagctcatttacattcaaggttaatactgatatgtgcagatatgatcctttaatcatgtttttagctggccattatgcagacttgattgtgtagttgctttagaatgtcgatttatgtactaaagtgtgtttttataatgtcttgtaacagtctttcctttccatatttaacactcctttaaggacctcttttaaggcaggtcacgtgctaacaaatttccttaacatttgcttatctgaaaagaatcttaatctctttcacttatgaaacttagtttggctagatatgaaatttttggttggaattagataagacccagattatctttaaggttattgtatttcctctccaatttgttgtgattattttttctaattatgtaggaagaaatctgaagcattatcacttaaaaaatatactgaatataggcccctaatctcttcaggcttttagggtttcttctaaaagatccactgtttgcctgatgtagttgcctttgtaggtgacttgctgcctctttctagcagcatttaacattttttctttcattttgacctaggagaatcttccggctacatttcttggggatggccaccttgtatagtatctcacaggggttctctgtattttctgaatttaagtgttggcccttgggtgaggttggagaattttcatggcctatatcccaaaatatggtttccaacttgctttctttcttactctttctcctatagggatgccaaggagccagagatttggtctttttacataatcccatagttctcaaaggttttgtccattctttattcttttttctttatttttgtatgacaattaatttgtagtaccagacttaacctctgagattctttgctccacttggttgattttgcgttgatacttgcaattgtattttgaaattattgaagtgagtttttcagctctatcagatcagctttgttttttcttaaaatggctattttgtctttcagttcttgtattgttgtattgtattccttagactccttggattgggttttgagtttctcttgaatctcagtaatcttcatccctatcaatattcttaattctgtttctggcatttcggtcatttcagcctggttaagaaccattgctggggaactagcatgatcatctggaggatgatcaccctggattttttagcgtccagagttctcatgctggtacattctaatctgtgtgggcagatgttccttcaatcttggaagttgctgccctttggataaggtatttgcttttatcttctttgattcccttgggagtttgatagaggaatatggtgggttcagtcgattgactttgtctctggaagatctcagggggccaaagattagtttagtactccaggcctgcttgcagtaactctggggggctaatgccaggcccctagctttgttagtttagccccttcatgctgggaacctgctgcaatggagaggttaaggattttactgagcatcatttgtaaaatagatttaggaatactatatttaaaatacataaaatataatcattaaggcatagctgattttcatatgttcattttgtccatttgttttcccctatgcaatgcataacttaccagtaaaatgtattttctttacaaagtgttaaaaagataaagaaataaaaaactatttattgctactgagatgctaaataatgtaacattctaaatatgttattaaaatgcattaatggaaataatatatatgaatatatttctcctgacattcaatataaggaatattaggtaaaattatagtatgatgaaaattatattaccatttttgtccttaaggctaacagtcttcaatcctactacttcagccactttgctgttggccacacttaaaagtattcagagaaacactgaagtctggtttcaaaagtgaggtgggactgcattgccatcattatcatcatagaacaataaaaaataattttctgtcatattgaaaacatgcagaaatcctttccttcagagattttgttacttctggttatgggtcttgatagagtcacttaagatagggtcttggtaattcagtttacatgacatctagatcacaatattttgatgacttttattcagaaatgtggcaaacattttcttccgtaacatatgaactaataatttgaggaacatgtaagtgactagttttttttttacataaaacctgtagttaagcattgtcaaatcatgttacaaaattctcacctttcaaagttgacaataacattgataaatactttgaaatatcattaaggtgtattatgttttctgaagttatttgtttaatcctttgttagaatgccattatgatttcagacactagatctttattctaagcacagaaacagattttgggtaaaccaatgctgtttttcctcttccgaagaggaggacattacttttatgaacacactcatttgattaatattgactttcccttttaaatgtgaaagacaaagaagaatttattatataagtcaaggaacccttcttgaggacacagaaaagtcataatcattatcaaagactgctttactaagaaacttttacacaaatgacactggcaatagttaaaaaatggtgccttctaaagataaaaagtggctcagttgtcagggaagaaatcatgataatagaaggcactaggtaaatgttggctatcatgtgccaggcataatgttagaacatttatctatgacctctaaattcactgtaggtaatcagggtagctgttattatcttcattttacaagtgataaaattgaaaatagagaattaaaaaggttaagtaattgatcaaatttatatagttttgaaatgatgtagagggtggaaaaccaggttctgtaaggcagcacagctgcagatctttgcactaccacatgaatgacaaatatctcatctcattccatttcccctggctgatatagcaaatagtgtgtagctttttctctgctcagcaacagacaccctcggaatccttctaaacacagaatctatacagcactaaactattgagcagatctgatgcaaataataaacccaaggcaacattctgtcaaaatgtgccagtcttctctattctttgagcaaacccatgtcactgtatctgtgagtgattgtttcaagaaatctatgtacttaattttttaattccaatacttcaaattagcttgtctctcctaatatccaaacgtgtttaactttcatttatcccatgccaacaaagcaatttgcctgtgatttccagtcaagcgaatgtaaactttctttcttaaattctgtttggatgattttccctttctgtaggtggctgtaactgcattgaatgagaagatagtcatttcagataaacatggacttgtttctcctcttgactgcttcattacttataaataccacccatactatattaaagctcactctcaggatgagtattgatttaggagtctctctaccaatgataagaagggaatgtacagatgccactgtatacagaacttagcaggtggcctaaatagtatcgtaagtgcctgttagagtaagaaataaccaataggtgagaacgtttttatgtaagaacagtcttcctggctattttttcttttctttttctttttttcactctccctccatcccttcctgcttttcttccttcctgccggccttccttgccttccttgcctcttccttacttccttcctcccttcctccctcccttcctcccttcctcccttcctcccttccccttcccccttccccttccttccttccttccttccttccttccttccttttctctctctctctctgaccataaatggaataagcaaaaataagcataaacatttctgcagaggttaactattgcaagcatgtaaagaggtatatatatatatatatatacacacatttcaataagcatagcgatatacataatgaaaaaataaaaacaaaatataagtctaacataatgtaactgttttaaataaattaaactgtgttctcaggtaatcatgtattttcaacatgaagatttaaatttatatgcagatatacctgtaaataaaataagtttaaaagatcatgatatgtgaactaaataatttcacaacagaaatatagtatgctactttgagagaaaaatattttttaaactatcaagtatatataagctaaaacaagttatttctgatattttagataatttactctttccattctatttgaaatttgttactattttttatctatcaaagtcatttcttctgtagtaactacaaataaataaaataactttatttctgcaaagacataataacaataatatcttcaaaaattggcactagctgggttcagtgatgtgcatttgtaatcccagctacacaggaggccaaggagtgcttgatccccaggaatctgagtccagtctgggcaacatagtgatacaccatctctaaaagaaacgtaaatttccactgtatcctataagatgacagcctgatggtcaggggagatgttggggaaaaatacacatacatagataaaaacatccatccctgcaatgacttaacttataatcacatcattttactttaacttgttaaaagttttcaggatagctatggaagtattattcaaaacaaaaggaaacctaaggaatgggcatgctaaaataaagctcgaagtagaaatttagggtggaaattaaaatacaaaaatagggcggttttttttttcatttattttctgatttgaaagaatctttttgatcagaaatgggaagcttttaactttcaactgccagtgctacttttcttctttcatgaaagatttccccatagatttcagtgctgtttgatagcatttaaccctcagtagaaatgttttcaaaatgggagtcagtcctctcaaaacctgccactgctttgtcaactaaacttatgtaatattctaaattctttgttgtcatttcaatggagttcatggcatcttcaccaggaatagattttatctcaagaaaccactttttttgtattcatccacacaaaacagttgctcatttgtgtatattttatcatgagattgcagcaattcagtcatatatttaggctccacttctaattctagttcccttgcaatttctaccacatctgtaggtattatctacactgaagtcttaacctctcgaagtcattcatgagtgttggaatcaacttcttccaaactcctgataaagttgttatttgatctcctcctataatttataaatgttcttaatggcatctagaatggaaggtcttcaatttactttgcccagatacataagaagaattgctacctatgccagctatagtcttgtgaaatgtatttcttaaataataaaacttgaatgtcaaaattactccttgatccatgggctgtagaatggatgttgtgctggcaggcatcacagcaacactgatctccctgtacatctccatcagagcttatgggtgactaggtgcattgtcaatgagcagtgatactttgaaaataatctttttttttccattggggcttaaatattcatttgaagccccaatggaaaaaattaatattcatatctatcttgtaaatatatgggctgttatccaggctttgttattccattcatagagcacagttatagtagacttggcataatcttaacaaccctccgattttcagaatggtcagtaagtatcagcctcaacttaaagtcaccacctacattcatccataacaagatagtcagcctgtactttgatgctttgaagccaggcattgacttctctctagttatgaaagttttacacggcatccttccatagaaggtattttcatctatattaaaaatctcttgttcagtgtagccaccttcaacaatgatcttagctaaattttccagataagttgctatagcttacccattaacacttgctacttcatcttacacttttatgttatggagatgacttctttcattaaatgttataaacaacctctgctaacttcaaacatctgcagcttcctgtcctctctcagttttcacagaatttaagagagttaaggccttgttctggattaggctttggtttaagggaatgttgtggttggtttgattttctatccaaaccagtaacactttctctatatccacaatcagactgttttgttttgttttgtttatactttaagttttagggtacatgtgcacaacgtgcaggtttgttacatatgtatacgtgtgccatgttggtgtgctgcacccattaactcatcatttaacattagttatatctcctaatgttatcccttccccctccccctccccctaccccacaacaggccctggtgtgtgactgttttgttttcttatcattcatgtgctcactgaagtagcactttttgagtttccctcaagaacttttcctttgcattcacaagttggctgtttggtgcttgaggcctagcttttggcctctgggctttcaacatgcctttctcactaagcttatttatttttagcttgtgattaaaaatgagaggcctgggactcctcctttcatttgaacacttagagaccactgtacaattattagttggcctaatttgaatattgtgtgcctctggaaacagggaagctgaagtgggtggagcagtcataacacattcaacatgtatcagttaagtttatcatcttctatggacctggtttgtggtggcccaaatcaactacaatagtagttgatctcaaagaccgctgatctctataacaaataataataataataaagtttgaaatattatgataatttccaaaacatagacacagagacatgaagtgagcacatgctattggaaaaacaatgccgatagatttgttggacaccaggttgccacaaaacttcaatttgtaaaaattggaatatttgtggagtgaaataaagcaaagagcagcaaaacaaggtatgcctgtattgttctatttattccatagattttctaaacttcagtaatttttcttaaaacttgaataaaaaaggtatttgtctcattgtctctcgacattttagttgaattgcacaatttgcagttattatttgacatctctataaatttatctgaacatttatttgatcatgtctatacattcttctaaacagaataagccctttcaaaagtgaccattctgtttacatttctattcatttcattctttagttgtagcctcaaattatattataatcgtattaacagaaaaatcaattcttattgagaatttttaatatactaaatgatgtatgtacatcattttattttcattctggaattaccacaattgtcccaaattttataggtgagacaacttcaaacaagagagtttaagttaatcacagtggaaaatcctgtgctcaaacctaggcctagttggatctaaattaatgctcttaaatatacttcgttgagaaaaaaagaactacactattttttgtttcggtttggttttttcttgtacgatttctgataaccatagacatttcactcagtaagtagtgcaggctgattggcaatcactgaagtgtgagaattttcccaagtaattattgtagcattaacttctgtacttgattgatacctccctcttccatctaaaactctccaatctagccaattctaaaactcaaacctatacttagagagtctttccctattcatctgaaagcatttcttcttcagggaaaggtgtgatagaaaaatacaaatattactgaaagttgttactgaaaaagcaatcaccattagagtctactttatcattcagaaaccaagttagatagtcagcaacttaacatgactctaaagtttctgcttcacttttaattctcaagggtgagaaaaaatatttgtttctactgcaaatattaagaaaccaagatctcagaaaatgttgtcaatttagaatgtgattaattgtattaatctaatatatgaacatgatatattatgataggattaactaacacatggtgttgttacacatgtgtttaagaatcctttagaatttaaatgttaagcttcatataaagggctcatttactcatataagttacagtgtaacttactttcaggaaagaaagaaagagagcgtcagttgtcaaagtgataattcttctcggtgtaaaaagagaagggtaaggagaaatatcatcctaagaatggttttatttctttttatggctgacacaggaacagaaaaccaaataccacatgttctcactcataagtgggagttactctacaatgagaacacatagacagagagaggggaacaatacacacgagggcctgttgcggggtagggtatgaggggagggaacttggaggacaggtcataggtgcagcaatccaccatggcacacgtatacctatgtaacgaacctgcacgttctgcacctgtatcctgttttgttgttgtggttgttgttgttattgttgttgttttagaatacatttaaaaaaagaatggttttatttacttgagtatttattttgtgtttgcatttatgctaagtatgtggcatcattttctcatttaatctttactacatcattttcattttcttggcaatgtatctgagattgacattcctatcagattgatgagcttattattttgagttattcaatcagggatgtttggagttattcgcttttaagtttaagaatggcttaaggatatgacttcgtttagaagttatggaacttatatttctagatcttatgtaaactgaatcacagctctaaccgatttttatttgtgaactcttttctatgcatgagatgtcccagggaaggctcaatcagagagaacaagaagaacatttaaccccagttagatttcgtgtacaaagactatgatttcagaggaagtttaaagttagatgactgataagttgttttgattgttaaagtttaggtaaaagataatcagaatatctgaattgcagtaaaatcaaaatactgctggaagcaaacgtatactagtttaagatacaaagtgcaataaatatatcactgcttgtatttatattttgcttatgtatacataccatttatacataaagtgaatatagtgagctcaatttgagatggacaggtaagaattggaaatatatcttcttaaaagttgatctaaatgataaatgaactctacaatttcagttcagtgtatgtagatgaatataataatataataaatagagctatgatacactacaagccatgccttcaaattgcatattcttattttcctctcagcagcaggtagtttggaaacaaataaaattattgaagataaattttaaattatcagctctggaatataattaaagattttcttgaatgttatataaatttggatatatatccttttcttccttgtgaagtggccaaagtattacttggcatactttatatgtggcggaacataaactttctatttccaaatttgctgacttttctgttctcatataaaagattgtaaagtcagtaaagctaaatttatgagtgtgttaaactccgtaagcagaaagtctacatgaagcataggatatcctctccaaagctgtcaaactgtttctataagtatcatgtagaaatcacagggtgaaaagaaatttcttattcagaaatccaatttccttggaggatgatggacacatctaaaatgtctgtaaaatataaaaatgtagacgatgtgtggctgaagagttaagcattgccattcaaaatactcctctgagtacagcagccagagccatttcagtgctctggctgctgtactcagaagagtaatttcctagctcctgctgcagaaagctttcacaattaatgcactggtgcaaaaggtcattctcaactcattgtcagtcatgaggttcagattagtttagtcttaggaatactgaaggaaatttataggaatacaatgggttcctagctgaggtggtttacagctgaaagattgcttcaggagaatttcttggtttgagagtttctagtggttattgacttccccagcccaatctaaaaaataaagcagcaaggaactatgtagattactactcattaagaaagtcttttaagtgagccaaattatgtgtaggctgctcctaaatataaacaaacataaaagtaggaaatacagagttttcagagacatttctacaaatctaaaccatgaagtgcctgtgctatttcaatagagatgcaatttatttgtgggttttcatatttgaagtttggaggtaatttttaattgataattaaaacatattttcctcttttgttctgctacgtactgtcataaattattttgtactttcatttacaccataccatataagaagtttttagggatcatttgtaagtcataagctacataactcacctgctcagaggaactcctctgtctcatattcagccaagttgagaaaaaaattggacattttgctcattgaccttcaatgatggtcatcttcttatgcacctaatgcagtacttgcttttctagggacactgagataataaacagtttcaaatataataggtgattttaaaagttggtgaatgatattaacagtactgacaaacgttagttgatattcttattatagttattactggtttagcaactccccacagcttaaaatgcaaaattcaaatactctggttaataagtaggagaagtatactctaaaataactataaaaaatatagtcttgtggctggccatggtggctcatgcctgtaatcccagcactttgggaagttgaggtgggtggatcacaaggtcaggagatcgagacaagcctggccaacatggtgaaaccccatctctactaaaaatacaaaaattagctggaagtggtggcgtgctcctgtagtcccagctactcgggagactgaggcaggagaatcacttgaactcaggaggcagacgttacagtgagccgagatggtgccactgcactccagcccagcctggcaacagagcaagactccatctcaaaaaaaaaaaaaaaaaaggtagtcttgtaaatacacaaaccagtaatatggtgtttattaacattattgagtattatgtactatatataattgcatatgctgtatttttatacactggcagtgcagtaggttaacaccagcattaccacaaacacatgagtaatgcgttgtgttataatgttatgacagctacagtgtcaacagaagatagacatttttcagctccattccaatcttaagggatcacctcatatatgtggtccattattaacagaaacattgttaagtggcacatgactatacaatttcttgatcatgctgtattttttgcaactccacagtttctttattgcttataacctatgttcaaaacgtttttgtctgtttgatgacctctcattccttcaagaacatgccccaataccacccattctgtgaaattgctacctactttgctgctcccatccaatagaattatttacattttctccaagaccagtaggagttggcatctacttgtcttatagagcacactccaatatattgtattcataggtgactcaatatatttgtcttcataggtgacaaaagcaaagatcatgtcttcactgccttctgctctatgtataacacagtcatgcaaatagtatttgatatttgggtttttgggatgaacacaattacttaatgtcgttatttcataaattgatgaatgttaatagaagtgtcatagatatgccaaatatgttatattgatccacttaaaactttattcagtccctaattgctgacttttgcacagtgcttttcatggctggtaagttaatgaggaaagtagtcagaggcaaaatgtaagtgttgatcaagaatttttctaccattttatataacattcaagccgtgataataattgactggtttggagatcaacagtttctgtgaacaatttacataatatttcagctctttgtttttttgactttggtagttaccatatccaaaaaagagtgctttgtgttaattgttttaaatgaataatacactttgcatatgtatttgtagaattgcttctgttagcatcacttagctcataaactttaaaaattacctattttatagccattttatctacctatgtggacatatatattaataataatatcagaaaattttattttaaggtttatgtagttgtggctaaagagttgtagtaagaaagaaaaattgaatgtgaagagaagataggtattttggaaacgttactgagaaagcagatacccaatttagcatatctaaaaatattgaattactttttgagcattggaatttttaggtagtctaatgttgctttattaagttatctaatttttaggattattaaccttattttgacattataaatgttctcaacacaagcattaactgactgatcctgatcttctcatacacaatgaacaagtaaagctttggttctttattctatggagagacaacttgctaatgcagtgacaaattttcctcatgaattttacttattgaaaaagtaattgcctttcagagttgattttgagatgctgcttttggggtttaacttctttgtgattcttaagtaggaatggaaattttaatgggtgaagcttatctgtgaatcactggtaactagaaactgattttacatggctagattttcaaactgagatgaaaggagaaaacctatgtaagcatacttgtttaagcatattctgatattttcaatattaatcctatgtatttttcaaaagtgtatacttttcagacaatacagtatttgccttaacatctcttaaactttggattcggaaatttattgtttatattgtttattctacttctgtgagaatggttaaaatacattaagcattctattcagtatatagttagccagagtcagattgaactgctgtttgttaatgtctgtgttttaacataatagcaatcccatttgtttagtatgattagcccaagtctaaagaagtacaattgaggcttagagaaaaaaaaatgacttacccagcctacctaactaatgggatggttgagggtagaacataacttttataacttcaatttttaccactcccattattctactctttgcacattaattctaatttttaagataatgccttcattgggctgacaattttattttttaatttaattgaggacagctctgtaataaatttataattaataatttttaatgctagtgaagacttttttaaatttttttaattttattttattgtggttagaatgcttaacgtgagacctatcctcttaaccaatttttaagtgtataatctttgactatagacataatgttgtttggcagatctctagggcttttttacctggcttgactgaaactttctgccatacaacattgtattatatattgcagaattttcttaaagatgttaaggcagatattgttcaaggatgggcatggtaataggtatagggaccccagcaaagtggtcttaaaggagcagagagagattggactcaattctgacttccaccatgacaagtggagacttataccaaaaagcagggtggggttcagtgaatggaaaattactaagaggaaacatacagaaaaacgaggtttctagctacatcaacttgatggaattattgctgaatggagtccagtgtcataagatattgaagcttttttcctaagctgacttaacaggaatcttgctcaaactggattcaacaaggacagaaagagaagcccaaggttagacctagccaagcataagattcaaaagagtccaaataaagttttggtcaaaggagagagttttagtcagtatatattatatatgtagcacatttttttattcatgtacttgttgatggacatttaggttgtttccacatcttggatattgtaaatagagtcgcaatgagcataagagtactagtatatgattgtatctgagagtgtaattttgattcttttggataaatgccaagaattttgattactgaatcatatggtagttccatttttaaatttttttagaaacctccgtagtgatttctatagtggctgcaccattttgcattcccaccaacagttttcaagagttccactttctccacattcttactaaaaacatactgtctttggggttttattgttttgatttctttgtttttgttttgtaatagccatactgacaggtgtgaggagatatctcttgttgactttgatttgcattcttcttatcattagggacattgaacatttttaaatatatctattggctatttatagttcttttggggaaaattgtctttccaagtctttagcccatttttaaaatcaagtcacatgctttattgagttacaggagtttcaaaaataaagtattttggagatcaaacctttatcaaatatacattttgcaaatattttctcccattctgttaaggcaaaatgcctcttcactctgttgtttcctttgctgtacagagcctttttagtttgatatagtaccacttgtacaacagacatatagaatactggaatatgatacagaactcagaaataaatctatgtatatatagtcaactgatcttcactaagggtgccaaaaagtcacaatgacctaatcaacacatggtggtggaaaaatagataagaatataaaaaagaatggtattggacacaattttacaccatacacacaaaaaattcaaaataggttattgacgtaaatgtaagactcaaatcattaaagtgcaaaaagaaatatgagggaaaagcttcatgatgttcgtctcagcaatgattttatggatatgacaccaaaagcacaggaaaccaaaacaaaaataatgaggacttctttttgctaaaaaatctcaataactctgtaaagcattccttatttaatgctttctttaaaaaggatctaaagcaaaacatagtgcatcaaaatttgcacccatcataaaatttcaactattaaatggcctttgaacttttcttttctagaaaataatctatatttatataatagtttggttattagctgatgattttaattttctagacatttttagctctgggttataattaaaattggctatcttggccgagtgcggtggctcacacctgtaatcccagcacttggggaggctgatcacgaggtcaggagtacaagactagcctgaccaacatggtgaaactccgtctctactaaaaatacaaaaaaaaaaaaaaaaaattggctgtcttgctcccttggatttggatttccatgcaaaaattagaaaagtagaggcagtgatgatttaaaatacataaacacacacacacatattttatatacagagagtcgccaacttacagtggttcaatttacaattttttggatttatgatggtgccaagtgatatgcattcagtggaaactttacttcagtgcagttcaatcagtcacatactatattcaacactattataaaaattaactttgtattagatgattttgcccaactgtaagctaatgcaagtgttctgagcatggttaaggtaggctaagctaagctatgatgttcagtagacagagtttattaaatgcattttaacttacaatatttttgacttcaatgattttaacaggatgtatcctcattgtaatttgatgagcatctgtacatttgtatggtcatgctctgcataatggcattttggtcaacaatgtacaacatatacaatggtggtcccataaggctataacatagctgaaaaatttctatttctatttcctggtgatatagcccttgtaacatcatctcagaaagcattactcacacgtttgtggtgattctggtataaacaaacctactgtgctgccagtgataaaaataatagcacatacacttagtatatagtacttgaaaacgatagcaaatgattatattactaatttatgtatttacaatactgtaagttttattgttattttagagtgtacttcatctccttataaaaaaattaactgtaaaccaccctcagacaggttcttcaagagatattccagaagaaggcattattatcataggagatgacagctccgtgcatgttattgcctctcagagtcttgtactgggacaagatatggaggaggaagacagggatattgattatcttgacccggtgtaggcctaggctaatgtgtatttttgggtctaggtttaaaaaatgctttaaaagtaaaaattaaattaataatttttaaaatagaaaaaggttatagaataaaaatataaagaaagaaactatgttgtatggctataccatgtgttcaagagtcaaaaagctaaaaaagttaaaaattaaaaattttattaaaaacaacagtaagctaaagttagtttactatttaaaaaatgcattttataaatttagtgtagcctaagttttcagacattctattctaatacacactactataggaaataacactatcaaatgatttgacctggagtaacgctggaaatgattgttgctgttagattttctgtaaaaaggtcaaactttgaaaatctgatttaaatatacacatggtattgatctaaattatttcctcccttcttaaatattttctagcttaacaaatgaaatttaaaacattttttccagtgttattttaattaaataattagcttttgtaatagcttcaacttgtgtcaagagaaaaaaacacagaattattttttacttcaagaacatctcatatatgcatttacataaagaggccataaatacatattcatatacatttgactaaatgccacatatgctttaacattttcttttaagaaaatgtaacactttgaagattcagtgtaaacatccaaatagtaaactaaatgatttccttagctccttgacatatcctagagtatctattttagtttataaatatgattttaaaaaattaggtacatagcaaatattctatacctacaatacattttttctttaacctattgtatcctttattgctgtacattctaattgtttacaacctcttcgtattacaaatcatacttcagtaaatatccttatatgaaggtatttgaagacgtgtttgagtatatctgaaggacaatttttaaatatataattgttatatacaataacacatgcattttaatatgtgaaaaatatcgctattttattattatctgccattgtgagtctcatcttaggtataatttccctaagcaatctgaattccctttcagatataaatgataatcttcttagtatctcaaaaagcctatatttttttctttatgatatggaaaagtttctgtcttgtgctatgctataatcaacaccctttctagatgattttcaaactatcattttaacattttgcaaaggaaaaactgagggtttgaaaagttcagaaaactgcccaaaatattgtagcatgtaagaggcagagtcaggattgcaactcaggttagtcagacacttgatcgcaagctttaatcactgcaagcataatgtacttcaaagttctgtgaaatgttaatggacatgggtttgaagattccacttctagtcttgcctctaatgtttgactttgagagggctacctaacctctcatgctcagcttctgtccaatttataaagaaatgaaatcaattagttcagaattttgatccagaatttaaaataaaacatgtatttaaggttcctagtaaaatgtctaaaatggtgatgctcaataattgtagttccatctgaaacgtgataaaataattcaattttgaatcccctcaaatgcttgtccattgaaagcacaaatttcatatcatttcacaaatataccatacccagaatagtcaaattaatagagaaataacatagaataatggttaccaggggcggggagcagggcttaatggggagcacctatttaatggatagagttccagtttgtaacgatgaaaagttctgaagatggatggtggtgatggctacacaacaatgtgaatgtccttaaagccactaaactgtaaacttaaaatggctaaaatggtacattatatgttatgtacattttaccacaacaaaatcttaaaatttaaatgaaaaaaattaaaaatatttaaaaaatctgaacaatagcaaagcctaatatgactttcaaagtcttataatatctcagaattttgttcctcaaagatgcttggttttgcacatttttaaattatagattcagaggctgcatgtataaatttgttgcatggatttattgtgtaatgctggggtttgggcttttccctgagcaacacttccatattaagcaattcagagcccaaagtcctaaatccaccttagtatgctatcaagcaaatcttgaacaaatcttttaatttctctgggcttctgttttcttatgggttaacagagaagaattagcaagatatgagcttcattttagctaagattctttggaatttacgactcagttaagaacttctgacatcactatgcacacacacatgggtagctatttagtttttaagaatgtgagagtatctcagatagattcttatcttgcctgcataaataaagggctctctgagacagcatccttaaatttcagatattataaaaagaggaaaagtaacctataaaaaggaaagtgattcttacatataagaagtatcaaacacagctgaattatttgtataatatagtttaaaccatgtttaaaaaatcatattgttcgtggtaaagatgcaataaatgccattatataaatgaccaatttctgaattactagtggcttgtgctgatggacagagccatagtcctagatacatagtttatgccagtgttccaagaacctggtatttgctcagttattcaggctaaagtggtggtgaatacaacagaagagaaagagaagtttcattgcttgctactatccaagtgttttaagtaattaccacccatgaacacgtatatttaagacttaattatgagattcaaaatattttaattggtaaacttgaagaagtgtattataaagaaaactaaacataaaaaaaataaaaatagtagtttgtctactctaatcctacatgccaacagcttcatgtggctggaaaataaaagaaaaaacaaacatcaagtggtccatcatccctatgcaataactgtataactgtatgccattttgccacttaattcacactattacttttcaaaggaatccttcatacattctctttatcctcaaagctccgatacatctttctcatccgcaaacttccacctatcctggaccttctctctggttaattaccactgtctggaggatctaatttcctctaccaacctaagaaaggacttttctcttactgtgcaggtgtgtccattctctctcctgttttgtctgcactgtactttttaatagattattttcattggtaatagctctatctttaacacaagtgcacacatgtgccaagttcatggactcattgtccccactgtcttcctatctccgcatttggttgctcacttgcacagtaaaaaaaaacactaacaaattatatgaactctattttcttgaaaacctctagtcaggcttttgttcccactcctccactaaaaccactcttctcaagggcatcagtgacttctgttttgcaaatacacaagagttaatcctcaatccttatcttcctcaacctattagtggcactcaacatattagcattctctcctgtttgaaatcctttcttcatttggcttcaggcattccctctcactccttcttatctctttagccacataccctttatttttctgacctctaaatatttgcaagtcctgattttttctctctttgtacatcctccgtagatagcctatgttagtgccatgttcatttcatgactggcaattttttgtctaccctgactttcagattcattcatatcaatctatgggacatctgtatttggtagtttaatagatatttcaaactttatttgagcaatcaaagccaaactcttgatttctactccaaacctgccgctccccaatagggaggatcacattccagtaagtggcacctccattctctcagtttcttgttggctacgtctctcatctctagtactactccctccctcttattaatctggcctatttgctgtttctcatccatggctggcatgctccccactcagagccattgaaagtggtatgcctgcttccctgttatgggattctctaaaatatcccttagtttattcaggtctcagctcaagtgtcattttcagagggctttcctttaataccctagcaatcttctccctactccaaccttctttctctctctgtattagttgttctcaggctgctaataaagacatacccaagactggataatgtataaaggaaagaggtttaattgactcacagttccacatggctggggaggcctcacaatcatggcagaaggtgaaggagcagcaaagtgatgtcttacatggcagcaggcaagagagcttgtgcaggggaactcccatttatagaaccagatctcatgagacttattcactatcacaagaacagtatgggggaaaatgccccgtgattcaattatcttcacctggccccacccttgacacatggggattattacaattcaaggtgagatttgggtggggacacaaccaaagcatatcactccctttacacctttcttcaagcattaacacaacctaaactatatttgtattatttcttcttttcttaaaaaaaaagaaagctccacaaagactttgtgaagcaatacatttcaaacaaggtgaaaagagtcttaaaaatatgcctgatcattatattttaatacctaatattaggagaaatgcatcttaaaatgagatgacaagtttacgcttcaggcttgttttcatgaattgcaaaaaatcattttagaaaaaagaaaaagtaacctcgaacactgtccccagacactcttttctattattgttcttttcatttctgtttggttaggggcttctctttattttcatttatctcttatcactgcatttaccacagtacatctgtcccaagagaaacagataactcatcccttttatcctgggggaagaaacctaacctcctcttacaaatgagcaaaatctgtaaagaagctaatagatttaatcaaagttaaataataaatgctttgattagttatattttatcttggcagtctaatacacatatgttaatatagcatatactcaaatacacatatgcatagaaatcttagacaaacattctttatcaaatatgtgacactctcaagaattaaaattatacccaagattcaaaagtttacaagctattggaaaaaatgagtgtctgcttaatttgtttttaagaaactaaagtaacaataatgttttaagaatatccagggattcatttcagtttgtggcattattttacttctaatggtagtttaaacaaaacttttctaattagactaagtatgttcattctcttattagtttttctttctataaacaaataactatttccagactcttaactcctctgtaattactgttgctcaagaaagctccattcagaatgagattacaagaaaattatagacataagccatacttaaagttgtttaatatgtcagttggaatagcttatgctctgtatttaatacttagttagtggaagatagtggatgataccattttagttataactgagagtattaaaattagtttacttatgtgttttcacgaagaatgatttttggaagctaatttctgtgaacagtatttctccctttaattaacatgaaacagagtgtgttttgctagtgtgttttttatttgtctacaaactctttcgataagtatcatgagatacaaataattgtttttctcttcaatacaccaatcatcagggcaaattttgtagtttagaccaacaaaatattggacaatctactatatcacatatattattgtcaattgtatgttttttttttttttttttttttgagacggagtctcgctgtgtctcccaggttggagtgcggtggcgcaatctcggctcactgcaagctccgcctcctgggttcacgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgcctcggcctcccaaagtgctgggattacaggcgtgagccaccgcgcccggccaattgtatgtttttaaattcacattgattacataagtgttatgcaagagtttggagaattccaactatatcatcaggtctatatctatttaatgttgtatcattattatttcctgccatatatagatgttatgttactttaaaaagttacatttattacagatataatattatgtatgcctcctactttcaccttcacaaatacataaatgatgatcttgaaggtggtaaccaatatctaaaattcacttggaaaggcatatttttaattcaatgtattaaaaattagaaaacatctacagggaacgtttgtcatgctttcaatcatttatatctttttttgtttttaaaatttgtttgaatttagcagtaatatgcttaactgagtattatataaggaccctcattggaagttgaaatgccagtcttagtgttgctcaccaaaaaataaaaaataataatcagaaaataccaaaagctagtttacaagattttctaacaccatccctcaaactcaaaatagtacaaaaaacataaataaatgtcatccaaatgactttaacctgggaatctggtatcattttaaagattgctcacatgattacaaaatttaaagcataaatcaatacatgaggcaagaatgaactttgtgttggtgatgactatgcccaaaatgcattcttactttaaaggtacatgtgcatttaagaaaccctttgtgcatatataaatatatgtgtgtgtgtatatacatatatttatatatgttactttgtaaagtaactacctgatatttctgaatatttctcttttgagaaaatcctgaacaacagcagttctaaaatttccacctagtatatcctcagcatcctggtacattatctttatggtgagtgcatatattactgtgatagatttttctaggcaggaagatactctaaagtgtgagaattttcaaagattgtgattatgaaaggaagttttggacgtgatgatagtacagtggtcctaaatgcgtatggagagatagctctgatcatacaaatgtcatgttactaacagatccttaagcccaaggctttaaactattgcaacatggtctggatggcacataaagctgcgtttccttggccacactatacactagaaaatagtttaattaaaataaattgcataattgcatatgaaaatccagacactcaatgttacctaaaaaattggaagatggaaaaaatagacgtagacttctgcaaagttgctaagtttaaattctgcacagtctccagagcccccattatttctcaatcagctttaattatttatttacggtattttatggacacttagattcttatgcatttatgatcccttcctgaaataactgtggtgtttacacttaatatatgcaacctgacacgcacgcacacacacactgccatgcacacacgctattatcattatatctgatttaaaaaaacttcatacacccccatttacaaggtattagtggaatatacttttttgtttatttgttttgtttgtttttgggctctcaatctgtccctgcagtaacacgatcatatctcactgtaaccttgaactcctgggctcaaaccatcctcccccatcagcctctggagagtggtaggacttcaggtgtgtgcccttactcccggctaatttttttattttgtctattctgcagagactgggtcttgctactttgcccaggctggctttgaactcctgacctcaatccattcttttatgttgacctcccaaagtgctaggattacatgtgtgagccaccatgttgtgccggaatatacttttgaaatgcatgatgagttgattggtgtgggcaacagtatgaaattcatttctgcttcaattctccctttcactatacctttatcattattaaaactgcaacttcaaaatcatctgtaatatctgatttcatctttgcccatgggcatcacattagtgagtttctagtcttaagatttctacttcctttcatccacaaaagatccttgattttgatttatttcacccatctctgacactggaaaggaaaatgaaagtttcttgctgttaatttaaatgagattttgtacttattaatgatgtttttataagataaatatcttgctgaatcgtaagatagtagacttttcatagtttagaaagtttcactgcatgctttatgagcagtaattaaaaacttgaacctttcaacttcagcagtaattctaaggggaaagtgttagtttttaaagtaattattgtctaattagacaagagtgttaataaagtggaagaaaattataatttatatttccacatatgctttgttcaatcttttgtttttgttttttaaaattcttcttaaggtactttttgtcactttctattaatttagtcatttcaacaaaaatattaaaatcatacttagtggctatgttcactgctttttaatgacttttctatgaagacatattaaaatagacattattttaggatagagagggctttgccaatattagtatactcagacatagggatgaaatttgagaaaagattagtttaattgggtcacagaaataaaaacagccccagtagtttttgttgtatataaaccataagttttaacttacaggctgagatttggttcttattttccaagtatattagaattttattcttatattttataagcatatattttatctaagttcgacgatttaaaatattattttataataagtatatatttatgtacaaacatctccatactctctgtgagaatttacaatattcatagccctttctccaacaataccttaaatgtgtcttaaaggaaatagaacttccttagaatttatcaattatcgatccttgcatattcagcaaatgctgcaggaataagtgttaaaactaaatttcatatataatacagatttgacaagaacaaattagctttaatgtaaataacaggacattttgtgaaaatgatacgtttctttttaaaattcattcattcaaaacatcaatgctaatctgggctaagctatttgctgggctccgggataaaaagctgggataggagcttggctaataatgattcctcttctcaggggcataaagtgaaacacaaatattgccaaagtacccactgacaagcaatgtaattataaactgagatgtgttcgctgaatacaaaggaaaggctaaggattatcgcaaaatatttgacctatacttgggggaggaagtgacttgtcagagaagtcttacatgaggaacaaattcttaggtcgaaatatgaaaaaggagaaaatgcctaggcagaaataactagctaaaaataaagtaaaatgaaatttggttatggtaataaatagagagagttaaaaattagatcagattgaaaaaaaaaaaaaaaacaacatgaaaaggccttagaattaaaaaggtcagaatgaaattatgtctttcacttataaaatatcttgccagggtgtgttgggaagtaaatatttttcattattgacttttggaaaattaataagtagtaaagtattcctaaaataatccccatccccaagggacatataacaacttattttaaaagtatggaaaaatggaaaacaatcattagaatgcccataaaatttaatgtctgtatcattttaataggatacaatattatacaggcagtttgaatttactatataatagcataatctaatatttaatgtaataaatttaaaaatttaagttagaaaaaatgtactctagtaatgaacgtaccatacaattagcattgacactaagagagagaacgactacttttcagtttggtaattttgaaatgccaggatacactataaaattaggtatttgtaggaagagactaaagttcttagtgtattattcgtgaagcatagtctttgtgagtaagacaacttattcaaattttatttgcccctcaaacataaagaaccaactaattgtaatatcttatcatttacagataagacagagttttacaattataaaattacacacaattgacccttggacaacatgagtttgaattccataaatctgcttatacatgaactattttcaataaaagttacagtttcctagaaaaataaaactcagctttacattaaaatccagtctctaagaaatatgacagtgacctttatggatttgtgtcataaatgaagggcttacatgactacacaattagttatttttctaagtcaaattatccatcttcacattgtgccagttgagaaggttgatcatttctttaaccatgtagatttataagataaatggtaaaagcttaatatatatcaaatcaaagcttagaaatatttgtgaaatgcttccttatatggatgtctttctgtattagactttgagttactgtttttgagatgatatttctgcaaacgttctagactatacatttcatacatgattttcatagtataaattggtaaagtacaaagagaaatgaaatggaacagtctaccatttggttttaaagttattaaagcatatctaatgatttcaataatatcaacatctatcatactcaaaaaatattcaccattagcattatttttatcaacatcaaatgtacaaacttagttcttgagagaattttactgttttaaaattattgtaaatgaaacagttgcagttcagttggccgaagaccttacctaaaaaatcctgcaaagaaagtaaaaagttatatgtatagaatgttgattctgcctctgcattgatatagtatgaaactttatgatctctggttagacttcatataatgtgaagtagaaaataaagtgtagaaaagatatgacatatgaaatatgacccctctgataagaagaggggcaatggaggataaacctagttttattcattctacttaaacatgtcacctggcaaagtattaaagtacacattttctactctattcgtgttaaataaatgttgtaagtacatgttaaaaagtacatattaaagctatatagaaaacaaatattttattaatgacagtttgtatttcccaatcagtatttactctagtatccattacatacatattaatatttaaataactattaaaagttatatgttggccgggcacagtggctcacacctgtaatcctagcactttgggaggccaaggagggcagatcatctgaggtcgggagttccagaccagcctgaccaacacggagaaaccctgtctctattaaaaatacaaaattagccgtgcgtggtggcacatgcctataatcccagctactcgggaggctgaggcaggaaaatcgcttgaacccaggaggaggaggtcgcagtgagccgagatcatgccattgcactccagcctgggcaacaagagcaaaactccatctcaaaacaaacaaacaacaaaaaaaagttatatgtttccttctattaccaactatatctaataaaaatgacatgcttggatgaagctggaaaccatcattttcagcaaactaacacaagaacagaaaaaccaagcaccgcatattctcactcgtaagtgggagctgaacaatgaaaacacatggacacagagaggggaacatcacacactggggcctgtcgcgggggtggggaggttaggggagggatagcattaggagaaatacctaatgtagatgacgggttggtcggtgcagcaaaccaccatggcacgtgtatacccacgtaacaaacctacacattctggacatgtatcccagaactttaatttaattttttttttaaatgacatgctttaccaattaattttacattgtttaaatgcaagcagatttaagaaaaaaaattaggaatgtagatactacctgtttgctatgtcattaaacatgtgaagtcattttttaaaattagaactgttatgaatcttttattctaaatctgtcacctacttaaaagactattatttaaaaccttatttcctaccaagctatggtaatggcaaaagcaagtaaagtaatatgactgagttatagctcaaaatttgttcaatataagaaacagaaaagttgtaactagatttataagaaaataatttattgtatataattgatcatatataaaataaaatctcattatttagtatttaaattacatttcttttcaaaatataattaacaatatggaatgcaattgttttacaaagctcatttagattgttggcagaattcatttctttttggttatatgactgagggctgttgtctggaggccatcctctggtccaagaagtcacctggagttccctggcatatgtccttctccaaaggcagtttacaatacgtttgcttctttacacagagcaggaagatttatctttctccaatgtgctaagactgaatcttatataacttaattgaaacaataaagtgatatcttgttacctttatcatattctacacattagaagcaagtcatagattccactatctatggcaatggtccccaagtttgtggcaccagggactggtttcatgaaaaataaatttccaccgacctggggctgggagcaggagagtggtttgggatgatttaggtgcattccatttattatacactctatttctattattattatattataatatataatgatataatcatacaactcaccataatgtaaaatcagtgggagctctgaacttgttttcttgcaactagatgatcccatctgggaataatgagagacaatgacagatcaatcatcagacattagattctcgtaaggaacatgcaacctggaacccttgtatgtgcagttcacaatagagattgccctcctatgagaatccaatgctgctgctgatctgacaggaggcggagctcaggcggtaatgcgaatgatggggaggggctgtaaatacagatgaaactttgcttgctcacccaccactcacctcctgctctgtggcctggttcctaacaggccatggaccagtactgaacccctgatctatagaatagtattatacgaggatttgattcattatgagctactttaggtgtgactgtcacactctgttagactgaaaactctatatggactattatgtatttattattaattcatttagtttttctcataaagctgtagccactgcatcttataaagtgcattatccagaatcagtgctcagtaaacacttatgctataaatgaacaaatgaatattcttaacttttattttttgttcaaattttcatctgtcaattacagaagaataaaatggattttattgtcctaattttaaactgattctcacaagttttaactagtttacccttatatagccctccaaaagcaacataactaggaatgcaatgcaagactctctcatgccagagccaggacttttattatattacattatacaagtcactgacattttcatacttttacgtttagtctctgttgactgacttaatacttttggattttttttgctgatggatttgccttaggaaaatactcatttactcattaatttatttgtgtttcttagaatctataatattcatcaaacaagaatattaatcagaatcatttttctgtgccaggtaataacactgcacagaactctctttcaagcttcttttttaaaatgatgcatgcgtttgcttgagcattaaaactccattttaaatttacttggttatatttttaagctaaacactccactgatgaaataatgtttgggcttctctttttatatttccctttgcttgctcctttcaaactaagctttttcccatgacttttctaacaaatagtgagaaatgtatttatctaaaagactgagatttagatgaaggttctgaaaacatagatggaatggaaacctcaaaaaaattggcaattaaaacttatttatctcctaatttggagttattttactaaagtaccttgaaatgtatattaggtaaaaaaatatgaaatgtagtgcatgctcaatagcaaagtcattgtgaggaaatggaataatttatttctatagtagaagcttagtgtctgatatgcactaaatataaaataaatactaattgagtaaatgtatgtataaacactaagaaaatatccaatataatagcaatagtaaacatggagattaaatttccactcatttaaaaacatttttggtgtatttatattttattaaaccaactagtatgactacattattataacatttggcatgtatctattatagactaaactgaatattagtttttttccatgaagacacaatctttaaacataagcagattaattatattggtcagtcatttattttcttgagaagtagtattccccaaaaagaaaaccagtgttcttccctcttttatttaaagttctattattaaaaccagaatttaataatgaatagactcaacagacatgttaagacactgatttgaattctccaagaattcaccatagctgtagtataagaatgccagagcttggacttaccttatgtgtttcatgtggtttcgggaaatatattttgggttaaattagtctcatctaatgtttacaactgttgattatatatttaaaatgtttaaaactgaaatgaaagaccttgtaaatgattgaagtgatagcaagattagttcttaataatttatattcttaattttaaaaatgattttcatcaattttattttatcccacaatgtttaggatgaatctatatgttgagacagagtgcacccaaaaagcaaattaacattttctttttatttgaaatggaatctgtcttgctctgtcgctcaggctgaagtgcagtggtgcaatctcaacccactgcaacctctgcttcctgggttcaagcgattcttctacctcagcctcctgagtaactgagattacaggtgtgcaccaccacacccagctaatattttatatttttagtagagatggggtttcaccaagtttgccaggctggtctggaactcctgatctcgagttatctatgctccccaacctcccaaagtgctaggattgcaggtgtgatccaccgcgcctggccaaattagcacatattttaaatttggtagtcaagacacattcagatgtagtagcatgttaaaaaaaactgtaagcccgagcaaagatctagtaagccgaatttagcaggaccgggtgggagaggtaggttggacctcacagtgtcctataaaaacattagttactttccaaacttacctcaaattagctacaacggaaccccttgaatttaaattgcaaactttaaaaaagtgggcgataatatcaatatcattgatattacctatcattaatgtaaatttaaataaaatatatacttctttatataaattgtatatgtgactatgtaacataattttatatataaatatgtataaatgtactataaaattgtcaataaatatcaatatatttttatagatgaatatatgatataaacttatacatatgtatatttagtaaagaaaaatataatatgatctagaaggaaggaatatatctgaaaggctctctgaaattttattttcctaaacttcatattacacattttaaaaaaggaacagctgattcatctggtaatgctgaagggtgataagtaccctctgtactgatgaagacattattaatatttaccaccatgctgaggtagaagacaggtttctctctagtcatttaagcaaattgatatttagtatggtaagatacagtgactttggaaaacctcatgtttttagtttgaagctgaggttgctttgaagggaagtttgctttattccagcaggtagatagcatacgtttctcacaaggaatacaaagcagtgacaagttttagttttgtagctttatctagatattgttacagatcaagaataacagtaatttggctgaaccaactgttgaagggcagactgcatacatacagctcacttcactgtgagactccagcttgcttcatggttgtgtattggtatggggtttctcatcaaagtaatgacggtgtgttccaagttttggtatctcaagaaagttagtgtttattcacatagcagtcagagacataggctaaaaaatagttaacattgtcaaaattgtatttaagagaaaactgctgtggtgtcaaccttggctgcttttgccatgtgtcactgcaaacacccaagactcagggagcagggataaacagaaaaaggacagacctttgtgtatttccagactttggatttatatttgaaagtgaaaggcagtgaaagacctttattctccttccaagagatggacagaaatctgtactcagaatagtagataccatcaaggatgctgtcagggttgtcggaatagttatactttcattgtaaagttctcattcagttattttatcggatagcattttggttgctttgtgtaatctcacttcatttactgaatgaaaattattgtaaagtgacaatatacagttttgaaatgctagctgctattttcatgtcacttattacattttaacattttatataacttatttatgtttgttattggtctatctttattttgctggaatataacatccatgggagaaaagaaatgtgtcagctttgttcactgatattttccaactgcctagaagagtgagtggtatctagtagaccctccataagtacttgttgaataaattaatttttgagaacattgaatgccagataaataaatatgagatttatcttgcaggaaatacaaatgatgtgaaattcaaaattagtatgtttgtcttgaataattgcagtaaaatattcttaagcctaaggaaattgtgtcataaaatgcacatggaatgcaaaccacttacgtgtaatattatactgtaataggaaaaaaacacttttccccagtattttgacaacagaatactatttctaagtcacgattgcaaaatgataactttattagctatattagagtactgaatacaccaatttaattatctcttaaaaaacaagtataacatatttatttataggtcacctacaattctttttagaattgaacatgctttggatttttagaacataacattattagccaataaattctgtaggaaaaatatatactcggggaacatggaaagagtttgatgtgggatttgtagtaaaagtaaagtaccaccatagaggtgttgtttgacaggcttttcatttacctacagtcacttagcaagattatggaattcatctcctataggactttctcttttaattctagagattaaaaagctagtaacaaaaacagtcttttgtctaaagcatttgatctcttccaattaatttgatcacaatcacagaagtgccactataggctgtcagttgattggcacaatattgtactaaacatcttggtcctgtagtcatttacacaatctctttgtgggaggtaccttttcattatatctttgtttagaaactgggttttctcactaagtcaatatgtgttctgtgttttggggtatcgggttgatgtgatgagtcatagctttctttcaggtctctgtaaatattgagcccattgaagtgatgaaaatttctttggaaatcaggcagatatagatgaaagagtaaaaaaactatagaaattgttattattatcattattcaaagacaaataagtataatatttcccctaaaattatctccttcctctgggcagtaaatgctatatctattctaaatagattttttatgagttttgtctgtgatgctttcagaaatatgcatataatcctctaaaaacttgcagagccatagatcaagaggttttgtttctggaggcataataatggcagtgacattaatgattttaaaataatgatccatcatgttgtttttatattggagactgttccatgaaaccaaattagcttcagttaggaataaaagaatatgccataatttgtgaatgcataatactataaactactataaaggaagtcaagctggcagatcaaggacccacacaggaacacaactatgtccttttgtcctttgctaagatattaccgtctctttaattttgttttctaatacatatcttttctggtttgtattaattttgttttccaatatatatcctttctggtttgtatttgtatatggtttctctttatatttttaaaatttaaataacattgttttatttcttaatgtcatgtttgtttttccaaataaaaaaagatttgaagccattgtatatagaaatcttagtagagctctaatcctttgtgaagggggttagaatgtctctctcagagtttaagggaagcaatacagcaggctctcctgggcctccatatgccttgaaaacttctgagccctgtgttttctgggaatttttccaatacttttctctaatggaatgagcagaagtgtcttactcacagactttatggtctcttcagacactcaccagtttataaccttgagccagtcacttattctctctgagcctgacctttcctccacaaaatggggataataatatctactttccagcccttgctaaagatagattgagtaaatctgtatttaagactttggaggttccatagatgctgagtcttttatattaagctttagggggtactcatattaagctttagggggtactcattctgtaagtacactgcattaagcacgtatttatattcccttacgtatttaatgtttaagacaatcttatgaggtaaatactattttatatccattatgataatgagaaatgtgagacaaagatgctatttaatttcttcaaagtcatataactagtaagctgaaaagcttgaatttaaaaaaaaagccacattcttatccgctgctctacacaaccagtagcattggtcaattttatttttcttttttctacaggttagtgtggattgtgatgatctcttggcatctaataatgagctcttctttgggctttctgtccctagaaattataaatgcacgcgccaagcactttgccagttaggaaaaaatgtggaaggcccagttaaaaagaaggcagctccttttatatcttagataaagaaacaaagaagaatagacttcatattaaaatgtgtgtgatctagagcagtgatcttttaaagtcaagaactgtgtatcccattagtttaaaaaaagagcttacacctttaatacaattttacaatgcaatatatatatttatacatgctgctggacaaataaacattattaaatacttggcaataaatcaaaaataaaatgtagacaaaagcagaattaaaatcgtgcctttgtaccctctgataaaccttatcctcagctagtctagtagagagaatcctgggcagaaatagaaaactggagaacttgagacatcaatattacctgctagaagcatttagtcttataaagaagattgcacaatcatgtaaacacttggaaatcacatgaaaatttggatttctgccttctctttgaaaatcagaagacccagaaacactggcttgcattgccacatcacaaccactgacagaagttgagcaccagctggtctctttagaaaaccttgcattgcacagtttatcacagcctctaccatcactattgtcccctttggctaattcattcttttcctttgtctgcttgtcctctgtaggcatttgagtttggaacctctgaattagagaaacagtgttccaatccctagtctgccacaatttataatcaagagcattttgaacaattctgtgtggataatttcctaaatttacaaagaaactgaggatgtcattctttcaataagacattctcatgtgctcacaggccactaatttctcaatcagttgttttctttcttttttttttttttttaacttgctggggattgaaaagtaaaacaagagaattaaaatgaaatgcatccaaatgcttcataaagcagatgtagtgaaaattgacagattttccttagtctttcctggcatagttaagtcaatctctgatcactctactagaaaggaattaacattttaatgatgggcttttctacttaattgtataagacaaattttcattgaaatgctcatgtaggatactaacaactggcttactatcttacactttgttgtaaaattatgctgtagacaacataagtttagtaacttaaactgattaacattggacttacccataatgtcttaaattttaaagagtgtgcttctgatattattagtatgttaacttctcaacctacttgctggcaaattaaataacagaaaagatgtctttccttagagattacttgtctgcaaatttatgttgataaacagttccagtgcattaaaccagtgtgttactttgttaatggataatgtggcacaggtaattaactatgaagtcattaaggcttttctgtgctgtgacaattgtgtttacctataacagattaatgaacatgtcaaatgtttctttctaccttttcttatttcagatcagctttgagtgaactttgacagaagatgtttcgacagttttatctctggacatgtttagcttcagggatcatcctgggctctctctttgaaatctgcttgggccagtatgatgatggtaaggttgcttttagcttgacctttagagcgagccaggatttttattattacattgaaaatataccacagagatgaataatgctaatttgtagtttatgattgaaaggttagtatctctgtgtaataattaaccttaactaaaataagcttagaaaagtgaaatcagatgtcctttgtttcttaataaagattgcagcatggtagaaggaatacagtttagtacaaaatttaatgcaagacctctgtttgaatgcttattctaactaggtaaatgcttaatttctgtggaaacaatattaaattgtatttactaacctttgaatatatgcaaacaaaggtctcaaacaaagctagaaatacaaaagacaacaaaatttgaccccctgaaagggtcagaagtagcagccataagttgttttggtgttggcactttaactgggcattgcgttattttatcccccactattttttttttttgggaagaatagaaaaatgaaaaaagatttggtattttggtatttgatttggtatttgatttcttaagctttcccctaacagtaagtcagtcattttagaaagattcattaattttcaggttccttagaatccatttagtacatgatgtttgcaatggcccaattgtgcctgtcttagatatttcaatattggcagaatctgtcttagaatagcctataatgacagttaggatatatataatatgttatatatatatttatatatatataaatttgatagaagacaaaaatggaaaatgtttcctccctagaaatttcctattcaagaaaattgagttttatttctttcctgtctttcttttcttttaacttttcctcgttcttattcaagatttgtttggcattcatgatgcacagacaagcaaactggttgctcttaacggcagcaaaggatgtgcatttattttgtgctttgcttggctaaactgattgatcagaagatagatgaattagtctggctttttcacaaacaatgttcaagttgtgcatatattaagacattctcagtcttcaataatgtgagagataaacttcttttgggatttgcaaaataattcacaatagtatattccctttcataagatcggcagcatgatctcttgaacactgctgctagttagcatggtgtttacttcaagtgcatctgaacttaacttcacatctttgatatttatggagattgtgaatctgcagcctaaaaatgatttttaaaagcagtatgtataaataactgctattttgaaggaaaacacattgaaatgaaaaagagttgtgactctatagttcaagagctcattttaaattgtgccagaggagtagattggaaatcaatgtattggtattactttatataataaggcattctattttcattcttattaagtgttcacactgagcaggaaagtattcactgtctgtcttttttcacattagacatccacgaaccatgcactttttagtaatgtaattttagttaacagaggaaatcacttctggtttaacctgtaatgctataaattggttttcttcgtaagcttgttgtagctcttagtcttataaatatatttgcattgcctctaatatgagattatcaggtcattattgggcattgcatagtcaactttctgaagcccattggaatttcagacttgccaagtgatacagcacagtggagctgactttaatgtactatactaacacagtttatgttgtggtttattttgttttgaatttgaggatatatatgataataaaaagtacaaatggactgggatgaaatggtgtctcatttttgttgtaacttgcatttctctaatgattagtgaggttgaatgttttttcatatgtttgttggtcacttccatttcttcttttgggaagtgtctgtttacattctttcctcacttattaatggagttatatgttttgttcttgttgatttgtttttcttatagatttcggacataaatcttttgtcagatatattacttgcaaatattttctcccatactataggttgtctgtttattctaataattgtttcttttgctgtgcagaaactctttggcttaattaagtcccatttgtctacttttgtttatgttgcatttgcttttgaggtattatttataaattatttgcctaggccaatgtctaaagaggttttcctaggttttattctatgatctctatagttttaggtcttaaatttaaattttcaattcatcgagttaatttttgcatatggtgagagataggagtgaagtttctttcttctgcatttagcaagcaagttttcctagcaccatttattgaatagggtgacctttccccaatgtttaattttgtcagctttgttgaagaaccgtggttatacacatgtgattttattttctagtttccctattgtgtccatagatctatgtgtccatctttatgccaatgccatgctgagttttgtttgttttttattatagccttatagtataaagtcagataatgtgatgcccccaacttcatctttcttcttaggattgctttggctattaaggctctttttttggttccatatgtattttagaatttttttttataattttatgagtaataaatttggtactatgatagaaattatattgactatgtagctcgctttgggcagtacagtcattttaatgatgttgattcttccaaacaatgatcatgggatatttttccacttgcttctgtcatgtagtatttctttcagcagtgttttatagttcttgttgtggacatcttttacctcattggtctcctttgttaaatatatttctagatattttattttttgtgtctattataaatgaaattgagatttttatttggttctcagtttgagtgttgtcgatctatgtaaatgaaactgattttcaagcatttattttgtatcctgaaatcttactgaagtagtttatcaggtaaaagaatcttttggaggaaatatcaaggttgtctaggtgtaagattgtcattagcaaacagagataatttgacttcctctttttcaatatggaagacatttatttattttccttgcctgattgctgagagtggccatccttgtcttgttacagttcccattcagtatgatattagttgtgggtttgtcatagacggctcttattattttgcagtatgtttttttcaatgcctagtttgttgagggtttttatcatacagacatattggatattattgaatgttttttctgcaggtattgagatgatcatatggctactgtttttaaaattgtttctgtggtgaatcacatttattgatttgcatatgtttaactatttgtgcatccctggaataaaatccacttgactgtgacaaattatctttctgatgaactgctggatttggttcactagcattttgttgcagatttttgtgtctattcatcagggatattggcctgtagttttctttgtgtgtatgtgttcagtgctaggttttggtatcaggatgatactggtttcatagaatgagttagagaggagtcattcctccttaatatttttattagtttatacaagatgggtactagctctttctatgtctggtaaagtttggctgttaatctgtttggtcctggctttttttggaaaatggattttttattactaattcaatttcataactcattatatgtctcttcaggatttcaatttcctcctggttcaatcttggctggttatatgtttccagggatttattcatttcttctaggttttctcgtttttgatcacagagatattcatagtctaccatgattactctctgagaatttacatagactactctgaatatattttgtatttctgtggtatcggttgtaatgccacatttttattatttctgattgtgcgtattagaatcttctctttttgttccttaattaacttaaatagcagtcttatcaattttatttatcctttcaaagacacaacttttgctttgttaatctcttgtttggtttttacagtctcaactccatttagttctgctctgatttttgttatttcttcttctagctttacatttggtttgttcttatgttcctagttccttgatgtatgatattggattattaatttaagatatttttatctttttatgtaggcatttagtgctttaaactttcctcttaacactgctttcattgtatcccagagttttggtgagttatatttctatttttatttatttcaactttttcttatgtctgccttaattttcttgtttagcctaaaatcattcagtagcaagttgttcagattccatgtacttgtgtggttttgagagtttctcctgatatgtatttttttttttttttgagacagggtcttactctgtcacccagactgaagtgtagtggtgctatctcagctcactgcaacctctgcctcccagattcaagcgattttcctgcctcagtttcctgagtagctgggattacaggcatgccccactaacacccagctaatttttgtatttttaatagagatggggttttaccatgttggccttgtgggtcttgaactcctgacctcaaatgatccacccacctcagcctcccaaactgctaggattaccagcatgagccactgcacccggctgatatatatttctaatgttatttcctctgtcatctgagaagataactggcataattttgatttttttgaaattattgagacttgccttaagtccaagtatttggttaattttagagaacgttccatgcacagatgtgaaaaatgtatactctgtggttgttgcatggtatgttctgtagatgtctattacatccatttgatcaagagttccatttaagtctggagttactttgttggttttcttttgccttgataatctatctggtgctgtcaccagacagattatataactaatagttgttaaatacttcagctgttattgtatgacttgtttcttttcttaggtctagttgtttttattaatctgggtgctatggtgttgggtgcatatatttaggacagttaaatcttgttgaattgtatctttctttgtctttttttttacctttcttgatttaatatctgtttcatctgatacaagaatagcacccctgatctttgttgttttctatttgtgtagtacatcattctccaccctttactttggggctgtggatatcattacacagtaggtcagtcccttgaaggcagcaaatggtagggtcttgctttttcatccaatttgcaaaatgatatcttttatgtggagcatttaggccattttcattcaagattaatattgacatgtgaggttttattcctgtcatattgttgttagctagatactttgtatattcaattgtgtaattgctttatgggatctgtgaactttgtacttatatatgcttttctggtagcaagtattgtcctttcatttgcatgtttagaagtcctttaaggattttttgaaggaccagtctatgggtgaaaatttcccttaccacttgcttgtctgggaatgactttttttctactttgtttatgaaattaagtttagtaggttataaaaattttggatgccatttattataaaattattttctttaagaaggctcaaaatagacctctaattccttctggcttgtaaggttgctgctgagaagtccactgttagtctaatgggactacattttatagatagtttgatacttactgtttaagatttttttctttagtattgaccttggatagtctgataaatttatgacttagtaatgttcatttgtataatatcttacagatattctctaaattgtttgtatctggatgtcctcctctctgacaagatgaggaaaattttcctcaattatttcctcaattatatttttcatgtttctttctttctctccttcctcaagaattcctctaagtataggtttggttgctttccattatccaatatttcttgaaggatttgttcatttttaaaaattattttttctttatatttgtgtgacagggttaattcaaaaaaaccaggcttctgaatggtctagtgtattgttaaagctttcaactatgttttgaaattcctttagttactttttcaatacatgaagttctattttctaatatagctattttgccttttatatccttcatcatttttctgattgaaattccttgcactctgtattttgaattctttatctgtcatttcaggattttcattttggttagaatctatggttagagtgcaagtacaatcctttagagatgtcaaaacactctactacctttttgtactgctagagttcatgcattgattctttctcatctaaaggagatatcacttcttatttttgaattttctatcatttatttttcctttagaggattactgtgatttatgttatgatgtgtatgatatgctttgttttggggtgctttcagtgtgccaaagttctttatgggttccttgattgtgggtaatctttgtatggtggttttcttgaatgttgcctgttgttttgatgtgttagatgtgtcagctgacactatctcctgcgaggctgagagtacagaggtctcaggaagcttatcttattcactagccctgtgcctttctgagaacaggtattctattttactctccagtccagtgatggcacttaagcataagagcctgctcattctctggtagctcagtaatgactggaggcacccaccctgacaggtgtagctggtggagatcctgttgggctgtggcaatgtttcaatggaagagcgttggaggcctataccaggtcctcatcctgggcagacaggaatgtgatctgcttccctatcatgccgctgttgcattttgctcatgaccttcagtttaaatatacattgtcctttgactcctggccatagtgcagctggagaccatgggtatgcccctccggcagctaccaacaaaatgggctcagggcaaatcctcttccccaagttcatgacagacaactttgtagcttgtctgccttcagttgctgggatgctatttctttgtatagaaggggagagatgggtcttactcttcatggaagcctctgtggcaggggcttactttgaatggaggtgtagctgttgtgaaaaccactggaaaagtttacaccaatttcacaagggctggcctttaactggtagagcctctgctgtgtctgcaagagtagatgggaggagcagaagatgactacctctccatatccattcccggctgccggtgccactcccttcagtgatctgtgtcacactacatttcctttctctcaaggcaggctttggagggctgtctgtgcacccccattccccaggggtaggtcacactgagggctagattaccagggatccacagttcctcagggatcctctctgtttccctttgattgtggatgtcagagcaggttatggggtatgtttgcaggggatcttgtgatgtggtgactcaatgactgaggttctacaggcacagcagtggcccactatgtgtacacaactagtacggcacttgacatctcagttcaggcctgagaagagtgtgggcacccctgtgtgagttaacaacatggatttctgtctttgggaattttccaaattgccacggacatcattgcccaggattgtgagggtagaaggactctctaataattcgatggttagcaggttgttgccagggtgaggggaacagagaagcacccccacctatacttttttggggtctctaagttccttgggggtcaatctctgccagactcttcctgctttctttttctgtaccctagcttcttcttgtgggttctctgacaggtcctggctctcatctgactgtgtttcattcagatcattaccattcacctgtaactttgatctttccgagaactagcatcccaagtcagtcaaccatgttggaaaaacaaagaaataaacaaaaaccttgactgtatgtttattctgagaagttaaattcaagttttaatagtaactacattgttttcgttagatggcaaaatccagagattttgtcttttttattggaagctttgtaagctattacatgtatatgtacatatttctagattacataccatatatgccatttagaaagggatgacaagaaataccattgttactttcaatgttaactccaataatttttttctaagcaatctcaatgttatcttcatatgaaatctcagctatgtcttttcattaggttgtaccaagactagcatttcttgtcttcatgttttcctgaaggtgagtaatcttgtggatccttgtgtctccaaaatggatttggttgtaggataacagtttgaaagcatatatcttttcctgctttagaagaattttctggtaatcaggttcagaaatacaaactctgtgacttctctaagttctgaccttatgccttgaaggattacttcaatagcttctccgtattccagtaatagactctgttaaagccatgtgtatatcctggaaagcaacagaactaaaagagagagaagaaaaaaggtactgataaatagaagcccatttcattgtacttagaagattctctttctgctaaaacacacacacacacacacacacacacacacacacacacacacaccccaccacacacacaccccttacccaaggatgttatttctgaggtaacttacaatatcccagtattggtgctcagatgttctttctttctttctctctttctctctttctctgtctctctctctgtctctctctctctctctctctctctctctctctctctctctctctctttctttctttctttctttcccttcctcccttcctcccttccttttttttgacggagtctcgctctgtgcccaggctggagtgcagtggcgcgatctcggctcactgcaagctccgcctccctggttcacgccattctcctgcctcgggctcccgagtagctaggaccacaggctcccgccaccgcgcccggctaattttttgtatttttagtagagatggggtttcaccgtgttaactaggatggtctcgatctcctgacctcgtgatccgcccgcctcagcctcccaaagtactgggatttcaggcgtgagccaccgctcctggcctagatgttcttatttgtcctgctgagacagggaaaagaaagaaaaggtctaattcagagtccaggcaatgcatataaaatcaataatatccggtaaggtggatgcttgtctttgtggttctaataatctgaaaattttagaacgattgaaaaatgcccacattctaattgtatgaaaaagcagaactcattttaaatgttcttcatagaaatcgaagttgagcaaaaatgtaattataaacttgcttggctctgagtcatcaatgacttatacaattcataatagagtttttctttagttagatgttctgtcaaatctttgtatctgttgctaccagttcttcaccaattcccttaagctctgcaatttggtttttcttgtaactatactgaaagtgcactctctatggcttccagtaactacttccttagacaagtactataattttgtagcatttcagcaaacagcattattgatttacctttcctgcaactttctttttctcagaggttttttactgaccttttctgagtgtcttcctatcagacttctccatcttctggtgaacatagtactttttacttttgtctgattttgaaatttccccactctcatttatttttccataaggggctgtatcctataataaacacattttgtatattctgaacaattaaataacatcatatcctttgtaactgtcagctttctctaacttcctattatttaacttgctgtccactggatgtggttggtggttaccagaagctggtgggtggagtgagcaatgaaatgggaaagaggagatgttgatcaaaagttataacatttcagttagaggaggaataagcttcagtgatctattgcacacaatggtgacaataataaataatattgcattgtgtgtttcaacattactaaaagaatagattctgaatgttttcaccataaaatgacaagtttatgaggtgataaatttgtgcattagcatatttaatcacaaagtaaatgtatatcagaacatcacattgtaccccaaaatatgtaatgtgcacaattatttgccaattaaaattttaattaactaattgactaactgttaaaacattttggagtagagataatcagaaaatgtttgcaggaagaattttgagttttcaagttaaggaacttgagaagcatatggaaatttcaggaaaaatttgaataacactgagttggcacttttaagatgtgtatccgtttgcagcaatgatgatcatacatgctgtgctatgaccccaatcgcacaaggttaggtattaaaagaatccaaaggtaacaaaatagcatgtactggacagttttgatcccaatccagttttctaaaagtatacaatagcagaagtcattacctaagttttaaaatatcctcaacagccattaccagatgctaatatacctactccaaactttgagaagcagtagaatgtggtggttaaaaatacacaccttcagtttggactgcctagatctgaatcctggctccaaaactctgtagctctgtggctatagtaaattactcaatatctctttgcttaaatttccttgtctataacacacggctagtaggaatacttacattataggaatattatgaatgtccaattatttaatgtaaggggtttagatgaataatggtcacgtggatactctgttagctgttttcatcatcattgtcatgaaaggtaaccgtgttagatgaatgagctctcctacttaacctatatgttatcagagtcaagttacttgatctaagtcatctgttcttgtttataaaatgaggaaaatggtactacctctctcatagggttatcatgagttcaaataaggcaaagcatacaatacctatgtgtcattttctggtacatcagacattaataaaattataagaaaattatataaaatatgttttgtttgtattcttaataaaacaagatttttgttaggaggtggcagagattaggcagattgtcattttcctaccatgggattgaaatgtttattggaaacagagataaaagttgtccttttactaggaatgccgtaattaaataccacagactaggtggcttaaacaacagaaatttaagcacttctggagactggaattatccaagatcaaggtactagttgagctggttgcctcagtcctctctccttggctttcagatatctaccctcttgctgcctcttcacattgttgcccttctgtacaggcacacccgtgatgtctctccttgtgtcctagtatcttcttacaggtttcaccttaagagcctcattttaacttaattatctcttcaaaagccctatatccaaatatagttacattctgagttactaggggatagaggttgaatatatgaattttggggaacacaatctagcccataacactgaaatagagatagattccagttaggaatgcctgcgagtcttagttctttgatactgcagggtcttaggcatatggcttttatcagaccccacctgctgtggaggactgagctattccaggtgtccctgccctaattcagttgccttagtcactgagcaatgcagagtgctcagatgcaagcctctgagactccagctgagtctcaggattggagctaagaatggacacagaagacaaggcagagcagcaactgaaaatctcaaagaaagaggagggaaagaaaggtcctgaaagtagcagatgtgaatagaagataaaatgtgaccagataattcctttaaagcagaatgactgatgagataaatggggcagtacaagggaatatgtcattttctatctacatttactcccttttcctaggacagcttagtctagattattcaatgaaaattggaattagacattaaattccttgcatataagaactgggaaggtaggtgtggttttttttttttgtcattgaaatcttagttcacatttggtgttccatgtgcatttgtgaaataaataaataattttacacctttgtcacattgcatttgtaggaaacagttatattttgcaaatattcagtttgttctgatgagttgtttaaatattcacctattaggcagaactgtataactatctctgggcagtgaaatataagtaagtatgacgtattattgttgggctgatgcaacaaaaatctatgtgaaattcttcattttctcgctcttctgccagaacaacttaagaagatatgtatcacagatggttcagctgtaaaaggtaatgcctcagtcagcccttatctttgagtgactaggtggagtggatctctccttcccttgctttcacctacccatgatagatgtgcaccatgaaagtgagataatacattcccccatggatttaaaggccagtttgcatactatggctttgcttactgcagaagttgaagtgactcagcttctgtctttcagctatttttaataaaacagtgaaccgctaatctctatttcctaaaacagtacttttctcaagtatctcctaacatttcttccactatctactggattgtgtccacatctaagctttcttggccctttgtgatatattcttgctttgcctactcatattatttcccagaatttctcaacatacaccaattgtttactcacattgtattcttttccattattggaatgttaaattttatttccttctgtctatattgttttaaagtctttttgcttttcttactgtatcctctctctttgcccttttctttctcgtaatccatctatccagggctcatttataagctcaatttcctttgtggaactccagtttacaacaatactcattctctctctctttctccctccttcctagaagttattcttgattgattgcttgtagggttcacttttttgccactgattgtatttagtgccttctcatataacattaagtaatgttcctacttatttcatacacataattcctacctacttgatatggtttggctgtgtcctcacccaaatatcatcttgaattttagctcccataattcccatgtgctctaggagggaactggtgggaaataattgaatcatggtggctgtttccccagtactgttctcacagtagttaataagtctcatgagatctgatggttttgtaaggggaaaccccttttgcttggtagtcattctctcccttgtctgctgccatggaagatgtcacttgctcttccaccacgattgtgaggcctccccagccatgtggaaccgtaagtccattaaacttctttcctcatattttacctagtctcaggtatgtctttattagcagtgtgagaacagactaatacaccactcaagaagtctcttgaaattatgaatcatatcaatagtcattttatgtgtaagcatcagtcactaatagtaaccaccaacatttatttagaatttattaattaagccatttatatagattatattctttaatgttcacaagtactccatagggtccttgtgattataacaataattattagtattttactattattatgcctagtttagagatcagggaactataaagaaacagggaactcaagttgctttctcattgtggttcaactattatgtgggaaatctgagagcaaatctgttatctcagcttgaaatgcgatagccacatgctgtcctgtgattttataatgtaaaattttaacaaaagtttattgttctagattttactaaaattctacttattactgatactaatttatttattgttctccaatgttagtactgatgacacccaatcaaaattaatgtccatctttccctttataatatgtcatgtaatgcttgttttcatggttagattataaaatcctgaacagagacagtctcagttacttatattttcctcaggacttggcagaatgacccaatttgtgattaatgaaataaataagcattgaataaaaagtagattgagacataaaatgcgtcagctagaagggcaagttggtgagctttgaggatagtagctggagttcaaacaacaattcaaaaataggtaatgagagtttgatttatatgacactggtcaatgacgtggggacaaaatcagtcaataaatatttagtaaggagatattacccaccccacagtgtaccttttttgcatcctgttaggaaaacaagaaatctaggtaaattatatgtgtagacaaaatactaagtgaatctctaaaaatttactcacacacacacatacacacacatgtatatgtgtaatttatcacatcatgggttatcactaactgaatctctcatatatgtgtaattatagattacatatatattgttcttcattgaaaaattggaatactgatgagagctcttcagcttaggcatagataatgtttaaaaagaacattgttaatacagtcatcaatattttatgtggttgtatgcaagatttgtccacacatggtcttctggattcacggaatgcaattctgatgatatctccccaggaaaaattagagcattataagcaaatattaataattctttacgctttatgttgagtatttttgttatatttcatatatgtaatttattacagatcaaattagtatttatcccatgattgtgtattatttagaaaagtatttgtagaaaactcaaactatgaattcatgctttcttcaggtatttcctctcttctttgctcatgtcggattattagctgcctttctgagtatttgtttataacgctagtggatcataatgcagtggctgttcctgacatcagtggcccagttcatgctgttaatgttccctactcttgtaagatcctatactgcccctaagggctgccccgctaaatgctcagtgaagactgttcagctagtttgcatttaatatgtttcttcattgaacaattggaatactgatgagatctgttaaggcttagacttagataatgttttaaaagaacattgttaacacagtcatcaatattttatgtggttgtatcaaagatttgtccacacatgatctgctggattcatggaatgcaattctgatgatatctccccaggaaaaaaatatatatcattataaacaaatattaataatgctttatgctgagtattttcattcattcattcaagtatagcaagcattatgtaatacctgttatgctaacatcaggtttctaataacaactagcgtttgtggtatttgtaagtgccaaacaccttagaaatactcttctctgtatttataccatataccttcatccacacacattgtattttatagataacacacttaataatgtattattacatttaagttacacaaaattacatagctttatacaaaattgcatagctttatttttaaggggctactaggtgcccaaccctgttctacctgttgtgtatatagcagacaacaaaacagatgaaaatctcatctttgcggattttgttttatgttggatagagacagataacaatccaaagcaacaagaaaacacataatcaaatcatggctgtcttcaaatgtcacatttttggtgtcctcctctcaaaaactacatttacactgactggagaaaggcactgctgctgtcctgtttaatgaattccacaagttgtcagtgatgaatacacatttcatgtactgggttgggtgcagtgtcaatagttcactggacaacattccttctaattttctctttcttagaatacattttactttagattatcagaggaaccccttggaattaatatgtaataaatatagtttgacaaaaataccagtttgaattaaaatattggaaatttaaagaataattgaaactctttccaaactttcctaaccttgaaaaggaaactgagtttggagagggctcaagagagaatggaggaagaggaaatataggcagtttgatgatatgataccaagtgttttttatttgttttgtttgtttttaagcaagagggcagtggtaatagggaagaaggagtaagaaacaggacctatcccaactcaggtcctagttgtggaagaatatgataaaaacattcaccactagtgagagggctacagaaaaatagcattttctggggtgagccagatttctggcaaaggaagaagaaatcaatggtcaatcaagtatatactatcttatttaatctatttaatcattacaaaaatttcacaagctgaattttattattattcctgtttttcagatgtggaaacagaaggttaaaatttcaagctatcttgcttaatttcacacaaatcctacatctaacagccataaagatggctcaggcacctggctcatgctgccaaatcctttttttatttttgcaagaagagtcaagtagaggttctaccttttaaaaatattttaaagtttttaacaatactgtatttgttatctttataccataatgttattcatcaggtttctagaatttttatctttcataactaaatatctacacatgttgtttagcatattctcacttctcccactctccaacccctggcaccattctattctttcccctggcaccagtctattctttgcttctgtgagtttcactactttagatactttgtaggattggtatcatgcagtatgcagtatttgttctctgtgactggcttattttccttagcataatgtcttcaaagtttatccatgttgtcaaatattgcaggattttctttccgccctttaagactgaatactattccactgtatgtatatactgcattctctttatgtattcatctgtcaatgaaaagttaggttgtctccgcaccttggttgttgtgaatagtgctgcagtaacatggtagtgctaatatttctttaagatcctgatttcagttattttggatgaatacctagaagtaggattcatggatcatattgtagttctattttcagtttattaaagaacttgtttttcagttttccatagcagctgcaccatattgtattcccatcatgtataggagttccagtttctccacatccttgccaacacttgtcttttgtttttgctttgttttttataatggtcatcctagtaagcatgaggtgatatatcatttttgcatttgtatcagcattcctctgatgattagtgcattaaaaattaaaaataatttctgaaagaaattaatgaaaacaagtggaaagacatcctatgttcacagactggaagactcaatattgttaatactgccctactgatccaatacaatccctatcatgctgccacactcttaatcattgtattttaataccttagtaataagtggtgtaggaatcacaaaagtacaatgatgtgggccccgccccctggaactttaggaaaatgatggaagttgtgataaaatattattatatgtctatttctccaaaatatattcattaaatttaccatatgacagttttgtgctaagttctggggataaaaatacagttgtccctcaatatccttggggcttggttccaggacctaccataggtaccaaaatccatatatactcaagtcctgcagttggttctgtgaaagtcagcctttcatttacgtgagttttgtattctgaatacagtgttttacactgagtccaggctgcagttgaaagaatgttatttatactgcgaaagtgggagtgtagtaatagtctgtgtcacctgcaatagattacaaaaagattttaagaatgaaatagttttgaggaactatgattcaaatcttatagtttcatataaacaaagaaaagagaaacagaggattaacatgcgataaaacatgtagtgtgtgaatataaaataaatatttaaggcatagtagttaagagcatgagcttagaaatcagataaaacattttcaaatcctgaaaatattaatgtatgatttttgatgagtggtctctaaggctctgatctctatccataatcaagaataatagtaactttctcattagattactgttaggattaactaatgttatgcaagaaaattgtgtagtatatttctggcatataagaaatgataaatatatgttagtatgttataataatattttcaatttaaagcatatttaatgtttcttcatcattaatcaatattccttaatgttttctttgtctaaaaacatttacacacacatgcaaacatacacaaacctgcacaatatattggccacttctttcttagaacactcataatactttctacatacttcattctgtgtgctacaattcttcttacaaatttctgtccatcttgtctttgattttctctgttgcattttattaaagtatctggcaaataataggaactcagcaaccacttggtatctgtacttttattttttttaattttctctatctcctacaactttttgtctattttcttaaattccttcttataaatgcttttactatttttcattcgtgtgtgggtgttattctatctccattcttcattttcttgtaataggtttcattcaagtctcttctattctcacttttctatttaccatttctctctctctctctgtctctctcagcagttgctaaactcttgtcatctctctaccaccggctagctaatttaaattccaaaaatcccaataatttttgcatatcaactgcttcattcctaggtataaaggaaaaatacacagacatgccaacctacaaattttaaaatagcaagaaatgcatctttcatttactgaaaattttgtatctaagagttttctgagtataataccaatatttacatgccctagtcatcctgccacaacaaaaacagaaactgggtaatttatagataacataatgtatttctcactgttctggaggctggaagtcaaagatcaaggcactggtaagttcattgtctggtgaggacctggcctctgtttcaaagatggtgcctgttgccgcatcctttggagaagacgaatgctgtgttctcacatagcagaagggcaaaagggcctagttagttcccttcagcccttctataaggtacagagtgcacagccctcatgacataatcacctcctaagggcccaacctcttaatgttgttgcattgatgtttaagtttcaacataaattttggagtgagatgcaaatattgaaaccataatacaatgttaaaagatacattatgaaaaatctttgcaaagaaactgttattctgaatctttttttctagccttatcccgtcattagagacgttcaatagaatgaatgactggccaatgatggaattgctaagacaagtaactggaagcttaagataaagtactttgaaaacagaaaatgttcaaccatgttcttaataccagaaggagtcaactaagaataaatactctttgttgaccttgagtgaatatattgtaatatgacatgttgcaagttaaagattcctaacatacttttatacagtcaacaaatagatgaatttttaaaaattaatgccttagaagatgaaaagcatattcagtaagctttgaaaataactggaacccagtctatgattgtaggacatttgggtttcagttattttcaaagcttactgaatatgctttacatcttctaaggcattaatttttaaaaattcatctatttgttgactatataaaagtatgttaggattaagaaaatgtggcacatatacaccgtggaatactatgcagccataaaaaaatgatgagttcatgtcctttgtagggacatggatgaaattggaaatcatcattcccagtaaactttcgcaaggacaaaaaaccaaacaccacatgttctcactcataggtgggaattgaacaatgagaacacatggacacaggaaggggaacatcacactctggggactgttgtggggtggggggaggggggagggttagcattaggagatatacctaatgctaagtgacgagttaatgggtgcagcacaccagcatggcacatgtatacatatgtaactaacctgcacattgtgcacatgtaccctaaaacttaaagtataataataataaaataaaattttaaaaaaaatgaaccagagctaagccaaaaaaaaaaaaaagaaaataactgaaacccatctagtattatatgtttatgtgatttaaaagcccagatttcaaatggaatatttttctgaatctatatcaaatatttttctgaatctataccaaatacatattgctctaacagagaacaaaagtatgtattttttaaaaaagtaacactttttaaacaattaaggtcatatgagagcaacagaaaagtgtgtacaaaaggcaaaatgataatctatcctgggaaaatatcaaaatagactctcctttcacagtactatatgtataccaactttgacaacacatgtgtttgaatgtattagcaaattatacttatcaataagattctattattaactttcattatatgcaagtaggaagaaaacatatctttgctttcacttctgaagtgcatttaagtatttggtgagcatcctttcagagttgaggtttagaaatcgttttgaacaggtttaatataaaaagtcatttgaggagactcttctaaaataaatgaaaaaacatatgtcagagtaggttcatcaaactttatggctgggtgtggtggctcacacctgtaatcccagcactttgggaggccaaggtgggcagattacctgaggtcaggagtttgagaccagcctggccaacatggtgaaaccccatctctactaaaagtacaaaaaaattagctgggcgtgctggcaggcacctgtaatcccagctactcgggaggctgaggcaggagaatcgcttgagcccaggaggcggaggtttcaggaagccaagactgtgccattgcactccagcctgggacagagagcgagattctgtcccaaaaaataaaacaaaactaattttatcaccaatttgccttctttacattggagagttacaacagacgtttataaagaataaacttgggtcaaagtcattttaataaagactgatactttttatataaattatattttgggcatttattaccaaatgtaaaacttttgtccttttatttatattcaataaattttcaataactatataaggtataaaaaacaatgtaaaataaactgtaacctctaaactgacctaatagatcatttggggtatggaatagtcataatgtctttagtaagagaaacagaattttctgtaattcattgcatagctgataatgcacatataatatgctgatatattcattgcttttggtgacagttcatttaattatttagtctttcaacgtattttttaaggtctctactatctgctagatactatgaaagataatggggcaaggagtttattctaaatggagggaataatatataagcctccatgaccagaagtaagcgaggtgagatcaagtgtcttgtcttagtccatttaggttgctataacatagcactataaattgatatagacagttgctataaacataacactttaaactgcttataaggaacaaaaaattattgttcatagttctggaggctggtaaatctaagttcgaggtgctagcaaatttgatgtttggtgatggcctacttcctgattcattgacagtggtcttttctctgtgctctcacatgacagaaggcacagacagctctcggggcctcttataaggcattaatcccactcataagggctgtggtctcatgacctaattatctcccaaagagcccacctccttataccatcacgttggggggttatattttaacatatgaattatgggtggggggagttaaaatattcagactatagcaatatgaataaaggccaatgtaaatcaaatgctgatgaaactgaggaggtatgtagagaccaaggtttgttagccaatgataataattttagtcttcattctaagtgaaaccattaaagtttttaaagctggaacaggaccagtgggggcaggggaagggggcagaaatagtaacatcatgattcaatttattctaaaacagatcactcgctatagtgaagagagtggatttgtgtaaagactgaagaaaactaacatcagaggtgaaataaacagttagcaatatagtccaacggagagataatagtagtttaagcaggtggaagtggagctagagacaagtgaagagattgaaaaatagataaagaaaaatgtgcatgcacacagatacacacagcagtgtgtgtgtgtgtgtgtgtgtgtggtgtttgcatatgtgtacctgtgtatgatttattgcaaatggggagtggaagtggaataaagggaggaaaagtggtatgtaataaggtagaatagggccattcactaatataaacatcctaaaggggctacatttagaagggagatcatcagtttagttgtaggaaaactttgagaaagaaagtagttaattcaataactactggatctagatcttaaaaatttgtatctcttatctgttcctgaataagtggtgattgtgatcaagataactgaataagtggtgattgtggtcaagataagcatttatagaagtgattattttgtgcatttcttggattcttcatgaaaacaaatgcaattgttttatgatgatgttcttagaaaagctttatttacacgtacacacacacaaaactttatttctaaattatgtttgtacttttaaaaaaattttaatttttattatattcattttgttgagacagaaatggctctatcgcccaggctggagtgcagtggcaccatctcggcttaccacaacctccgcctcctgggttcaagttattctcctgcctcagcctcctgagtagctgggattacaggcacacatcaccatgctcggctaatttttgtatttttagtagagatgagatttcaccatgtcagccaggctggtctccaactcctgacctcaagtgatccacctacctcagcctcccaaagtgctggggttacaggcttgagccactgagcctggcctgtttgtactttttaatatgtcactaagactcttaaaaaggcatcgtgaagaagtgcacaactggcattttttttttctttttctaattcttccactcttcctcttattctgattttagaactcatataaaattcctgtcatttataagtaatttcaagaataaggaaggaaaaaaggaaacatctggagggaaaaggtatataaattatgtaatcaaatatgtttatttttcataaaaatgtttcagtaaatgtccttattcaagctacgcagggtgacatcacttagtatctttttgtaggtattatattatttcatctaaacatcaaggaaaaaaatcattgttcagtaaaacatttaggaattttattagttcatttattttactaagctatatttaacaaatagaaaagtattaaaggtacatacttatatatctcaagtgtctttgaacccatgatattaaatttttgcaataatagtaagtattcctaaatgttttgccctgattttctaaaaaaaaaaaaattatcaggaaggcagaaaatttccaatttttacattttttctgattttatttctgttttcctgttaaagaaattatgtttaaatatgcaaaataactttattatcaaattacacattcagatggaagcaacattaactataaattatttttctcaattttctcattttgttttctaactggtttttatttatttatttagagacagggtcttgctatgttgccaggctggagtgcagtgctattcacaggtatgaccgtgatgcactacagctttgacctcctgggctcaagtgatcttccttcctcagcctccagatcagctggactacaggcatgcaccaccatgaccagcttttaaaaatctatctataatcactaggtatattttattcagtgccatatatcaggaaagtacattgtttcattagtcttttttgttaaatagtgatagtttcaggtgacagggttaatgtgtggttgggtggctgcagatacacacgaatctatttgaaaacctcagaatcatcaacattaatcatgtttcttttggtggtgttcccatatacattttgcggattttacagtatatgttaccagactctcagaggaatactcctatttattagtttttggctactttattcactattataaacaactcaatgtattgaatatctttgtagtgatgtcaaatatgtaactgttctattgccttatcatttggcattagtatcttgtatttaatttattaaaataaccattttaagtcaaattatggagaaataatcctcaaacatgaattttagaatgtagttttctctcaaaaacttaaacttctgagacctttttttttgccttttaatgtaacaaaatgaagaaatttagactcggctccaagaaatactttataactcttaactctctgaccaaataagattttatatatctagggctaaagaatatgtatgcctcctcatagattcttctgaggtcatgtttgtctgaatctcttaaaatattattacaaactttggaagttgaaaataatattaactttcaaagtggcaacatgtgtacaatgtaacaaatttggatttatcgtttatttataagcatatatttggaatttcaattctataagaaaacatcaagcacagctattaattttggagacattaagaatagtactcacctgtgaattttacgtcctttttacgggatacaggagataaaattaaagggacagtggcttgttaaggtaggatattgtttattatatcactctgtatatcattgtgtacccatagtttagcttccacttacaagtgagaacttgaagtatttagttttatattcctgacttacttcacttagaataatggcctccagttccatccaagttgctgcaaaaaaaaacataatttcgttattttttatagctgagcggtgttccgtggtgtctatataccatgttttctttatccgctcattggttggtggacacttagattgattccatatctttgcagtcgtgaattgtgttgcaaataaatgcgcatgtgtatgtgtcttttttatataatgatttctttttctttgagtagatacctagtagtggaattgctggatcaaatggtagatctactttagttctttgagaaataaataaaaattaaataataaaagataggctagttgacaagtgtaaaaaatggaagccaggcactatcttaaattcattagctactttttaaaattgtttttatctggttaaatttttggcgaagtactttaggattttagttattactgaatgacttaactgagtataatgagatatactgtagatacagcaaaaatgtgggagatttctgaagggatatttcttacctcaaattcaaaacttgaattttgaaagaataatcttaattgtaaatgtctgtcaattatttgggaggccatgggtttctttctttaacttgtttactagattgtaatcaaataaaaaaatgtaaaggtaaaatacatactttctctctgagattggtaccccaatccagtctcataatgtatatgtctaaaatacatagttacaaaaagctgaaaataaagatcttttttttcatgagaccatcagtcatcagggttcaagcagatcttttatgttgtgcgagttacaaaatgtgacacagggtggagggggagtctccctgtttccatgaaggacatagagaaaatcacggtgtctgtctgggatacaatttcctcatctgttatctgaaggaattaatctaaaggaattattttaagagactgtactaattagtcaagtagatctgagtattgtccacataaaaggtcttcatctgtttcagatgttctaacatttaatattgctcatgctgtccacagtaccaaatagattcagacatgttctgaaacttgattgtttcagattgataaataccatatttattgagctcattaaaaacactggataatttttatgccccttgggataaacagaataataactccccaattatttctatgtcctaatttctggaactcgcaaatatgttacattacatagcaaatgagaatttattgaagataaaattcaccagtcagctgacctgaaaagattattttggaatatacaggaaagctcaatacaataattagagtccttgaaaatgaaagagtaaagcagataagctcaaagtctgagggaaatgtgactatggaataagtgcgtgttgtgagtggtactcaattaactgttattaactgataaaattgaagaagaaccatgagtcaaggaacagggctgtctccagaagccggagcagacaaataaatggattttccttttgacctacagaagggatatagtcctgtccacacctcgattttaggctaatgagactgatgactcacagaactataaggtaacaaattagtgttattttaagtctgtggtgattgttaccatagtgatagaaaactaacacctctcttatagattttacagcatagtgagggatactgacaagaaaactcatatatctatcaaaatagtgttccaagaagatgatgggagctcaaaataggtaactaaatcattcttcagctagcctccctgaattgttttttttttttttttgaagattgattcttagttgagtcttgactaggagtaggacagacagaggaatagatatagtgatacagagtagaaaattttagctcaaaaaaggaaagaaggtacgctatgccataaaagtttgaaaggcttttatatacttgggagaatcacaacttactgacatcttgtttacttatattacatcatgagtatgtctcaatatggctatagtttgccttgatatgacgttgtgtaaatcatttgaaaattttgttgtgttttctagtactggaaaataatagggcaatggtatattggaaattaatgttcttatttataagttataaaaataaagaatttaacaatgttatattttatagatttgggattgtttgcctcttctgtcatatcagtcattagctctagaaagctgactgggaatgctatgctggtgacgtgacctcctgcccatgttcttctttcaattctgctctttccccttctttctgtttgtacatttcagagacctaacctaaaatcttaaatccacttcatttgctattatatgtggcttctagaaaatgtatttatatgaaattgtttcatggtttgtcaacatcattcatgacatttataaattcatattaggaaggaaaatgtgatatatgcaaattaaatacaatttagttttacagtatgcagaaaagagacctgagactgctgcacttagaaacatctgcttacaagattggctcttgtctggcctatgggaaagtgattatctctgagggtaaagagacaggggaatgggagaatagagacatgcagatgaatatagttggtaatactctaattcttggtttaagcaaatttttaatattcattgcactgtacaaataaataccattaagaaaagcgccatttatttgctaatggtgatggtgcatcataaactgttgatgattagtctaatgttttacctttaagttccaattaaaatattaatactaggaaaaaataaaggttttagaaatggattagtattcagtttttagtattactggattaatgacttcatgtcaattattaacgttacttacttttttgagcttctgtttctttacttcacaaatgatgatagtggctgtcttgtaatttttttttgagagaggttagtcattattcctgttaccaaatatttctcgttttctttgcagacacatgacaggattatacttctgtgtttttgtttttcaagtgatatatgaccataatatttgtgattaaaagtgaactcgtggaggtcacctctgaatgataaatataagatccagtgtatcatttatgatgtttttcttccctcttttgagtgtgtcattattagctctgtcaacctacatccttgagtgagtataatagcagaacaatttggacattgagagtgaataacaatatataatttttcttattttaggcttctgatgttttatatttgttaccataacacattattgcctatcctaactaatacaattttcattaaattaaaagagataaaagaatgccaattacccaacacaatgcttaatgtattatatgtgattaacaacttagagtagttatattactgtgaacttcacaatttccatgtaatagaactctggtagaatacaagataaaataggtaaattttggtgacagtacagattgtaaaattacacagtgtatgaaattatgtgtgtgcatatatatatatacatatatgagatgaattaaggaaaattaaacacgaatgtcaccatttttacatggagctctttgttttactcgagtttttgaagcaaatctcagctaaataagcatgtattttacataggtctctaaaataattgctttcattttagctttgacttgactgagtcaagaaagcaagtccaggaatgaataaattatttatttatttatttatttatttatttataggagactatttgtatacatttcaaaaacaagaaaaactatatatcacgtaggcatacttttatgtgtgatctgtttaaagcaaggaaaaaataatcaaaattcaggaaggtaattaaatctggctgtaagacatcaatgatgagtttatggcttaaaagctctgctctataaatcatacatctgagccttactgctatcttcctaaagaggccgtgtacacttagaaaatcacctttataatattatctattaaaaaaagaaaattctgttttgggcttataatccaaggcagtgacagcagatattataaggcattttaggagcatggataagaataagcagcagtttataattgtgaagatgcctaactatgtgtcttttttatttatctgaggttaaaatgcttgttttaatatatttacatctgaaacagttggaagatagtgtatacgcgcaagcatctttaaaagtaactcttgttatcaccaaacttataaacaatatgtataatttttttctcagtctcttttccttttgttgattttgctttccattcctttagcgtcttgtaagaaaattgcagagcctgcctcatattctaaaagcatagacatgcttagattaataaagaaataattctccatttccaaaatgaaaatacatgttttagataaaatacagtaagtccagagacttatatgacctccaataattaaaatgaataaaatattattcagtttttctagttacaacaaattgtaactgctgctgacttcaagaaaggaacactttgagactttaattatttctaaaaattgttatttgctataatgacatatgcaaaatatttataagtatagaaagcagtgcaatattttataatttaccttataaaaagtttcatcctcttgaaatgcagtattgtttttggtaagaatcaagggtgctcctgatacaagtatagaaagcagtgcaagattttataatttaccatataaaaagtttcatcttcttgaaatgcagtattgtttttggtaagaatcaaggttgctcctaatacaagtttttcagagtttaattcagtcatttggctatggacacaagaaacctgaaagtaatggaaggtatttatgaagataaggattggctccagtggccagaaggagattcatggctggtgcatgggcatcttggcatatcagctaatgcatggggtcatgaaaagttctggctgatttgtgtacaaccatgctgtcagaagacattttctctaaaacactcctaatatgtgcctaaactcttcttatgatttaggtttagtttttcagttctccatggttattgcagagagatctctccatagaaagtacattcattagcattgggttggggcgtaattgatttacaggtagatactttatattttctgaaaccttggagattacgaagactcccatttccctcagtgagccagtgtttgtgtggggaggacatatttacactgtttctttttcattttactttttgaatcttcttcacatcaaaccttttttcctccagtgtccagaaattctccactgttaggtactctgggctttcacctgtctcctccttgaacctagacatggtccacacagttcactattttccttctctgcctgaataacgggtaaagcaaccagccttctttatttgatctttgacactagtgtttcttattctttacaaagcaaactctgcaactttcaggttcatgcaaatctcctttctaaatgattagggcaacttctgaaaagaactagaaaataagaagggaaagatttctagctctgcctacaacccaacatcccttgcatctcacaaaaggatatgcttaaaacccaaggcattcagaagaaaatctccagtggatgcccctttactctttaatttgctccctgaccttcaggattatgcaggctcccttcttcaggttactctgttgaaaaaaataaaatcatttaactccttccacagaaatgtgtctcatttacttgggctttttttcagtctccgtattccattatggttttagaccaaatggaaatttgagtcaagacttcagctttaatctgctaaactggaattctctttagtttacaatttcatttgtacaggtaagtatatacttttctttcattgtttctttttaatattcccattagtgggaattcaggctatctgtctcttacctatccttgttgacctattaattatgcacatttcctcctaaaactactgttgctatttttttcttggaacttcttgttcaagtcctttgaggtagtattcaggtctgactttagagtctatggaatatcttagcgtttgagaattttagatgagtgattaatagatctgtgtgttcaccttttgatccagtcttggggcaggtgcaggtgcttatgttttatgatcttcttcagaatggaagaaggaggatgtcagtgtccccttattcttgaaacacatttaatttcctttttaaagttataaatattgttaattaaaattttagcaggggtaattttaatatgaatttttattttgaaataaatttaaatttgctgaaatgttgccaaggtaatacagagtatccccatatgtttctcacacagtttcccttgatgtttaatttttaacatttatcatgccaatcgaagatttattttattttatgttttatgctttcaactgttattttagattcagggggcacatgtgcatggtatattgtgtgacactgagttttggggtatgattgatcccatcacttagatagtgagcatagtacctagcaggtattttttcagaccttgacccactcctactcttccctctgtagtagttcccagtgctagtgttcccatatttatgtccatgtgtacccaataattaactcccacttataagtgagaacatgtagtatttggtttttctcttcctgtgttaattttcttaggataatggtctccagctgcatccatgttgctgtaagggacatgatttcattcttgttttatggctgtgtagtattccatggtgtatatgtactacattttctttatccaatctatggacacttaggttgattccatgtcttgatgataaggtttggctgtgtccccatccaaaatctcattttgaattgtaatccttttaatccccacgtgtcaagggagagaccaggtgaaggtagttgaatcacgggggcggtttcccctatgctgttctcgcgaagtgtgtgagttctcatgagacctgatggttttataagtgtatggtggttcctcctgagttcattctccttcctgcctccttatgaaaaaggtgcctcgcttcccatttgtcttctaccataattgtaagtttcctgaagcctccccagctatgctgaattgtgagttaattaaacctttttcatttataaattacccagtctcaggcagtactttatagcagtgtgaaaacagactaatacacttggcttttgtgcatagtgctatgatggaacacacaaagtaatgtgtcccttttttgtaggatgatttattttccttagtgtgtatccctagtcacgtaaatgctgggtctaacggtagttctgagttctttgggaaatctccaaactgctttccacagaggctgaactaatttacattcaaacctagagtgtataaccattcccttttctccacagcctcagcaactgtgttaggctgttcttgtattactataaataaatacctgacattgggtaatttttttaaaaaagagattgaattggctaattgttctgcaggctgtacaggaagcacagcaccagcatctactcagcttctagggaggcctcaggtgaaaggtaaagctggagcaaggctctcacgtggcagagtggaagcaagagagaggtggggaagtgccacacattttaaatgataaatgatcagatctcatgagaactcactcactgtcatgaggacagcaccaagccatgaggaatcagcctccataacccaaacacacctccaagcaggtcccacctccaacatcggggattacaattttacatgagatattgtagggacatatattcaaagtatatcatcaacatctgttattttttgactttttaataatagcattccgattggtgtgagacagtatctcatatttgctttgatttgtatttctctgatacttagtgatgtagagggtttgtcatttgtttgttggctgcttgtaagtcttcctttgagaactgtctcttcatgtcctctgctcacttttcaatgagcttatttgttttttcacttttgaattgtttaagttccttagaggctccggatattagacttctgtaagttgcataatttatgaatatttccttccattccataggttatctgtttactctgttgatagtttattttgaggtacagaagctctttagggtcccaactgtcaatttttattttttgtaatttttgtttttgcaattacttttgaggacttactcataaattcttagccaaggctgatgtccagaatgccatgtcctaggttttcttctagcacttttatagttttaggtcttatattcatcttaagacaatttttgcctgcgatgaaaggcaagggtgcagtttcattcttctgcatatggctagccagttaaactagcaccatttattgaatagaaagtcctttctccattgctaatttttgtcgagtctgttgaagatcaaatggttgtaagtaagcagccttatttctgttttctattctgtttcattgttctatgtgtttgtttttgtgacaataccatgctgttttagttaaagtagccttatatacaatttgaaaacaggtaatgtgatgcctccagctttcttctcttcacttagtattgctttagctattcaagctcttttctagttccatatgaattttagaagactttcttctagttctgggaaaaacgtagtcggtagatccagttcatgagcatggaacattttcccatttgtttcatctatgatttcattcagcagtattttgtaattctccttctagaaatctttcatctcctttgttggatgcattcctacttaattttttttgtggctattgtaaatgggtttttgatcttaatttggctcccaacttgaacattattggtgtatagaaatgctactgatttttgtatgtggattttggatcctgaaactttactgcagttgctaatcaattctaggggccttttcaaagagtctttacagttttctaggtacagaattatatcagcaccaaagagagttaatttgactgccttttttcctatttagatgccttgtatttttttcttttgcctgattgctctgtctaggacttccagtactatgttgaataggaatggtgaaagtgggcattattgtcttgctccagttcccaaggggtatgcttccagattttgtccattcagtatgattttgctctaggtttgtcacacatggttcctatcattttgaggtatgtttaatgcctagtttgttgtaggtttttatcataaagagatgtcgaattttatgaaaagatttatctgagtctgttgaaataatgatatggttattcagttttgttttgtgtatgaggtgaatcaaatttattgatttgcgtatgttgaaccaactttgcttcccaggaatatagccttcttgatcatggtgaattaactttttcatgtgcttctggattctgtcaaataacattttgcttatcttctcttgaattctgggttattacatttcttcctttcttcctttttaaaaatacttctataaagttctttaatgtttaattaaatgtaacactcacaaatattagctaactttttttaagtaattgccttattgccaagtacaaaaatgatgttttctcagagttttacttaatagttttgcactcaaattttttttttgtgttgaagcatatgctttcttccggtggaataataagtactgtagctagatgaacattattcagaaatttagcaattttgagaattcaacaaatttgataattttgtcataagctttctaggaattttgaatctcataccaaaaaaattgtgtgtgtgtgtgtattctttcctgtttgagcttctcttttaaagtaggagaagtgctcactaattagtgtaaatttttggtgtaccaaatataggccattcctaacgaaagcaaaggagaaatcaaagaactgaaatggaagtcttggtgagagcagacatcatgtcagccacattgtatttatcaaatccactcatgaatgtgagtctaacattctcaccaactccagtcataaccaaactgactcaagaaccatgtcatattattgatctatcctttgcacccaaaacaatacttgacacatgagaggcatcaagggcaatttggttactctaccataaactgatgaaagacctaaagtaattaatcacgtataataattttgcatccgtatttcaattgatgcttaaatttagacgaattactggcatgacttctaagataccagtaacattatttcccacgtattatcaagtttaaggtttgtctgcttccctgtaccttttaactaaagacctgtagaaataaatttaagaaaataattgtggtaaacagggtttctgtgattttagagacaataaagtgagaggaaaagtcactgaaaatccagaataagagaaagtcacatgaaagatcaagttggtaaatctctggaaacttcaaaaaatcaggaaatatgttaatctataatttatgtgggaagaatataaggccaacaggggacctacatcttcctgcttcttctcgtgcatggtaactcagtggatgttgtgtgtttagccattctttgctttgcccacacattcagtttcttgggacttctacacctgttcccttggttcctgtatctagtgctaacttatgaaaatacagtttaaataaatgaggacagcattaattcatgaaaaaattacttagcctgttacacatttcaaataaaggcagtaatcctagtatattcctcaagaggaaatatgagaattaaataagaaaaagctgcaaatactagctcattgcatgacaaatagtagcctagagatattagttattattaagtttcttatggcaaagactctctccttgaccagactttagtcaggctcctccgagcatttttattgactgggacttaaccttggcctgtgagaactgcagattctcagcataaatgattttgtgcatgtcccacactaagagacttgaacaaattctagcacagctttttaacagttcaaggctgtgtcccaggttaacaatcccagcccacttaaatgtctacctgacaaacatcaacattgctaaaataagttaatgtttgtttctgccaaaacctggctgtattagtccattttcacactgctgataaagacatacccaagactggacaattaacaaacgaaagaagtttaatggaaaactcacagttccacatggctgaggaagtctcataattgtggtggaaggcaaggaggagcacgtcacatcttatgtggatggcagcaggcaaagagagagtttgtgcaggcaaacttccatttttaaaaccatcagatctcgtgagacccattcactatcatgagaacagtacgggaaagatctgcccccatgattcaatcatctcccaccagctccctcccaaaacacgtgggaactatgggagcttcaagatgagatttgggtggggacacagccaaatcataccattccacttcccaaatctcatatttccacatttcaaaaccaaatatgccttcccgagagtcccccagagtctcatttcagcattaactcaaaagtccacagtccagagtcttatcctagacaaggcaagggccttctgcctatgagcctgtaaaatcaaaagcaagttacttacttcctagatacaatgcagatacagtcgttgggaaaatacagccattccaaatgggagaaatttgccgaagcaaaggggctacaggccccatgtaagttggaaatccagggggcagtcaaaccttaaagctccaaaatcatctcctttaaatccatgtctcacatccaggtcacactgatggaagaggtgagttcccatggtcttgggaagctccatccctgtggctttgcaggctacagtctcattcccagctgctttcatgggctggtattgagtgtctgcagcttttccaggtgaactgtgcaagctgtcagtggatctaccattctggggtctggaggacagtggcccttttctcacagctctactaggcagtgccccaatagggactctgtgtagggacttcaaccccacatttcccttctgcactgccctaggagaggttctccatgagggccaggcccctgcagcaaacttctgcctggacatccaggcatttccatatattttctgaaatctaggcagaggttcccaaaactcaattcttgacttctgtacacttgcaggctcaacaccacgtggaaactgccaaggctcagggcctgcaccctctgaagccacagctcaagctctaaattggcccctttcacccatggctggagtggcttggaagcagggcatcaggtccctggctgcacacagcagggggactttgagccctgcccatgaaaccattttctcctagtcttccaggcctgtggtataagggcctgctgtgaagacctctgacaggccctggagacatttcccctattgtgttccttgttactactgcaaatttctgccgcccgcttgaatttcttctcagaaaatgggattttcttttctatcacatcattaggctgcaaaatttctgaatattcatgttctgcctcctttgtaaagctgaatgcctttaacagcacccaaatcacctcttaaatgctttgctgcttagaaatttattttgccacatatccctaaatcatctctctcaagttcaaagttccacaaatctctaaggcaggggcaaaatgctgccagtctctttgctaaaacataacagaagtcacctttgctccagtttccaacaagttcctcatctccaactgagaccacctcagcctggatgttattgttcatatcactatcagcatttttgtcaaagctattcaacaagtctctagggagttccaaaatttcctacattttcctctcttcttctgagccctctaaactgttccaacctctgcctgttagccagttccaaagttgtttccacattttcaggtatcttttcagcaaagcttcactctactggtaccaatttactgtattagtctgttttcaagctgctgataaagacatacctgagactgagcaatttacaaaggaaaaaagtttaatagagaactcgcagttccatgtggctggggaagcctcacaatcatggtggaaggcaaggaggagcaagtgacatcttacatggatggcagcaggcaaagagagagcttgtgcaggcaaactcccatttttaaaaccatcagatctcaggagacccattcaccatcatgagaacagcaggaaaagtctccccctcataactcagtcatctcccactgggtccctcccacaacacatgggaattatggaagctacaagatgagatttgggtggggacacagaaccaaaccatatcattggctatgggtcccagacttcccttttcttagagaatttacattaggaaacttgtagtcctttccttgtcgttgtgaaatgtatctgcaactcaggaatgtctttctcaaggacctgggagacctccttttgaaatgtaaccattgagaaagatagggcctctatttcccagtctctgtggtaaagtagggactttatttctgtaagtgccagttagcaaacacaactgggctaatcacattaagcatccacctcaaagtgctttggtacttttgctttagcacagtggtccccagtctttttggcaccagggaccagtttcactgaagacaatttttctacggacccagtggggtggggggatgattttaggacaattcaagtgcattacgtgtattgtgtactttattatcacattgtaatatgtaatgaaataattatataactcaccataatgtagaatcaatgggagtcctgagcttgttttcctgcaactagacaatcccacctgggtgatgggaacattgacagatcaccaggcattagattctcattaggagcacgcaacctagacccctcatatgcacagttcacaataaggtttgcactactatgagaatctaatactgtggcttatctgacaggaggtagagctcaggcaataatgccagtgatggggagccactgtaaatacaaagtgttacttagacttgctcactcaccattcgcctcctgctatgcagcccagttcctaacgggccacagacccatactggtccatggcccagggattgggaacccctactttagcatattccagcatttaaacagccttctgccttttgtttcatcagagctgaacccagtttccactgaagtctctcttccctactgcagtatcttactaagatctgtcttgctatttttaacaagtgtctgactttgtttctttatgacacttttaatgttcataacttgggatcaggtaacaaattcaaggcaatcagtagttttatattttgtaatatttttgctactaattcttttaaactctagacaagtggttctaaatattttcatcacacttcccttttcttttttgttcctgcactataaactgcaaatttgagagatggtatatgccaaatttcatttagagcattataatttatttatttatttctttaccctattttaagtagccaaacacgtgtataagtacttcgatggagaaacaatattataaaactaattaacatatttccgcatgagcaaaagttgccttatcaccttatgactttataatctaaacccatgattttctttggtttttgaaaagattttttaatgtatcaaacatgtactctctgttctttccttgtaatcactacagttaatcttgataaattaatttcatatgatttcattttaaaatatagtattttgtatagtcaatgtataaaccatcaacagtttccaaatcttcctgttcatgacaacacagatcaaagcgagtagctaatggatcctagtaatagttattagtacataactagtagtcgactataccagaggtaaatgcttttacagagaattgctcataaaaattttaatggtttggaaaccaaatatcttagcttcatcttgattaagaaaatgaatttttaatgtggtttacattttaaataataagggtcaatttatatagtttagtgttccaagccagaagagactcggcttgaagagcccaaaatatggcattatttatttctcgccaaagaaatagttcagtcaacatttgtctctactaattaagaattagcagtaaaaataacaataacaatcagtaccaatgttagaacattcatatttttctcagcatggttctatgcacattatttataaaaatccacttaatcctttcatgttatgaagtagatagtattatgtaaaaaagttagtcaaattttaaaaaaaagtcttttcattattaataatagtacttataaaatatataaaaggaaccacaatttgacttttgtttttggttgtgttaatttgcataacactgtctaggcaagatggatgtatgcagagcttctgccgccaaaggatcagagaagaccaatagacagcctaggacaagagttttacttcattaattgatgtcgtttgctttgatgagtaaggctgtaagtagtgatttcagggcaagaagtcagcgcaatggtggaaactagtctaccttgaatagacaaatggaaagtcaggcagggaaagtaaaatcaattgaacaaaactgtgaataattaagttgattggattggactttatatggaagtagtgggaatcacataggcattcaatcaaataactaacctgaagtgtgacatttgaagaaaacgtatctgacattagtaggcaaggtgcagcaggtcttgggagaatgaaaataaagaatctgctttgaaacacatcataaagaaagaggaggttgtgaaagacactgatggcaatagaaacagaaaggagctcacagacacgagagatagtgtacaggaaatagccactggattaatggtttttcccactgtagtgggaaaaatatatatataatataattatatataatatatatataattatataatatatattatatataatatatagaaaatatatattatataatatatattatatataatatatattatatagtatatatataattatataatatatattatatatattatatataattatatatattatatattatatatattatatatatatatacacacaggttacaatgatgtttgacagcaagggtttggaataatgagaagaaatatttaaagtggtttgtagaataggttaagaggttaagaggattaggacaaatgacataaaacaagccagaatgccctatcaccagaactcatggaaaacaaaatttaaatcttgtcaccaattattgtatttatcaaagtcaaggtcctttccagcgctcagcttccctagaactacagtgtttcttatcagagataggaaaagccagggaagtctgatatctcacggcttccccttacaatagataaacacacacacacacataaatttcctccggtagatacatagagcatcaacattgacctccacacaccccctcacagattcagacactaaaatatctcttcctatgacagggatggtactcctttacagtccattttttcatcaaagtatgttcaccagccttccccacagactctcattcttactatatatcactcaccttataagaagagctggtgatttagtaagcacagaaaaccacaaaggaaacttaaattctcattcctcagtaataactctaactcaaagtttaaaaatgattctccactttgctaatttaaaaaatacctcttctttcctttctttacagcgtttgacactatcaaccaatcaccctttctctaatgtttcttcccctttacaacatcgctgacaaataccgtttcattttctttcctgaagaatatttcttcccttatctttcttcctgcccacatttttgcattcattattttctgcgtgactctgtttaatcaccagtgagtgattctagctaaaggaggatgagattgtgcggagaaaaatgggatttgaggagaaaatctaaggagtttagaagtaaaaacaatgctgaaggagggtacttttaaaaagagaaaacataatgttccttttagattaaaacaatgagaaaaatagatagagactatgtattcagaggcagagaattacacggattttggacattttatattgtatgaaaaattgagttatctgcttaaaacatctgattttaagagggtaagacaattcagaacaacgggactccaaggcagcttgtatttggtggttttagtaaacttagtgtttgcatatttcatcttttctttctcaggcaaagtaaacttttcttaaaaaataatcttgaggaggtatgcagagatcagcatatttaataaattgaaccatttaatatgcactagaggatgtattttattaataatagtaattactgttgctagcatggggtttggaaggtcactaatcaatatatgttcatttacttgaaataaaataatcctagcattaatccatttttgatgaatattgctttggttaagcaaataattacaacaaaattttgcatttgtgaatgaatcagctttatgtccactgggcttacttaaaatgaactacaagtatataattttaaatgaaaaataattttctccacctacacagtaccttagggaacagaatatacttaagcttgctatttttgtgtcctcctaaaaaagaatatatattcttctccattgaatattaggagattggatatttttgttcttacttctttattaaaatagtaataaatcttcttttatgtttcaggaaagcatggtagagtgttttatacacagcttttcagtaaaggggaaaaaggaggtgttgtatggataatatgtcccttagaatgacaatggaaacatagactgcctctttttctcttacacattgcaattctattgcaaaatacagacaatcctacaggatgtacagaaaacatataaataatagagttttacagtaaaagttagactattatgattgtcatatactactaataacaatttctgcctaactttctcagtggtatctatcacaaaatgtattgctcagctttcgcaagaaactaggtggtgagaccattcagtggtttaaatgtgctgatgcaggctgctttctgaaggtgcactggcacattcagtatccttgaccttcagtaaagagtaaaaagaatcggttttagaaaccaacccctgtaatttgtcttacatgatcatttcccctgaaagcttcatttaggctcagtttcatttataagactagaaatattagaatcttttttatctcaaattcccatctgatatattaaatccattgtatcagatttttcctatatgatatgtgactgtataataataagattggtattttatcaatctttgcctaattttcccattatgctacaatcatattatgggttcacagtattattttcctgaaaaatttatgtttatataaaataagttattgagttgggggtcagcaaactttttctgtaaagaacaaagtaaatctttagggcttttgtgggccgcgtcatctctgctgcaacgatttaactctggttgttgtagtgttaaaataatcaacaatatatctttaaaaggggaacaagattgtggacatttaaattttatataattttcccatgttaagaaatatctgtttttttgattttttccccaactgtttaaaaatgtcaaaaccattcttaccctttcagccttacaaaaatcaggtgtgggttggatttgtccggtgagctataatttgccaacccctgtcttggataacacaatcagtgaacctactcttagaagcccagtcccagatttagaacacagattaagaactttagaagaatagaaataggaagtagaaaaatagtgtaaatttggtccacactatgatggttctagtgcggcagtctagaaaattaaagatgataattttgttagaagtggagtatagcagtaatggtggaagctaggcacttatcttgaagtcacttttgcaaagtgagcacatcttatttaatttagagtacctttggtgggaccaaatccctctgcttaacatctctgcattccaccattcctcactcccagtatttactgaaaacatgaacaatctgttacaagattacgcacaaaaagaaaactgagggagaaaggatgtgtttctcatcagtatcactagatgtaataattatattaaattcttccttcagcctttgagacttatctcaatgtcattatgaaaccatacctgtttctcttgccatttcctctcttatcccaatcaatgaattatcaacccttcttccttaaattacttactttttttaagtctctattaacagatgttatcccagtctgccatgtgagagaattgatgacttctttaaaatctctttgaagttaggtttttgaggaggtagagtctatattagtatcctcactagtttctccaggaggggtcttcaatttcattgtcttttatttaacattttttttaagttagattaaacctataaaataaaatgtaagatgttttcaggttcttaactattaatattgaagatcagtgtttgactttcctttctctatgcaaaagggaacattttgttaaaaatagagctaatgagtaacatcatgaactgaaattttaaaaattcatgtacaaattttcttttaatgaaaacatccatttgatgctttgatatcctcctggagtgccattttatctgcagatacaaatttttttttccatatggaataacatgctgccgttgtctctatatatagctatctctgtgtgtcttcatatattttgctctatggtgagcttatttagacaccaaagtatttattagtttgttaaggcacatacttttgtaataatatttcaacataattagtgattctagaaatatataacatgtagcaaactcattattgctccactggtgcccacatagccacacacgcatatatacacacactcaagtagataacacaaatctgttagtagaatatgtatgtctatttacatacagagattactattcaaacaataataatgataatctttacaatcctagtaactcacatttgttatattcttactctgtgctatacattatgctaaccaagctacttgcatgttcttatttggtgctcacagcaatcatgttgataaaacacagcttcataatcatgtaccactgctgagaatgagtttacctgaaatatttccccggttttacatcataatgtatgttccagcataaggttagtagtctactactatctgtatgtggaaagtgttttaaatgaggaagataactaaacctaatagggcatttgtaataacctaagtatcactttaggaaagatatgtatgtttattgctccagttaaatagatacttatactgtcattttaataggtgcatttgaacctcaaatactcatgtacttaatctacatactttgtctatagaaaacaggaggtatcaaaatacattacctcttctcatattatactgacatgacagaagaactttagaacatgctaaatgggaagtagaatttatagaagaattccccaggcttctaatatatcttgaaaacaaagttacagttgggctgaatactctcattctgtgactcttattccattctatatcctcctctttctcctattcttactcttactcttcttctttttttttttttttgaaatggagtctcactctgtctcccaggatggactgcagtggcgatctcagctcagtgcgatctctgcctcccgggttcaagaaattctctgcctcagcctcccaagtagctgagattataggtgcccgccactatgcctgactaatttttttttttttttttttttgtatttttagagttggggtttcaccatcttggccaggttggtcttgaactcctgaccttgtgatcctcccacctcgaattacaggcatgagccaccgtgcctggccttttcttttcttttaagctactttttaatatatagtaatgactgttaatatagtatatactatgctattcatcaatgctgtaactttcttagtttcattttctcactcaattgaagtccaggtacccaggtcacaaaaattttagctgtatagaagaccttatgatatagtaattttccatatacatatagtaaaagtgtatgttctctttattgtatattaacataatttacttctgagtaagatggctttgaaaacacaattttactattattcaaaagcagattcacaaataagttaggtaattacgaaagtgctacattttacatcttacaagatcttacaagatcttaaaatttgatcagttggttgctcaatggctaccatcccactggaaataatctacacaatattcttaggaccctggtgatgtttaccaaatagtcatatttttaggccaggtgcagtggctcatgcctgtaatcccagcatttgggaggccaaggctggtggatcatctgaggtcaggagttcgagacaggctggccaacatggtgaaatccagtctctacttaaaaaaataaataaataaaaattaaaaaataaaaataaaaacgtcatgtttttaaagatacaatgaaattcatgataaacaacagtgatccttaatgacatatcacttatgaactaggttttcttttttatgctgaatttaaacaagtatttgggctagaaatgccattttacaaagaagttataagcttctaaattattaattttattgtaaaagcgggcatccaaagaaattagtaacaagaaggaagaatatataatgcaataaaatatagcctccatgtagctgaagacacattaatgtcacctagttaaacttgttataaatacgtctcttgggttccagttccgaggtactcataagtctgactgggtctcaaagtcgccaactaaacaagtgtctttggtggctgtgagtccagtggtataattctcaacatgtactttgtatcaaagttaactagagttaattttttaaaaaaatcagaattctgtacccaaccaaaaatatttgattctgtatctggaaaggtgtctgggaatctgcattttaacaagcacatcctgtgattacagttggggagtccacaaaatatactttgaaaaaataggacacacttgcaatggcttcatttaaataaccccaaacagatgaaaaattaaggcctccaaagaagcagttctatgatttcactgatttaaaagttcctcatctgattaggaatatgttctttatacctgacctaattttccatagaaaatctaaggacagtagctttttcttcagtgttctttctgtatcttccaattttctatagtttttgcagagctcttcttcatgcctcccttttataagtccttgagttcaggatcaaacagcagaaacctgaatgttgattccacccacagatatagttttgagggttttttaaactttatttttaatttttttcttagccacttttttgaattgaacacatttttaaaggctttgcacattaaaatatcaaaatttatttctactcaaaaaaatgagataatttggtaatgctgagcctgctgttgtctacagcaacaatttccaagtatagtccactgcctttaaaccgtgtgatatttttagttcaccagtgtctgtaccaatccctgtgatgccactgacattaagactaagtatccatcgccattttccactgggaatatttttattattgaaaaacttatctctgtatttatgtttctatacctaataatagattataaaatttgacagaaatactacatatttcaagataaatggagaaagtttttcagaaaatgaacagtattttatgtttattttgtaaatatgaaatgcttcacacgttgttatttgtatgtgtcttattttgtcattcctagtttatgtgtgtttttctctctcactagaatgaaagtctatgatgtttttatagagatagacagtgtcttatttgtctccgtgtctcaagtaccaaggtaactgtgatgttcttggcatagaatggatgcacatatatgtatttcattgattaatattgcttttaaaaaactatgagtactagagattgcaaaattctaatccatttattattttcttggacttatttcttcaatctatgcacatccgttggattaactcttgaatcttctaattccatttcttgcccaattctacaatttccacacatttctgtttagttccagaaacacagaattaaaaaatctactgagtatacttctatacaaaacattgtatctggtaaagaagaattatgcccaacatactctagccttatggctgccaatagaaataacccccttctattttctactgtataaactcaatttgtatcgctttaccacttatttaatgcgtgtttattctcaattcataatatgtattatctcgcctgaggtatagttattattttaggtaatagctacctttcagcgtactttatcccttaactttagaaagtatgatgaacatttagacaacattgtgtgaatgggtaaatacctatccaacattcaataaaaaataaattaaaatccaagcccaaatcagaaatagcaaaaacaattaccatttactgagtacttagcatatcttatacatatcatatattagccatttgacaaatgcaattctgccttatatctcatctgatcctcatcacaactattagaaactctagattaaaaatatagattcaaggaagaggtaataagtagcagagcccagaatgaaaaggcagactctttgatcccaaacccttgttccacacacaggagtatgcaagtggaactttgactcttggtgggaatttctgtggacaagcacgagaaaagtaacaaaactacaagaagaaagtagaatgacaatagcaccctgaccagaagcttatttgtagtgacagagcacttcattagtgtttattatgtttaaacatttaataattaggtcagatggtacaaatacaattgtaatataaaattatagttttgcagttactttggtcatgaaaattattcaagtttaaattgctaaaacttccaaagggataaagtacttgactttgaaaagctttaatttttaagccattaaaattcctttaatgagcaatattgcctcaacaataaccccttaaagtgaacaaaactttcagcattttcaactgcttttacctctctcatttgttttaaaatttcttggaacaaataaaatagcggagatttgatactggcaggaagttgtgaaatgcttgaatgatccaacagatggtgaaactcaaaatctcttctggcctctcagccctctaggctagtgttggctcagcatttttatttccacatttgagatattttaggatttttattgttatactaatatataattacaattatgtgcatataggtctagtgtatatgcatatatgggtgtatatatatgctcatatgcatgtatgttgctatgcattgtttactaattctcttgctaatgattttttatccactttgtctttatatagcattagttttattaagaaacagttatctttattaagaaaataataaactattcaatggaaaactatataattttaaatttggaagtggtctgggagttcgttgtctcctgccattatagcactaatttataaaatactcatgaaaactcatccaaggttgaggagctaacaaatttggattattgttttctcgtgggtgccggatagttcacaataatcaatgaaaccatttgccactttgattttttgtgtgtgtttttgttgttgttgttgttctggtgcatgattagaataaagcttctgccaatcttttccccttttaataccagttaatctgctgaaatgttaaaattattctgaatttgcttaattgtcttcagattgttcaaaaaatcattatgtacacagagacccttcaccacatttgtcagagaccctactctacatttctttcacctccctagcctcaattaccttgtgcatatgtgtatgtgtgtgagtgtgtgtgtgtgtgtgtgtatgtgtgtgtgagagagagacaaaagagagactgaagctttttatatttcatcttgaaattgtgatggaacatgtttccctgttacttatgccacaaagtgaatcatatttgctgaatttaataactcaatgactcagcaaatatgatttattgaacttcctgaacaattgtctttcttttcctcattcacattctctacaaattttaagccttgctgtttgagagtgataaagtttctttctcttcattttagaaaaacatagcattgctgtgtttctaaggcatactttagaaagtgaagtccttctaaattgtactttctaaagtgaactctttcactctctaaagcgtgctttaaaaacatagcaatgccgtgtttccctaaaatgggcattgtaaaatataaatattgtttctagccctgaatcggtatttttgtctaaccttccatatttccttagttttcccaaatattgtcatctactgaagttaaaatgtaaaattatgccatgcctctttatcctaccctcttttaagttataaagagctagagtttcatttattatcttatgtattcatctattcatgctattgccttaaaatttattttaaaaatattaaaaacataaatattaagatggacattgcaaagtaaatctgaccaggtacgataagaaacttacttggaacttacaaagtctattccaataggttttatactgtgtaaattaataaattatgtcccattttagtataattgttacccaattgttaggtcacacaagacataatactaaattatatttctgcaaccagttttatttttcttatataagtaagtcgaggcaaaatttttataacatagtttagaatataaaaagagccacacacaatatattctgcagtttgtttttcaaacttttagattatgtttttctgtaaagttgccatcttgactttgctggttatatctctaagtaagtgtcatttatgcctccagtccacctagatccaaaatttatctacataattaaaaattaatcattttatttagagaaaaaacacttatttaagtttaacaatgcaaagaaaaaagattttatgttggtgatccttttatcttagtgaatagctgaggttaagatactgaaccttttcatgccactctgtgtagtgccaattgttaattcaatttattttaataaatatatgtgtacagagctttagagatatgtcccttatttcactatgcacaaaatgtgctcacaagaaaggtggttttgttaagctgagaatttctgattttatttcatttgttcatttcattttattgtttgcctcttttacttttagggttatacaattattcaactctgtttaaaaagtgatgtgttatgctaccactctgccaaagccactagaactattttgtagaaataaccagaaggttcaaagacacatataccttaagaaacgaaatttaacaaatgagatggaccttattatttattaacttcagtgttgtgtttgtttttgtatttattcactctatactctttgaacaatagaagaggaacaacatgaaagaggagatattaatcattcatacaatcatacaatttgttttttgtcatttttcttcattctctcagaaagtgttgaagacaaaacaagtaggaatatggtgaaacaaggaagactgacttagacagatgagaaatacagaaagctgatgatgctggtttagtaggctgtttacagagctgttttggataaaaggtctggactaaccctaaggtgccttgattaaatgcagagtaattacatcttgatttggttgctctcttatatttatcttcttgtctctctagatatgtagctgcctcatatgttctgtcactgtgcaaaagggaccagactctttgaattctgttctccttaacatgtgtgattcctattggctagtgggccattatctcagcttaaagagtcagctgttgatctaattatccgaacaaaacaattctccctagatatgaataaacttaagcttatagtgggaatatttattttaaaaaggatttttacagcacatgctaacagaattctaaagtaatcagaggtgacgatattgagaatatgtgcttctgtgtccttcatttctgttttaattattctaatccaattcacttaaattatcagggaggttttttttaaaaaaataaaaacatcaatattactgatacatatctttgcttctctgttaaattttgcaaggggactccatagtgtttaaagacacataacttggcaagaaaatgggagttagcatagataattataaatactcaacagttattaaaatcttttcaattgtaagaaaaaaatgctaaactgtgtttatttccttttgagttttgtggactatattgtgttactcatgtctttcatttgtggtatttaagacatttatatatttaatgaaatatttgcaaagatatgttgttctgtgctggaggaatgttactagtataagaagcaaataacactgaccaaaataagcaataaaatgaaacaaaagaaaataaaaatatgaattttgtatgtatttctcaagtactaccagcagatagatgcattgttccagggtacacctttttcatttctttgtcatttgttgacttcagagacaaaagctgatccattaactcattctctttaaaccaacttatcttcagaatatcttctccctgatctactcttattcttctattctccttttattattatttttattattatagaaacccaaaagaactagcacagcaaaacagaactctactgaaaagacaaaaatatataatgactaagtagtctaagacagaatattcatagaaagcaggagagaaaagccagggattgttttgtctagcctcagatattacggaaggacaagtacacatttaactctatagatttttgaatcaacacagtcctgtgtttgaatcctcctctgccataaactagctatgtgatcttggaaatattagttaacctcttgaaattgagttttgcttatgttataaaatggttaaaacgtacctatctcatgggattggtgtaaatggaatgagataatgtggctaaactatttagacagtgccttgtactaaacaatataagaaaatatttgtgagattccaagcatgttaaaggtaagatcaagggttaaaaccattggacaaatccaagccagtagttttgtaaggcataagagctaatagatagtatttctgaggtgaaatactatatttgaaaaaatcgagatctgcaccagtaaacaaagcctctttaccttccaagagtatgagctcaacagctatattcacatcccctaagaggaagagttagtgacaatcaaattgacagaataggatgaacctaaaggtaacaactaacaatttttgatggctattttacccatgaaaaaccatcagtattgttaataaaagtatcaagaaatacaaatgaatttaatgttttattttacattagagaaactattttaatgacataaatatatgaacataattgaactgcatataaagtgttaaaccaatatttagctatctaatgtattataaatagccctgccttcacatacatttcctctagggaaaaaaatagaatcatttactttctatagatatttagtgttcttcaaagtatctttgttattaaattaatttgggagagggaggtggttaagaaaacattgctttacaccagtacatataactatgtgatttataataaatgcaaccacagtggcagtatattttctggatgttaatagcctgaaatccctttcagtagcagcattaatcagtcaaggatgggttattttatggtctttaatggcctttgttgatagatggagattttgtttacagattattcttcattgaagcaccatagattgcaagctatgattcttaagagatattctcaaaacataaattatgctgctaagaaatctgttcagagctaaattaaattagatagctgcattttttatgaagcataggtaatggagcagtatactacaaatgccttttcctgagacattggtgtggaatatctttaacacagaattttttcctaagaaacattcctttacttgtgtgcaagtttatgagcctacatgttcctctcctgagtaatttatgtagaatacataacatttgaaatgtatttatgatatttgactattataatgaatatctgccttcaggtcagacattaccaaaaattttcatttttaaaaaatgagcaaaaacagtagtgctcatttatattttccaaatgtcttcataattgagtatactgacaattcaatagtcaaattttaataattgttgcagtcaacgttttgtttcacattgaataattttttattgtacctttcagggaaacattattcgtgcgcttgtagtgcgtgattatcattcatgttgcttctaataatattttgctcacatacatcttatagattgagtacagagtctaaaaatttgggtatgattatactacttcagaatatattttcatttcccaaatgttattgactcttaaaatttctagctagggactgatttttttttctcatttcttcttcttcttctttttttaatggagaataatataatagctgtggaaaacaaatgactgtattttactaaactacactaaacaagccaagacacccttaatttaattcaatgtgaaagtcagaattgtaagagagcataaatcttgacttcttgacgaatattaccagactaagtcacatcattttgtttgatgactttctcctttttgtattttttattttgttaagagagggtctctgtcacccaggctggagtgcagtggcatgatcacagatcactgcagcctagatatcctgggttcaatctatccgcccacctcagcctccagagtagctgaaactataggcgtgtgtcaccacacccagataattattattattattatctgtagtgatgaggtttcactaaactgcccaggcgggtctcaaactcccgagttgaagcgtttctcccacatcagcctctctaagtggctggactataggtgtaccccaccatgtccgctattttttcttttttttttttggtagagataagtttttgtcatgttgcccatgctcgtcctaaactcctgggctcaagcaatccagccacctcggcctcccacagtgctgggattacagttgtgagccaccacacctggcctctccttttattgagcgaagtgtttgcatacaaatcccctgggatttttttgctcggaaatcccctcagggctatgcctagtcctctttttggctctatcacttttactgtatttgtcaaagaaaagtatttcaagttaaaatattattttgaaaaattccttatgtgtgcaagtcttctcacaataaccaaaatgatgtaggcaaagcctttccaaagtgcggaagtattaggttggtgcaaaagtaatcacagtttttgacattactttcaaagacaaaaactgtaattacttttggaccaacctaatagcctgattagcagtgtcttgctcacagtaggcctcatggcatcatatctcttccttaccatcattcttcatatatctataaaaattctttgtagtagacagtaaaagccttaaagttaccattgatttattgagcaatctaatattttttctaataaatatattaagataatataaattttaaaatctccattaccctctagtctattatattttcttactgattgaatcgttatgctaaggcaattctaatcgtaaggactatgggttgatttctactcttaacctgaaacaagaataaatttgtcatgcagacaaatttgcataatgttcaaaacataaacatatgccaggaattgagaggtctctgagggcagggacctggatttcctgtatgcctttccttctcttctctctagtctactgccattctttaatatttttccatatttaataatgccacatgttatcatatattgggtagtgggcagggatatggagaaaatcatatttttgccccagaatcctctaccaagaatattattaaatttagaagattttatatcacattattgtttaccacatttattgcacataaactcaattttaaatcttataattatcttttgactagttcagatatatttaattattgtattttctttatgtaaaaagtattgttattaaatgtaaacatataaaacaactcattttcacaaataatttttagcattttaattttttaaaattgcaataaatattaagtataagttactttgacaactaaaagacctttattacttatgttaataaatctttctagccacctgaaattagtatatcttttcaaaaaattcactatatttttatgtgtatttgcagccactcaccatttagcctttgttttatgactctagggaattcttcattaaaagctttagaatagtcagaatgtgaaacagaagacagatctatataaggctcttcctctctcatccttctgttaggaattctgccacacttttggtttctgatgggtttgatgtgacttggccttaagtttgggccatcctttaaacaattaatctgtgttctctgccacatgcttccaaacaagtgtagcttgacttcttatcttttatgatatctgaaaacccttcagcctacagagacacatacacttagtcttttggttgctgattccagttgaggacaatactaatttttctagcctgcatccgaactggcatctttccacaatcttgatcctgacccattgcttccatgtccaagacagcacaaaattctaaaatttttattttgttttatttagtttccttctctctttctgatagcaagaaggacacaaactagagaagcatctttgggcagtatgtgaagcctgctcaaaggagttgtaatcattctcatatatctcaaaactgaagataattcttgtcctctatgaagggtttctagtagctgctttgagagttcttagtttcctttctttgtattctcatccatggcagacattctttggcagcaattctcacctctcaggaaatagaatcatcactactgtggccagctactacagacaaactaaggtacattgagaaaaaatgcccaaacaaatgggttcttcccatatctcctccacttcacctcctcattcaccaactagctacaacaacaaagcccagttcccagattctctatgaaagaagttagactacaaatcaagcattctaagttttctagctcctacctgaggtctggcttctaactcactgtctatgagagctattggtgttgccattcactatttacatgtgggctatagaaaacaaagcagccattttaaacaggcatgtggatatttccacaaattctcccacttgctcactctaatgataaaagcaagcctctagcttcagtctggaaggaatttatctacatatctatccccttaacttttccagctgctacctgaggaactagctttcaactgacgtgtctatgagaactaatggagatcagcatccattaggcccatggaggctacagagatcaaagcaacagtttgaaaaagtctgtggtttgaatgagcttgcaaacatttgccatagttcttttccccagctcagttcagcatgagcagattatacacccagcttttccctgaggagagaagaaattggaaaatccagttagtgccccaacatttatggttactactaaaaaggatcagtatctcacctgtttcagggcaatgatgagagctggcatactctggacacccagagaccactgaaagcagcaaaagaaaaacaacttgttatgtgttagggaaccctcctatgatcattggtggattttcagcagaaactttggaggccagaagggagttggatgatacatttaaaatgcggaaacaaacaaacaaatacacaactgccaatcaaaacagtatacccagaaaattatcctttaaaacttaagacaaaattaaaaaaatcgaaagctgagggagtttattgccactagacttgtcatataaaaaatgctaaagggagtactttaagttgaaatcaaaggatgctaaataacaatataagagcatacaaaagtataaaactcatcggtaatggtaaatttatagaggcaaataaaaaatactatattattgtggttgtggtaggtaaatcacttttaattctaatctaaaatttaaaaaagtattaaatataggtataactaaaattacattaatagatacacatgttaagatatgtaaattctgatatcaataatctataatgggaacaaggtaaaaatgtgaagtttttgtgtggaagagaagttatcagttttagattattataattatattttatgtaagactcatgtcattcacacagaaaatagccatagtacttaaaaaagaaaatctactacctacagtagttaaaaaactagttataaaagaaaaggagaaaggaattaaagcctgtcaaacaacaataacaaaaaaagaaacacaaaataagacatcaagaaagaaaaaaaggaacaagaaaaacagcagtcagtaaaatttcaatagtaaatccttccctatcaatagttactttaaatgtaaaaggattaaactgcccaatcacacgatattaactggctgaaagaataaaaacttggcaccaactatttaaggacacacatagttaaacatgataggatggaaaaatatatattttatgcaaatggtaatgaaaagaaagcagaatggctatacttacattagacaaaatagactttatgtcaaaaactgtctccaggggcaaagaaggtcattacataaagataaaaaggttaattcaataggaagatataactattgtaaatgtatatgcactcaatatcagatctaaatatttaaagcaaacactgacagaactggagaaatttatagcagcacaataatactagaagattttaatattccacttttaataatggacagaacatccacagagaaatcaatggaaaacagcttacttgaacaataggagagaccaaattaacctaacagacatctacagaactttttacccaacaacagaagattgtacattcttttcaagcacatatggaacactcttcacaatagatcacctattagataacaaaacaactcaactttaagatgatagaaactgtatcaagtatcttttcaggtcacaatagagtgaaagtgtaaatcagttaatggtaaagaaacaagaaaccatatgattcacaaatacatggaagctaaacaatacactcttgaacaatcattgggtccaagattaaatttaaaaaattaaaaattacctcctgacaaaaatgaaaagaaaacataccaacagttgtgagatatagcaaaagtatttctgagaaggaacattatagcaactgggcccaatctgttttccattgccaatgcactactgctaaagctgtgcaatatcaaacaacctctctctaggctcagggaccatcttggaagaagagagaatgtgaaattgtaaaatctgggtcagataggtggagtgtacaggctaaaccaattctgtcttaaatgctaatccaacatgttggcttttcattaacctcggttctgggaatgcctctaagatttttactctactactgttaagagcacacacttaccataaattctgaccaaattacttcaattctccttacctatagtatataagccctgggttctgggggttaatggcatggggatccaccatcttgtctcacagcctcgagagacatggcttctgtttgttaatacctattaaatgtttctgaggaagaaaaaaaaaaagaaacatctcaaataaacaacctaaaaaaataactagccaaagacagaaaaaaatacatactaacccaaatattatcagaaagaaggaaataatgctaattaaggcaaaaaataaattttaaaaaggacaaaaaagctatttcaaaagtcaacaaaactgagttgtgttttgaaaaagacaaataaaactgacacatcctttcctagagtaaccaaagagagagagaagactgaaataaataaaactgtatatgaaagaggaaacattacaacagatgtctcagaaataaaaagagcccttaagggactgttatgaataaatatacaccaacaaattagataaatgcgaagtaatacataaattcctagaaagatacatcctaccaagattgaagaagaaatagaatagtccagcactgcatggctttgtgggagaattccagcaaacattcaaagaattaataatatttcttaaactatttgaaaatctagatgatggaacacttacaaactcatttcatgtagccagcatcgacctgataaccaaagacatccacaagaaaagtaaactacaggccagtaaccttgatgaatgtagactcagaaatgctcaataaaatacaagcaaactgaatgcaacaacacattgaaaaaattgtacacaatgaccaactaggacttatccctggggtgcaaggatggttgaacatgcataagtcattcaatgtgatacactacataaacagaatgaaacacaaaaaccatatgatcatctcaataagttctggaaaaatatttgtcaaatttaatacctatttctaatttaaaaaactctcaatacaataggtgtagagaaaacctacctcatcacaataatagccatataagaaaagcccactgataacataataatcaatggggaaaacccaaaagcctctcctctaaaatcctgtacaagatttcctgctcttgccacttctagtcaagaacaatgatacaataaaaagaaatgaaagacattcaaactagacaagaaacagtaatattatctctgtttacagttgacatataggtgtataggcagaaaagtctaaaagtctcaatgacaaccaaaaatgctacaattaatacatgaatttagtaaagttgctctaaataaaagtaagtggcatttgtagaggctaaaaatagattatctgaaaggaaattttaaaaatcctatttatataataataagaataaatactttgaaatatatttaatcaaacaggaaaatacatacactgaaaattataaagtattaataaaggaaaatgtttactttttgcaaaatacaacatttttcttttttagaaaacttttaggtttaggggtatatgtgcaggtttgttatataggtaaaattatgtcatgggggtttgatattcagaatgtttaatcacctgtgtactaagcaaagtagctaataactacttttttcagatcctctccctcttaccctccaccttctggttggcctcactgtctggttgttgctgtctttgtgtccatgtgttttcatcatttagctcccacttataagtgagaacatgcagtatttctgttttctgtttttctgtccctgtattagtttgcatagaataatggtctcttgctccatccatgttaccgcaaaggacatggtctcattctttttatgactgcatagaattccgtggtgcatatgtaccacatttactgaaatgaacatatgtgggcatgtgtctttataatacatcaatcatattcctttggctatatacccagtaatgggattgctgggtcaaatggcagttctgtttttggttctttgaggagttaccacactgcttcttacaatggacgaactaaattatactcccaccaacagtgtaaaagtgagccctcttctccacaaccaggccaacatatgctactttctgactttttaataaaaagctttctgactggtgtgagatgttttctattgtggtttttatttgcgtgtctctaatgatcagtgatgttgagcttttttaaaatacttttttttggctgcaagtatttttttgtttttgtgtttgaaaagtgtctgttcatatacttttcaccctttttagtggggctgtttgtttttttcctgtaaatttgtttaaattccttatagatgctagataatcgacctttgtcagctacataatctgcaaataatttctcccattctattggttgtctggtaactttgttgatagtttcctttgctgtgcagaagctctttcatttatttattttttgactatgtttccaatatgacctttattgagcaagtactgctatgacatttcacatcgatcaacataagattgcaaactgtccgtgtcaacgaggttctcccatgaagaaaagtccattttaaatgcaccagtgtggtaaacataattattcatatatagctttcttaaggctaagagagttctgtgtttcatttattgtttttggctcagttggtactttacataatacatctcaagacatctccccttctgagtgacccccttccaacagtgcaggaaattggtaaatttcccaggtacatacagtatcatgcatttgaatcccccaaagactgaggggggagcacactgagcttgcatgcagtctcctcatattgcacaaagtaaaatacaatgtctggagcccctatgggagaatctgttctgttttgaagctgtcaatcacatgcattttgaaattgtcgtatggcttaaacttttgcagtggactcaaatcttagtcactctgggtgacttcctttattacggcatgtgaagtgacattttctacctttttagtagacactggtttctcctcaaaggtctcttcatgctcttcgaccatttgagtgatggttacagttttagtgatgtatttggtagcaccatctccctctcactggtgattttttctactattttggtcaccaccactttatcttcatttttatcatcccccttcttttcatctgctgggcttaagtctaggtcattggtgacaatgtcttactcctcttccctcccactgccttttgccttggtctcctgctctcccttctcttttccttctacctctccattgacagctatgtctttcttcctggattccttggaatctttatcactcccttccttctcattccccatttcctcccactttctcctctttctcctgttgctgtggcttccctcttctttggtctctttctccaagtgcacctttaccaatttggtaatggtgactgcctcctccatggcttcctcctttaccagggactcagctttcttcttctctggcacatccattggtttctcttcctttttctctaccttctattccttgggagcttcctcgatttccttttcttcctctttctgttcacctttccccacttctgcttttgactttgcctcttcctttggtgattttggcacagtagacttggctttttctggcttttccaccttggtgtctgccaccaactcctccttagtggccacttcctcactcttttcctcaactttcttttcctctttagctttggcttcctctacttcaccttcagcctctgtttctccttctttctgctcaccttcctctttttcactagaggcttccttctcagatcctccctcttcagcttggtctaacttatcaccctcatcttttacctcctcttcttcttccttttccccttctttctttccattaacttcaggtgcagttgctttcactggagactagtgtaccagtttttcaattagtttgtcaatttttgcttttgctgtgattgcttttggcatattttccatgaaatctttgtcagatcttatgttcagaatagtattgcctatgttgtcttccagtgcttttatagttttgggttttacatttaagtatttaatacattttgaattgatttttgtatatgatgtaaggaaagggtccagtttcaatctctgcatatggctagccagttatcccagcacaatttattgaatagggagttgtttccccattacttattttttgtcagttttctcaaagagcagatggttgtagctgtacagacttatttcttgactctctgttttgtttttttggtctatgcatatgttcttgtaccaataccatgttgttttggttactgtagccctgtaggatagtttgaagtcaggtagcatgatgcctccggctttgttctttgtgcttaagattcccttgattatttgggctatgtttttggttccatatgaattttaaaattgattttttttctagttctgtgaagaatgtaattgctaattggataggaataatgtagttgctaattagataggaataacattttatgtacaaattgctttgggcaatatggtcattttaaccatattgaatcttcctatccatgagcatagaatttttttttaaatttatttctgttatctctgatttcttttagcagtgttttatagttctcattgtagagatctttcacctttctggttagctgtattcctaggtattttattctttttgtggcaattgtgaatgggattgtattcctgatttggctctcagcttggctgttgttgatgtatagcaatggtagtcatttttgtacattgatttttataccttgatactttgctgaagttgtttgtcagcttacagagctttcgagctgaaactgggcttttctagatatagaatcatttcatctgcaaacaggattagtttgacttcctctcctcctatttggatgccttttatttctttctcttgcctgattgctctggtcagaatttccaatactgtgttgaatagaaatagcaagtggagaaatcatttttttggtgctggttttcaaggacagtgcttccagcttttgcccattcagtctgatgttggctgtgggtttgcaatatatggctcttattattttgaggtatattccttcaatacctaatttgtaaagagtttttaacatgaagggaagcagaattttttcaaaagtctttctgcatctattgagatgttcatgtggcttttgtctttagttctctttattttataaatcatatttattggtttttgtatattgaacaaaccttgcatcccagggataaagaatattgattgtggtggattcgtgatatagtgctggattcagctgggtagtattttgttaaggatatttgcatcaaagttcatcaagtatattggcctaaagttctcttttttgttgtgtctctgccaggttttgttatcaggatgatactggcctcatagaatgagttgaggagaagtcccttctcaattgtgggggaaccgtttcagtaggaatgcaccaactcttctttgtacatctggtagaattcagaagtgaattcatctggtctagggctgtttttggtttgcaggctgtttattactgattcaatttcagcatttgttatagttatcttcagggatttaatttcttcctggttcagcttggaagactgtatgtgtgtaggaatttatccatttattctagattttctagtttgtgttcatagaggatttcatagtagtctctgatggttatttgtagttttgtggggtcagtggtaatattccctttctcatttatgattctgtttatttggatcttctctgttttcttctttcttagtttaaccagtggtctatctattgtattaatgttttcaaaaagtcaactcctggcttcgttgatcttttgaatggttgtattatgtctcagtctctgttcagctctgatttggtgtattttttatcttctgctagctttgggtttttttgtttgtttgtttttgttgttattttgttgttgttgttgtttttctcttgcttctgtagctttttaactatgatattaggttgttaatttgaggtctttctaactttttgatgggggtgtttagtgctatgaatttccctctcaacactgccttaattgtgtcccagagattctggtatattatatctttgttctcactaatttcaaaatacttcttgatttctgccttaatttcattatttacccaaaagtcattcaggaacaggttgttaaattccatgtgattgtatggttttgactgattttcttgttcttcaattctatgtttattgtgctgttgtccaagagagtggttggtatgatctcgtttcttttgcatttgctgaggattgctttatgtttgattgtgtggtcattgttagaatatgtgttgtgtgtacatgagaagaatgtacattatgttgttttttgatgaacagttatgtagctgtttcacagctcaatttggtccagtgttaagttcatgttctgattatttttgttaattttctgcttaaatggtctgtctaatactgtcagtgggggtgtcaaaatttccccgtattattgtgtagtagcctaagtctccttgaaggtccctaagaacttggtttataaatctgaatgtttctgtgttaggtgcatgtatatataggctagttaggtcttgttgaattgaacccttttctattatataatgcccttctttgccatttcttatttttattggtttaaaatcttttttgtctgaaattaggattgcaataattgctttttttctgtgttctctttgcatggcagatttttttccattcctttatttgattctgtgggcatcactgcatgtcagatgggtctcttgcagacagcatacaattgtgttttggttctttatccagcttacattctgtgccttttaattgggaaaattagttcatttacattcaaggttagtattaatgtgtatttgatcttgttatcctgttgctgtcgacttattatgctgacttgtttggttgctttatagtgttactggtctgtgtccttaagtgagtttgtgtggttgctggttatggtctttcccatccatattaatgcttccagaagctcttgtaaggcaggtctggtggtaataaaatccctcagcatttgcttttctgaaaaggatcatatttcccttcacttaggaagctttgtttagccaaatataaatttctttggctggaatttcttctctttaggttattgaatataggtcccaaatctcttctgacttgtaggatttgtactgagaggtctgctgttagtctgatgggcttccttttgtaggtgatctgtcctttctctctagctacttttaacatttttttctttcattttgaccttacagaacctgataattatgtatcttggggatgatcttcttgtgaagtactttgtgggagttctcttcattttctgaatttgaatattggtggttaggttggggaagttctcatggatgatatcctgacttatgttttccaagttgctttctttcttctcatctctttcggggacaccaatgagtcataatattggtctctttatatattcctatatttcctggaggtttgcttcattcctttttattcttttttctttattcttgtctgaccatcttatttaagaaaaacagtctttgagctctgagattctttccttagcttggtattcttctcttaatacaattgcattatgaaattcttgtagagtgtttttcagctctatcctgtcatttatgttttttgtttgtttgtttgtttgtttttctgtactggctattttgtctgttaccttctgtatcttaatattgtgattcttagcttccttagatgtggtttcaacattctcccaaaactcaatgatttttattcctatccataatctgaatgctatttctgtcatttcagctacctctgcctcattaggaattcttgctggagggctagtgtgctcatttggaggaaagaaggcactctggctttttgagttgtcagagttcctgcactggttctttctcatctttgtgggctggtgttccttcaatctttgaagttgctgtcctttggattttttttcttttattctattttatgaccttgagggtttgattatggtataagctgtgttcagtcacctggctttgttagtggaagacttcaggtggccaaggctcagctcagcactctgcattgtgtgctctaactctgggagactggtatcatacaccagctattacctgtggatcaagtttaggaacctgctgcactggaggggtcaatgtgatctcagactgctggtcacaacactctaatggctactcccagccaaagcattttgtaggacagtcgtagtgggatgtgtccacatttgcatgtaccagcggcatcctccatccacatggaagatgacagcctccatgtgggtgtttgtagtagtggctgtggcggtatggtttgggaaggtggagggccctgctggcaatggtgtgcacatttgtactggtgctggtgttagcacagggatggggcgctagtggtcgcaggactgtgtgcaccctctgtgagcattcttgcttacagcagtgacctctcagggatgggagtagatacactgttttctgtgcttagtttcatgccagcagttttggcacaggagtggagcactggtggtggcagagctgtcaaactatatgccctccaatgctccaacaaaaatggcagtgcaacagggggagaagggatggggcacactcaagccagcaatagtggcatggcatggcatggtacatgtgtacacatgcactgtcagagaaggaaaggctaggtctgtctgcaaacacatgtacaggcaaagagatgtatggggatcgctggcagcgagtgcctgccagcaaagcagtatggaggaggctgtagtgtggggaggacatgggcagtcttatatgtatacacagggtttgctcttctggagcactctcccagtcagctgcagtccaccagtgcaggagcaatgaggcaggcccccttgaggtgcctgggggggtacactgctagcaggtacaggcaggctggggcccaaagagaagacagcacaccaaagggtgctcagggggcctggctcatctcatgggcaagactgctctacagagtctacgttcacccctttccttagggctaatgtctactataggagcaaatcaagcctagggggatgggcatccctggctgttctccactatagatgctcctgcaccaaaccccatgggctctgctgcagctggagttctgtccctaccacttcactaagtagctttctctgccaactcaagtgtccatggtggctgacaagactcctcctgctatgattccagaggctcatggtgagagtgagttgctcatttctgttcaactcaccccttccacaggagttgctgggagccaggaatgagtcctggtgtgtggtagccacatgcagcattcccagcttcatctccctttatcccaccttctgtatcttctctctatctgctctcaatgccttccctctgaagatttactaggggtacacccgtcttcctgatgtcgtggtccctctgtgggagatgtttctcctggctgcatctagttggccatcttggaggaggaatcaaggaaaaatgttaaagcatagataaatgaaaaaacattcatccatggaaaataaatgtttatgaattgaaataattaatattgttttagtagccatgctagccaaaaggaatcaacaggttcatgcaatccctgtcaaaattccaatggcattctttacagaaataggaaaaaaaattctaaaatttatatggaaccacaataaactccaaatagcaaatagctaaaccaattatgagcaagaaaagcaagctagaggcatcacactttctgatttcaaaataatttacaaatctaatcaaaacagtgtggaatttgcataaaaacagacatatagattaatgcaagaaaacagagagcccagaaataaatccatgcacttagagtaaaccagcctacaataagggcaccaagaatacacactggggaaaaggtattttcttcaataaatggtgctgagaaaactggatatccacatgtagaaaaatgaagataagctcttaccacatacaaaaataaaaattaacttaaaatggattaaagacataaacataagacttgaaactgtaaaactaatagcaaaaagccatcaggaaaaagattcttgtcattggttctggcaatgatttttttggatatgagagcaaaagcacaggcaacaaaaacaaaagtatagaagtggaattgcatcaaactaaaaagcttctgcacagtaaaagaaacaatcaacagactgaaaagacaaactacagaaaatatttgcaactgtatatctgataaaaggtaatattcaaaatatataaggagttcacaaaactcaatagaaaaataaatttacaaaaatggacattaatccaaagatgtacaaatggcaaacagctagatgaaagacgacaggtcaataggtagatgaaagatgaaagattaatgacattaattatcaggaaatacaaatcaaaaccacaaaaatgtatcaccacattcctgtttgaatggctattatcaaacttcaaaatataaattttgtgaaggaagtggagaaaaaggaagacatattgatgggaatgtaaattggtgtggccattatggaaaacaatatgaagattcctttaacaattaaaaatggaactaccaaatgcttcagcaatcccacttctgagtctttattcaaaggaaataaaataattttgaatcgatatttgctttagttttcatttcagctttatatacaatagctatggtatggatacaacttaagtgtccatggacagataaatgaataaggaaaatgtggcatatacctattgtacagcatggtaacagtatatctaatgtacaacattagatatgttttacattatggatgtgatggatatgttaattagcttgattatgatgatcatttcacaatgtatgcatatacaaaaatcaagttgcacaccttaaatatgttcatttttacttgtcagctatacctcaataaagctgaaaaaagaaaaatggaagtcaggaaggaagtcgaaggaagaaaggaaaggaggaaggaagggaaggagggaggggaggggacaggagcagagaggagggaaaagaaagaaaataagtgctcaaggaaacgtgagctctacaatggaacaaatgcttattttgctgtgctttatggatttaattttaacttgcatattgctagtttgaatatcacttttgacattcattatccattgttaaaaacagaagaaaatacccatgcatggttttgtatgctctatatttaccactgtgttcacaaatgtaagatgctgctatgatatttgcttctccttgggatagcctcaagtgtaggtcatagcttttttggaacattgattgtcattgaaaattccatggagcattgtcattgtaaattcctgtacacttgaagcttcacattgggttctgacaagattgggtcatgttgagcgtagttgggactgaatgagacatattactttttatcagattgtaatgacaggtttaaaacagttgctttcaggtgaatgataactagacaagctacttttttcatatttttgagatcagaatattatgaaataattcaaatttcccaaatatgtaatatagaaaaattctaagtttcattttaatttttcatcctatttttggttttattcattagatattggcatgttgaagttctttttaaaatgtattttaaaattgttttctagctgtattagttatctactgctgtcttagcaatttatcacaaaattagtgccttaaaacaacacaaatgtaatatcttatacttctctaagtcacatgcttgacacaggtctgacgattaaaatcaggttaaattggcaaggtaatgctactttctggaggctctaggggagaatcagttttctcgatctttctagcttatagtggccacccacgtcccttgacttctggactccttttgttttcaaaactagcaatgttacatttgcctgccattcttctacaatcacatttctctccctgaccacagccaaggaaggtttaatatttttaaaactaatgtgatgagattgggtctatccagataatttgggacagtttttccatatggaggttcttaactttaaacacatctacaaagtcctttttaccaggtaaggtaacatattccaaggctcttggaattaggtaatggacatataacagggcattattttctgcataccacactaggcactggggttctaggggcttcgggcatttggctagtggctaggtcctacagatgaaatagagacaaatccaatatgtgggtatatatgcataagtaaaaatacattcccctctgctaatggtattatttttaatttactttttactccattgaatgtttaccaactacatgtacatgtaaatactattatttctgggtttttagaccccttcccaaatgaggtaacagaaagatattttatttttgtgtctcggtttttttttgtttgcttgtttctagtttgtttgttagcttgtgtcatacagggaagtcacatgtaaatgtatggatttagagggtgcaaaatgctttcacacagtttaactcatcagattcttacaacaatccctttaggtaggcaaagcacttttactctgctcttctctctgcctgtaacagatgagggtctttaacagatttctatcagagcaggaaataaggtgttcccagagttacacagcatctagtgttgtgctactttgctcaaccattattatagcacatctcactaatgttcttgaggaaaataattctccgtagataatattaggctgccagaaatatttaagccatttttggaatgttggtcccgaatatgtgtaaacctctgtattctaaataaccatttatatattggcgctaataaatgatggaacgcagaaaattacaaaagtcatccaaaacatcggtttaagcaagaggtaatttttggactgatatatcagatctgacagccagcaagggatgataaaatcagaccaagttttggagtcaggcaaatgtattcggtcacttctgagttatatgactttgagcaaatcagttatgttctttctacctgtgtttttctacttatagtatgggcatgataacactttattgtcatatgggtgcaaaacaacatagataaaagtgttttattgtttaaaagttcactaaatggaataaaataacattaaattaatccttaataacactttaatctggagataaataaaagccaaactgggaaagtgattagcagttctttttgtcatacaaaaggccagttgggagtcttttcattgtctaggaaaatatatactgctgactaagataatgacaaatgctcattgccatggtatatatattattccaatacacagaatttcatgtcaaggggatatttctttattcttacgtaatgaacgggccgggcacagtggctcatgcctgtaatcccagcactttgggagactgaggcaggcagatcacaaggtcaggagatcgagatcaccctggttaacatagtgaaagcccgtctctactaaaaatagaaaaattagccgggtgtggtgggcacctgtagtcccagctactcgggaggctgaggtgggagaatggtgtgaacccgggagcaagactctgtctcagaaaaaaataaaaaaagaatggttgctatatgacagacactgtttggtaatcttgaaatatcaatgaataacacacacaaatatgcctgctctcttagagtctacatgccattgatagacataaatgataaacaataaaattaacaaataagttaataaacaaagagttcatataatatgccaacaggtgataggcactatggataaaacaaaatagaatggccaatgggggttcagagagagtataggaaaactggaacattaaatacagattatcagctaggcctccttgagcagaagatgtttaaataccagcttgattgaaataattacctaattttatttcttgaggaatagtgttccagggagagggaacagaaatattaaggtctcagaatatttgttgtgtttgataaagaccaaaaagataagcacaactagagtacaataaatgaagggtagattgctaggagatgagatagagagaaatggaaggtgggatcttttgaaacagtggaaatttcctttagactcttcaaaaatatgttgagtaatgattactaacatcaaaattattttttataaaatcatgtcagactttttcatctccttaaaaaaaagcaaaaatatgtactgagtatctgtgtttgggaaataacagagaacaagacagacacaaattctattactttctcaaacttttggaattcatttgaaaatatacccatgtttttaatatcaccatttttttccactagctagcagccattctcaactcttttacaaattatggcacatcagtccaggtgtggtggcttatgcctataataccagcacttaagaaggatgaggtgggagaatcgcttgagcccaagagttcaagactagccccggccacatagtcagaccgtgtctttacaaaaaatagaaattagctgggtgtggtcacatgcaactgtagtcacagctgcttgggaggctgaagtgggaaaatcgcttgagtgggaagtagaggctgcatggagctgtgatcatgccactgcactccaggctgggcaacagagtgagatcctgtctcaagaaaacaataacaacaaaacacaaagtatggcacatcactgattcttacagacataactatatatttccctcacatatcttcacacagctttaaacctgttggttatgaaaaactcccacatttcatttacaaattaatatgaagatgtatatcttaaagtaggatcacaagagcactgataagtgtctttaatcatgtaagtgaaaaatgtagttttaccaaagctaatgtagttacttttaattgaccaacaaatatattgtcattactattatattattggcaataattatgtcaccagttgggatgccttttccataattatgtttagaaagacgatacagaaacatacataatagaagcattatcttaaaattgatttagtgtcatttcctcttaaatatttttctgttgatgtaacactaagctgtgtgtcattcactttaaacaaacagataataagttaatacccacacttctcgctttacatggtagtgaaggatgataaacatgataatctcagctgaaatcatgcaagtttatcttaataatcaagaataaatattattccataacctttaatttcttttcaaaatattagaaactcttttactgtcacttacaaatgtgtaggaaaataaataaattataaaacatattcatttaacatcctggaatttacactgggaataaaagaattaaagtcagttctttctttctataactctgtttatattcaactcatatcttacattattattttttgcatcattattttcatttgtttgctatactttcacatatgctggccaattccctcttaattacattgatgttaaagacttaaagtttacttgtttgttaaaaaatgtttactaatagtttgaatagtgattgatttcttcttacatggcttacaatgaagggggcaatgttttatgccttggcaaattgtcataatcttaaatttggatcagctttcatcactttatgctttgatgctttcaatattgttaagtatctctgtaagttcctttaatgtaagtcttttttttttttattgtgtgtttgggtttttgctggcgtcacttagcctgatacatcttcatccttttcatcacatccactttcttcatttatgtcaataagctcctctgcactaagttgttctggctgcaaagcttaagttcctcagatggcagcagtgtcaatattcccacagggattttgctgtagctccattttcactggactcaacgttttactttatgttgtacttttatcttttctggccaattctttcaattatttatttttaagaaatggcacttgtgtttatcaatgggaaacagagacaacataactgcacacttttctgtctgcatgtgatgaataatagatgtgtagtgatcaatcactgacagacatttaaaaagatgatgccaatggtcactgatcatgaagcacacctgttatttacataatgattttggaccaaagagcaaggagcaaaatttgtacttatgtaattacttacagttaatacactgtggtagctgaaatttgaaattttattttttataaaatcatgtcagactttttcatctccttaaaaaaaagcaaaaatatgtactgagtatctgtgtttgcgaaataacagagaacaaaacagacaaaaattctattactttctcaaacttttggaattcatttgaaaatatacccatgtttctaatatcaccatttttttctactagctagcagccattctcaactcttttacaaactatggcacatccgtccaggtgtggtggctcatgcctgtaatcccagcactttagaaggatgaggtgggagaatcgcttgagctgggtaactggtctaacttaactaaacatggtgactgaaatgtatgcatataggaactgtaaattgaggagtacctgtaaataggaatgctacaaggtcatacatatcttgtcccaaactaaactttagcatttgctagttatgtgatatcaggaagcaatataatttttctaagccttagttcatctataataaaaaatatgatatggtctatgttataagatcgttaaaaagattaagtaaggtgacacatatcgaccaagtactttataggtccttagtaaatagccagtatatattagctaatggattattattgaattattatttctactccaccagactaataaacctcttgaagttaagaccttttgtatcctcattgtgtagcaaaaggcctggaacatagtaggtactcaatgaatctattttaatgaatgaaacttaccttctccatttctagaatatttcataaataaattgtgtgacacactttttaatctgtcaaaatctattttcagaaaaatttaaaaatttactccactttccctaaatcccatctgtaatggaacagcaataactgatctttttacaaagaaaattatattacagaggtgaacataatcaaatgctacaaaactgggtctaattttcctgaaaattaatcttaaaggaaaatactgggagtaattttatttttgacttgatttaacaatcaattttattaattttattgtcccttctcgggcagggctatctgcacaaatctgttgagctttttcagacaccatcagatcaacttacttgtgcctctgaggcagagatgaagtggctatttttcaaatctcaagtgccctacccacaggaaaggaatattatttttcatttaatgagctgtagcacatgaacaattaagaagacataattgaatgaagctaatcagcaaaaagcaagagcttgcctctgggaacctgctgaagttgattgcggctgttatctgtggttttatctgttaagctaatagtaccaatgagtgggaaaacagtgactagtaattgcacagtcctcaccgcctcccccaccaagtcttaaattaaaaaaaaaaaaaacacatattgctaggaggactgatgatgccaatgaaatgaatgaattatttgttaactattggttagcctacagctatgaagttaaaaaaaattaaaaattgttcttagtcttgttattaacaacagttctgaaggttagctttaataattgtaagaaagctctccttattctaaggtaggggggtaagccattaatgaagtgtagtttaattagaactttgttgaaaaccttaataaagccgaagttttaaaatattcagcctcctaaagaaactgggaatttctgtacctcttagttgggaaacggtaattcataggaaattgctacttggggagtaccaaatcagaaactggaaaaccgcacaggatagatattccaattaaggttgttcagcttatatttgaattgtgcactggatggtttatttaatctaaacctttagggcagccaacttctgtgggtcatttacagttttaaagagacttaaagagcctataaatctagagtccctgaaaaatgactttcttgagccaatttatatactaaaatgttatttgtatattgttcttagaagactttatatgtacaatttggtaaaattttcatgtaatgaaagcaaacctaccatttggttgaagcaaacctaccatttgcttgttacatgcttattcttatcatcgttcctgacattgtctttactttttcttccttgttttgttttattaattgaaaatagccacatttttatatgactagactatcattgctaatggacatttggtcacattctttttatttacagccatgattctgatttatattcagtcattacttgatttcagtggtccagccaagaactcagcacagttatgcttcctacacagcagagagatactgaatggaagattagagggatgaactgggttaaaattacaaggaggatatcataggaaacaagaactagacatgaatcaagatagaataaagagaaaaacaaattattgaagcagtagaaaaccagtaaggagtaaaagaaagaagatatgaaaatatgttattgtggataatatattaccctggatagatttaggggataattttatcaatatggtgaaattttaaaaacttgttccatatatctcaactttgagaaaaaaaactattgagagtgtttgtgacctgtttaatagaagcaaatacagttcctttaaaaagtcagggtcttgctctgtcacctaggcctgagtacagtggcatgattatagctcactgcagccttgcagactcaaaaccctgcatccaagtgatccttctgcctcagtctctcaagggtctaggactacaggtgggcactaccacacatgactaattttattttcattgttttcctttttatagagatggggtcttgttatgttgcccagagtggtctcaaattcctgagctcaagtcattctcctcagcttcccaaagctttgggattacaagcttgagcatctacacttgaccttaaataatatattatgtaataatgaggtgattgatatgttctgccgttaaaagtaaacacctttctttccattctgaagcatgtgtatctttattgtttttattaatatactaaataaaagaaaacatggtatatttctttctttagatcaaatatttttctattgatcttttagtcgaatcttaattttaaatgataaaatgaagactaccatttaggcaatagatttttgtgtaccattttaacttcaagtaaatggtggtagctaaatagatctacctttgaaagtttgttgggtaggtgttgaatatgctttagagggtgtctattttcactcattttctctttgaaagcagaaaaaaatcaattccttttctattaagacttgtaaatgaggtttataattgaagcaactgatatggttgattagcatatgaacttttttttagtagaaattgggagttgataatcttatctactgaatgcttgtatgttagaatttctatgtgtttggataccattaaccctacaggtctgtgtatcccttcccatccataggtcaaaaataaaagcatttgcccattgtggtatcccttactagcatatctctctccttatattcattttagtgttgtctacaggcccacacctagtcttgccttgagatacctttaattttgtcctctccatgaaaaggtaacataaaccagccctccacttagtaaaataaaatggaggaaaataacaattatccaagtagcacaagtaaataaaagacattatagaatcattctaattcctcaattgtttggtataatagtctatattttatagccattggattaaatttgttaattgcatggataaaatatttcatatgagaatttttgggtataaattcaagggtataattttattttcataaagttaaaaaaggaaaaactatatactgtttaggggtgcatacattatagtctgtctatcaactatggcaagtaataacgcaaaattcaggatagtgtaagaaaaggtatgcaagagattcttttaaatttttttcctgatcaaaaagctcagattgtatatatgcaagatattctaagataccagtaactgaaatatgtgtatctttattgtttttattaatatgctaaataaaggaaaacatggtatattcctttctttagatcaaatattttcattatttttatttttttggaaacaggttcttgctctattgcctagagtgcagtggcaaaatcatagcttactgtaaccttgaacttctgggctcatgtgatcctcctgccgagaggtgtgcaccaccattcccagctatattttttaattttcttcgtagagacagggcctccctacattgcccatgctagttgaactcttggcctcaagcaatcctccagccttagcctcccaaagtgttgtgattacgggagtgagacaccacaccttgccagtaatgttctatttcttaaattgggtggcatctagtgtacatttatatttcatattgtattgtttaaaaagaaaataagagcacctaccgttttgtttgcatatatgtatttcctcaagaaaatacatgataaaagagtatgtgtaattatgacaagaaaaataatgtcttgattataacctgaccaacatatagattcttcattttacatctggtgttactgaagctgtaaattttaccagtcacagattcaatgaaattatcatgcgatccaatggaacttaacaatctttatggaatattttgtcatttgtttgttggctgtttgtatgtcttcttttgagaagtacctcttcatgtcctttgcccactttttaatagggttatttttttcttgtaaatttgtttaagttttttatagattctgggtattagacctctgtcagatgcagaattcacaaatattttctcccattctgcaggttatctatttactctgttgatctttttaaaatttttttatattgctgtgcaaactctttaatttaaataggtcccaattgtcaatttttgcttttgttgcaattgattttgaggatttagccataaattgttttcctagcctaatgtcaaaaatgatgttgcttgggtttttttctagggtttttatagtttgaagtattacatttaaatctttaatccatcttgagtgaattgagtgaatttattatatggtgaaaggtaggagtccagtttcattcttctgcatatggctagccagtttttgagtaccatatattgaacattacccagcgttcacttttgtcaactttgtcacagatcgtatgattataggtgtgcagctttccttctgggttctcttttctgttccatacgtctatgtgtctgtttttgtattaataccgtcctattttggatattgtagacttattgtatagctgaagtcggataatatgatgcctctggcttttttctttttgtttaccttcctttagctattcaggctattttttgttctatattttagaatcctatttttctatttctgttaaaaatggcattggtagttttacaggaatagcattgaatctgtaaattgctttgggcagtatgaccatgagtaatactcattcttaccttccatgagtgtggaatgaatttataattgtgtgtgtcatctattatttctttcagcaatattgtgtagttattacagagatctttcacctctttgttggatgtattcatagacatttaatttttattgtgggtattgtaaatgtgattgtgttcttgatttgactctccacttgaacattatagaaatgctactgatttttgtatgttgaatttttattctgaaactttactgaagtcatttatccatttcaggagcctttcagcagagtctttgaggtttccttagtgtagaaacatatagtcagcaaagagaaatagtttgactgcttttcatatctggatgtcttttattactttctcttctttgattgctctaagatttccagtactgcattgaatagaagtagtgaaagtgagcatccttgctttgttccagttctcaagggattgatcccgcttttgcccattcagtatgatgttggctataggtttgtcatagatgactcttattatttttaggtatgttcctttggtgactcattttttaagtatttttatcatgaagagatgttagattttatcaaaagctttctctgcatctatggagatgatcataattacatggtttttgtttttaattttgtttatgtggtgaatcacattattgatttgcacatgttgaactactcttgcatcccagaaataaaggctacttgatcatggtatagctatttgatgtgctgttggatcaggtttgctagtgtttggttggagatttttgtgtttatgttcatcatggatattagcctgtagtttttctttttttcattgtttatctgccaggttttggtatcagggtgatgctggcttcatagaatgagttacagaggagttcctccttaattttttgtaatagtgtcagtagaattggtagtaggacttctttgtatttctgctataatttggctgtgaattatgtccacctggtcagggacattagttgattcatagggttttttatgactgattcatttgttcagagttgcaatttctttgtgattcaatttggggaggttgtatgttttcatgaatgtatcaatttcctctagattttttagttcgtgtgcatccagtgttcataatattctcaggatcttttcggtttccatgtgtttggctgtaatgtcatccttgtttctgaatgggcttatttggatcttctcttttttgttttgttcatctagctggaggtttatctctcttgtttatgctttcaaagtcccaacttttggtcttgttgatcttttgtatggattattgggtctctacttcattcagttctgctctgattttagttatttctttcctctcattagctttaggtttagattgttccttttcctccggttcccataggtgtaatgttagatcattaatttgagatctttctaacttcttgatgtagacacttagtgctgtaaatgttcctcttaacattgtataggctgcatctcagagattttgaaatgttgtgtgtcttcattttaaataattttataaatttccttaatatcgttgtttatctgaaagtccttcaggagcaagttgtttaatttgcatgtcattgtgtggttttgggagatgttcttagtattggtttctggttttaatctactgtggttcaagagtatggttgatatgattttaattttttgtgtttattgagacttgctttatggctgagcatgtggtcacccttagagtatgttctgtgtgcagatgagaggaatgtatattctgtggttgatgggtagagtgctctgtaacgtctactaggtccaactggtgaagtgtcaaatttaagtccaggattattttgttattttgcattgatgatctctctaatgctgtcattgatgtgttgaggtctcccattattgttttgtgcctaagtctttttataggttttgaagtatttgttttatgaattgggtgctccaatattgagtgtgtgcatatttaagatagttaagtctacttgttgagttgaaccctttgtcattatttaatgacattctttatccttttttattattattggtttaaattctgtcttatctaacacaagtgactgttgttcttttttgtttttcatttgcatgatacatctttctccaaccctttaccttgaactatgggtgttgttacatgggagttctgtctcttgaagacagcagatggatgagtctttgtgttttatacaacttgcaagtctgtgccttctaagtggggtgtttggaccatgtaaattcaaggttaatatttatatgtgaggttttgatcccattgtgaaattgctagctggttgctttgtagtttctattatatggttgctttatagggtctgcagactatgtatttaattgtgttctcgtggtggcagaaattgtcctttttttccatgtttaggactccgctgaggttgccttgtaaagctggtctagtgattacaaattcccttgtcagttgcttgtctagaaaatactttatttatcccttccttacaaagctaagtttggaggaatatgaaattattagtttaagttcttttagagtgttgaaaataagcccctaatcccttctggcttgcaagatttctactgagaagtcttctgccagcctgattgggttccctttgtatatgacttaaataatttatgccattcgaactttgtggaaaggaggagcagatttaaataggactaaaaaatgggtgagattaagttcttatggaatgctttaattgttcattagccttcaacagctaaatgagctgcacatttttattatatatttttgtcattctgaccataaaactgacaccagctaactgacttggaagacctaaacaaaatagtatcttattttaaaattactatgtttataattactattttaaaccatgtaggtatttcttaaaccttaggagatgagttcttacaaaaatctgctaaaatcattctctctagtgttttcctataaggttaatagttctgaaagaattaatttatattaaaaatacaaaatattaaatttttccaaatgtcacaatgttataatgagcattttctttatcaatcaagggtttgagactcatatttataaaaatgatggacaatgccacattaatcagaagaaagactgatttgtatgcccaagattaggggccctcaaactttgaaaggcacaaaaacttcctgcaggatttttttaaagaactacatgccagaatttacaccagaaatttaaaaagtacttcaaaaaggctaaggagtaggctaatcaacattttaaaacactacatagataattttattttgcattaaaacttaaccattgtgataaagtattaaactttccaaatgtatataaatcatccaaggcaatgtatgaatcaatgttatacaatttaatcctaatttactttcgattcatttaacttaattcgacatggtcttaagaaggactcatcagggataaggggaactgccagatgcctcttggaagaggaatatttatttatttatttatttatttatttatttatttatttattcatttatttaggcttaaacaggaactggcctcaaggccagaaaccagagaactccttcacctactgttcttctgagggaggactagtgcctccaggagatggttttataaagggactattagtgggcacactgggtaaggaatctaacctgtttcctgactcctgtaaggggcataaccagtaaattaattattataagaaatttttgtagcaatgctttgccttgaacttttgtttttaatttaattattctggattttcgtggagtgataccatgaaattaatatgatcaattaatcttgacttatttttttttccttttttgtattctcaccaaatgtaaccctgatttcttaatgtgagaacagttggacactacatttttaacttgcatttacattattcttgaaagcatagtttagagggaactgaagaatatgggtcaagaaattaaaattttcagccgggagcggtggctcacgcctgtaatcccagcactttgggaggccgaggcgggtgtattgtaaggtcaggagatcgagactatcctggccaatatggtgaaaccccgtctctactaaaaattacaaaaaaaaaaaaaaattagctgggcgtggtggtgcacgcctatagtccctgctactcagggggctgaggcaggagaatcacttgaacccagtaggcagaggttgcagtgagccgagatcgcgtcactgcactccagcctggggacagagtgagactgtctcaaaaaaaaaaaagaaattaaaattttcttcaggtctttcaggtatacattctgtgctcttcttttatcttcactacacctcaatcccctaggtgttcagccatcaatgtagacatttttctctatctttgcataaagacttccagtaaaaaaaaataacttggtggtctttaacagattgcgtactcctcaagagcggaactaccaatgtatttttttcacaaatgtctgaaacacactgtacattcaatattacttgagagaatagatgcactcttttactttgagtactaatggaacaaacatcactggacatttttggcaaataatctgatgtattactacactgtaactgtgagagtcagtgacgtggaccatactgtgttaaccagtgtccaacgttttatctgatctggatacaattcccaagaatttgcatctttttagactgactgagtctgactgaattccttacatttaaaaaaatcgcaggagaagtgctgtcataacccagagatcctttatcactcttttctttgataatttcatgacatgaataaagataattttcaaaaacaaataccggatagaatatatacaaagatcttgccctgcagcataccagtgtttggctttattcatctttgtctttcatttacagcaagttgtctttaaatgattagtattctgtgggaaatattctcacttttaaaggaggatgtcagctgatcagtgattttcattctgacttaatatttatttctccaagtctggtcttaacttaaatcgctaactacatgagtagtctacatatccaatgctaatttttatagaaaacttatacttaataactgtacaaaagggatcattgcattgatatggaactttacttggatacaactggaaaagcagcagttctacatcagcaaaagatatagatagataggtaggtagatagatagatagatggatacatacgtacatacatagataaatgataatttaaatgtaaccaactcacttagaagaatagagcttgtttgtttgtttgtttgtttgtttaataacaaggtaaaagatatgtatctaacttacaaattggccattggccagggcgatgaattgactatatagttcctgaagacatgttgtagtgactttgatgaccatgggcaaaactgtagttactccctagcaattcccattaaaatcaatgttgtgtggaattaaatatggcacaaaaacatgtgtcactgcttcagggctagccttctgttaaaattagtaagtgtcatgtgactcttatgtggaagtgtctgagaactaatttacaactctagttttaagaaagcagttgacttgtttattactaaatacctgttttgttctgatatttcttttctttgcttttttctttcatatattgaaaaattaggaattttcaatatatctacctgcactgtagagtaagcccagtagaacaagacatttaaaaagaagctttaaaagattaagagaaacacaagcatctagatatcattctgatatagatggaaatattttatttcccaagatatattgttaaaccctgctaccaacatcatgagtacaatacaatttctttgtaatctcatattctaaaattataaccaaatattgaagccaatttttttctgtcttagttatttttaataaaataacttggctaatattaggaattagttataatgagattttatctggtttattaaatcaaagaactgacgagaaataataaaacaggccaatttcagtttttttttttattatactttaagttttagggtacatgtgtacattgtgcaggttagttacatatgtatacacgtgccatgctggtgcactgcacccactaactcgtcatctagcattaggtatatctcccaatgctatccctcccccctccccccaccccacaacagtccccagagtgtgatattccctttcctgtgtgcatgtgatctcattgttcaattcccacctatgagtgagaatatgtggtgcttggttttttgttcttgcgatagtttactgagaatgatgttttccaatatcatccatgtccctacaaaggacatgaactcatcattttttatggctgcatagtattccatggtgtatatgtgccacagtttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgagtcaaatggtatttctagttctagacccctgaggaatcgccacactgacttccacaatggttgaactagtttacagtcccaccaacagtgtaaaagtgttcctatttctccacatcctctccagcacctgtagtttcctgactttttaatgattgccattctaaatggtgtgagatggtatctcattgtggttttgatttgcatttctctgatggccagtgatgatgagcattttttcacgtgttttttggctgcataaatgtcttcttttgagaagtgtctgttcatgtcctaagccaaaagaacaaagctggaggcatcacactacctgacttcaaactataatacaaggctacagtaaccaaaacagcatggtaccggtaccaaaacagagatatagatcaatggaacagaacagagccctcagaaataacgccacatatctacaactatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgagatctaattaaactaaagagcttctgcaaagcaaaagaaactaccatcagagtgaacaggcaacctacacaatgggagaaaattttcacaacctactcatctgacaaagggctaatatccagaatctacaatgaactcaaacaaattttttttaaataaaggattatttactaagtaaggataaggtgcagggactgctacaaaggatgatgctgtcagcacctgaggctagtgttcacaggacgctgttttcctcctttaatctaggatttaaacacagagagggtagggtaagtcatgcaattaccagaatctgaagttggggaaaactatcgataaagataaggctacctaatagaagctgtgacctagacattgacttatatattaatgaaggctgtaaaattgttcgcagtgtattctacatggcttttcaatttggaaaatttcactacaaggcagagagttaaaaattatttttgggaaaatgcctaaagaatctgaattcaccttcaggggaaatgagtcaaagaaaactattcaaaatgcatgcattattagatttagaaaatatcaatgctggtttcattttcattagcaccaaattgatgctacctaatcttattttcctcctaaatttatgtgtatgtgttggtagaggagagataaaatttaaaaataccttattgtaaacacagcctcagcactttggttaagtgttttttattaaaattatgaaaacatcaagaaaaataaaggagaaacaagacatattgttttttactaaactaatgctatggtattgtacatttggagtataataggcaatacttctcttggaaggagatttggcaagaatttgggtcaaagacatcctttatccactcctgaaattgatagaaaaattatatatacgcatgtataaattgatatgtaaactttacatataaaggagaagcaaggcacagtatgaggaaaaagtaaagaaataaaatattgatataaaaacattgtcaactagaatatgaggtcattttataatcttggatttgcagatgaataattaaaacttgaaagggtatgtgatttcctcaaggatacaaaattagcactggggctgagcttttagttgcctcttttagctttgctgggtctaatcccacatacaagaaacacataaattacaatagagaagtgaattatcctttttctcttttatttttctggttacttgtttgaacttattttttcttccttgggaattttcaatgctttctacaagcaagataataaaacttattaatctattaacctagtgaaagaactagaactcattgtaataatacttgaagcagtgtaatggattccatttggaaatgccttctatgatcactgaaattatcatcaaaacatatttaatacattttcataggccaggtgcttgatcttcaggaatttgcctccactcaaatttaaagagaacttgacaagattaaatatttgaacagggaatgacaattctttcaatcctctcttttcgttttcctttcaaattagttcatttggaaagttcttaaagtatcaaattgaatatcttcatctactttgtgaaaattaggattcatgctatttttctgtttctagaaggcaaactcaaggtggagtcagctctttgtgattctcctagcgtttgatgttataaataatatcactcattatggcacacctgctagaatgtaaaagccacaaatatcaggagttcagttaggttcttgaattgctttaccctaacacatagcaggtactcaataagtaattgtcagtaaattagttataaaagtcaagttattaattataaattaattataccatatatgtcatgtaggcaggtgtaaaatttattataccttcctacatgacaaacacggtatttcgtcatctaattctcataagaaacctgagtagtatcattatgcccagttattgatgaagaaacagaggtttaggagtgcaaataaattatccaaatccccaaatatggttttagaaatgatttgtgatcaggtggacctcatctacaatttttgtcattaaccactgttcttcaactcacaccctccattttccaaccttctgagaagtcctgccatcattccctctagaaattttcacaatttttgatgtatagaattggaacatgggtccaaagcctaagagtttctgtctaagctaaaaacaaaagctttttttaagctgctaaaattagatgaaatgtgaaaaaggtgaagtatgtgtttagtaaaatgataccttctctcttggcaccatgtatactcccatgtccttgctcctagctattcatcactcccatttcatttctaaacctctgaagagcttatttttcagggttttcatttttttatttccattccagcatatgttttaagctcaatatagctcactaaaccattgtaatgagttaagtgagtcctcatgggttagtacattgccttttcggttgttataattgtgttctaatgagggtattgtgaaggtaatatattaattttctgcattgcttctaatgatgagatttaccagatactgaaatactgaacagaaagcccattatatttaagacattcatgctttcctccaggaaaccatttctttgcagctttttttttttttttttttttttttcaaattttgtctattgtctcgtacttcagcacctcagagcaagagggtgggactggtatcttctcatttgccaagatctctgctcttttaagccccaggtaccccaaaactttgttgttgcttgcatctcctgtcttgccagtagtttctcctcgttcaaatttctggctcgaggccctccactctacatcagttcctcttataatcgttgtgcatttgctgtctacatggaaagtctgttttagggcattgggctctcagttctttgatctcatttctggtggcttttgcctcactttggatacacacaatccaaggtcaaacctaagaattcatcatcagggctgcaactagaatgatgcaagtgaggccgggcacagtggctcacacctgtaatcccagcactttgggaggcggaggcaggtgaatcgtgaggccaggagctcaagaccagcctgagcaacagggtgaaactccgtctctactaaaaatacaaaaaaaaaagaaaaaaaaaaatagccaggcgtggtggcacatgcctgcatcccagctactcaggaggctgaggcaggagaattgcttgaatcctggaggccgaggttgcagtgagaggagatcacgccactgcactccagcctggcaacagagagagactccatctcaaaaaagaaaggaaaaaaaatggacacaagtgaagcactttcttcgggtgcagaatttaaggaatgccaacacaacttaataatagaataaatatattccaatgcaatatttaaaaaatagaaatccaatgtgaaaatcccacaagaaatagtttatcaaaatctaaaagaaaggatcagtaagttgaaattaagtaaaagttaatcaagacatttgtcaagagaaattgtcaaacatagcaattctctcaattaaaaatgagtaagcaaaagagtacattttgaaaatattataatatattcaggtttaggtataaatgagatatttaaacctaaaaactagattgtatgtttcaatactctactttccaggttttcattattttttaaaactatttttgtgttctgagaaaaataaccattaaaaagcacaggaagtcacgtatatagccagacactttccttttgccttaggctccagtatggttccacatggcactacccatgaccacttgtagttgatccattctccttatgaatttccacctatcacacaattacatactcccgagacagtgagataaacgcattcacacaaacacacacacacacagacacacacacacacacacccctaattgtattggcaaagagagtctattcctcatgaaaatttggaccaatgtagccctcctctagaggtctgatttatagcttttaactttagatcttatctaaaaaccctgagttgttagaacccaatgtaatctctgacttcaacgtatactgaggtcacaccacctacgagaaatcttgcggcaagatttttgtgtatcttaaagtcttgagtgagaaactaaaagaatcttgatgtataggacagactgtttcatagaataactcattccctttttcaagcttccttatttcactgttgccagcatgttgttcattctcagggagtagaaataatttccagtcagatataacatccaagacttttaagttggtttgaaaaatcccccaaagccaaccttggagtagaacagttactgtatttcctctcttatgaactccattaagaatttactttggcacaattatcttatcccaacaccaacttccttaatacctgcttactgaaatggaacactttaaaataaattaacgtagtaatgacttttgtgtactaatgattttaacattttggaaaaagaaatcacttattttacaaacatctaagacatgttgattctagggaacttctctgctgcaaaactttcccatgaaaattgataaaggaacatttctatgaccattaagcaataagcatgatcaaataaaaaatgagattaaaacccaccgataattgaatggcctattgtgcaagaatattgctttacatattttcttcacagtatagtttttagtaaattctctgttttcatatatatactttaattttataaaaagttcaatagtaataacaaactatccaagtatatattgactctgtattagcatatgtagttttttaatttcttgggttttgctttttttcttttattttttaaatatcaggatattgtgctaaaattctatggtctctgaaaacattatgattgttccaaaataaataatttaaaattatattagagcaatttttatagattattccttgaaactaggttttgaatctgtttcccacatttcaaaaataaatcatatattacagactacaaaatggcaatcaaaaattttttacaaaatggtttgtgaggtttactaagatcttaatttttattgatgattgagtttacaatttagaatgatgatgatgagtttaaaaatattctcatatttgctattctatatatttaaaatagaaaaaggtaccattagataatatacatgtagcataaacttgatatactgtattatttcatttatatgaagttctgtaacaggtaaacaatagtgaaataaatcaggctacctgtattcctttatggaaagggtggggtagatagtggttggggaagagaagtatatgtgctctttgtcctctcagtatagcaggtttcactggtgtagccattcatcaaaactgttgaacagtaatatttaagatcagtgcaattcactgaatgtaaattataccacaataaaatagaaacaaagcatactatttgttgaagactatattttacagttttttaaaagtctacaaagtccattttttgaataaacaaatgaagatgtaatatatcaggtagtgatatgtattatgtacaaaaagggaggggataagatgtgagggaatgcgtggtgggctattttagacagtggtgaagtagatttcttggagaaagtgatgcagtgcatgagtagagacaggaactaaaggaggccttgtgccatgtaggcatctggaagatgagccatttcaagcagaaggaaattcacaggccttactaacatggggaagtacttatcatgtttaattacagcaaaatgactgaagccaagtgtatgacagggaaaaaaaagagctacgttttgaaaatatgtttttaaatagagcacaataagccaaggtgtgcaaaattgatctccttactaaatataatttagtttctcaagtgggcccaaggttttatttttttataagtatacttatgtgttagataagtatacgtagcagaaataatttttacaagattgaattactcaaagtagtttcagcagatgctggaagccttagaggatgaaagcttctttttctgttgaaggaaatagcacagcaggaaggccttctatgatgtaactctgtgacttcttcaccttctgctggatgccacttgacatctcaataaagttacttggatatcttgacctattttgattttattatcactccctctcaaaatatatttataggtaaattataaaaatctctttaggctaattagaaaattctgtagatagtaagacagcagttttaacataatgcttgaacatagagcatagagatcttgaactattcaattcgattcaaaaggttatgctatttcattttttagctttgcatttgaaaagcttaattatgatttgattttataacacaataaaaatacaactatttcataatggtttggaagagctaaaagcattgataaaaaatgtgaaatgatataatttaactatatttctttttcaaaaatatgatttctattaaaaacaattatacttaggtgaccttgagtatggcaatgactttttggatacaacatcaaaagtaggattcatttaaagattgataatctgaccttcattgaaattaaaaacttcttccctgagaaagacagtgtcaaatgaatgagaagacaagctacaaactgggagaaaatactcacaaaagacacatctgattaaggactgctatgcaaaatatacaaagatctgttaaaagttaacaataagaaaacaaaccactcattttaaaaatgggccaaaaaccgtaacagtcacctaaccaaagaagatatacagagagcaaataagcacatgaaaagatgtcccacatcagatgttatcaaggggatataaatttaaataataatgagataacactacacacctattagaatgaccaaaattctaaaccctgatgacaccaaatgctgttgaacatgtggagcaagaagaagtcccatccattgctggggactgcaaaatgacacagtgcctttggaagacaatctgaaagtttcttacaaaactaaagatgcttttactataaaatccagcggtcattctccttggtatttacccaaagaagctgaaaacatccatctgcacatagatgtttacagcatctttattcacaattttcaaaacttgggagggaacaaccaagagggtctacagtaagtgaatggataaataaactgtggtaccttcagacaatggactattattcagtgctaaaagtaagtgtactatcaagccttgaaaagacatgaacaaactgtaaattcaaaataccaaatggaaaaaggcaatatgacaaggctgtatacgctatgatttcacctatttgacattctgtgaaaggcagaactatagagaaagtgaaaacaccagtgattgtcagggggttgtggtcagggaaaaatgaatcggcagagaacagaggattttttggtcagtgaaaataagtctgtatgatactataatgatagaaacatctcattatacatttagtcaaagccacagagtgtaaaacacaaagaataaaccctaatataaactagtatttgagtgataatgatgtgtaaatgaagtttcatcaactgtaacaagtgtaccacgttggtgggggatgctgataatacaagttatgcatgggtggggacaggagtatatggaaaatatctataccttcctcccattttttttgtaaacctaaagcttctctgtgaagaaaattcttcaaatatgacaaaaaattataccacaaattgaatagtccatattcaaatcttcacaatccattttatgtatgtatgtatgtatttatttattgagatgaaatttcactcttgttgcccaggctggagtgaaatggcacgatctcagctcgctgcaaactccgcttcccagtttcaaacgattctactgcctcagcctcccaagtagctgggattacaggcatgcatcaccacacctggctaattttgtacttttagtagagatggggtttctccaggttggtcaggctggtctcaaactcccaacctcaagtgatccacctgccttggcctcccaaagtgctgggattacaggcatgagccaccgcgcctggccttccattttatttaagaagaagaaatctcatagttatttctactgcctgaacatattgagatataatctgcataaaagaaaacacgagaaattaagtttttaatttcatgagttttcacaattgcaaacagctaggtaaataccaccccaaacaaggaataaaatattttcataattccagaaagtaacagcatgctctttccagacaattttctctcccattgttgacatcatcatcatcctcattgtcttcatcattcagaaataccctaggcagccctgttgatatctagtttctacttaaaaagtttcaacctataaatacagtgcaatagttagaaacagactggctataattgctgtctaaagagactggctggctgttaaggtcaggcctcagtgggtagaaatacttgtctggggaaatcaaggaccagaggttgattcacagatcaagaaatttatatttgtctccatagctggatgtgattggagtcaggagaagggatcacagtaaccaaacccatgcaagacaactatgtgacaacatgcaaatttgttgatttataataaaagaaatataattgacaaaggaaaggtgttggaatgtttgaatattaggtggtacattttctccttgtaggaacatggaagttggaagccaaatttcaattctaaagatgtgattagaatccaagtgaatgaagtgagtttattgcttataatggtttgggttcatctcattttgctagatcaatgcatccacttgtgttacaggaatagacatctgcagttttctgtttaaaatttcctttctcttgacattgctgaagagaaagtgacatattgtctctcttaaatgttcatttttttccaagaatgaggtatttttatatttttgaaaatgtaatatgtattgatacatgataaaataatatagaaataaacaataatttgtagagtaattttttgagggtactcagttttatactatggacttcccataattttttcaacttaatctttataacaatacaaagagatagaattatattcccattttattgataacaaagacatatttattaatctcactctaagatgtagggaatatttctctgagttatattgatacctgctttctcactaaaaaacaataaaaataaaaagcccttttctaatttgccacctaattcacaccaggagtcacatcatttatatgcaaccatgtaaattcaagcagtaaattggattatagatttttctaaaattaatcattgtaagaaaaaatgtgccgtcattttagactgaacattttatttgagatagcctttatctactacactaaaggtaaacatggaaacagctttccaaatactttctgctactcataacatggtacaattttaataaaattccgttaatgtaaggattatgctgactttaattcctatttagccatacttctcaatcctctcactaaaatattgcaaactccacctttgccttaaattagacatcctagttctttcatatccagatatgtaattcattctgatatgtcgttagggatcttgtctgatgtataatcatttgaagtggatagacaaaataatttatcaagctttaaaattttgatgataattttggtggattcagtatgatgtgggggggaaaaacaaggaatctacaaaaaaagtgcagtgagttagtgtttaattgggggtaattctttataattaattaatttagaactaggcaacagccttgcctctcctccatgttcctctgtgttcttgagaacaagtcagctaggctcactaaggttttttgtttgttttgctttgcttttatgcactattatttttctccccctgtgaggcaaccagtcgaagtcgaatgtttgtttttttcttcaacactgaccagaggaataagatttgtttttacttaatttcttagggtaaggttgtatttttaaaagtatttggttatggtggggctctgttgcttttcttattaccacaatatacacaactagaacaggaaatggatcctatagctgccacattatcaaacctcaagctggagccacaatttaacagctaccttctcttggtagggcaaggtgatgtcctttaaaagatattgttaattgagctacattccactgatgtaatgacatcttgacacaattatttatagagaacctttgtctgaagctttgtctttactcttcagttaatatgttactcttttgctgccagagccaataacttagactcttccagaaagcctaatatcttatggtctatgtatttttggctgaaaaagttaacacggtactttgagttaattataatttgggcctgttgtcagtgatacccggcaagtccagatacttaggcaattactcatgtaaacccatagctttgttcaaatgcaagaacaaacccaccagaggaaaagcgctaaaaaagcggaagttccccaggcccttggattgctaatctggctttatggtaacagtagactcagtcttagcttgtggcattattagtaactgggcttatttcaaaacctgggcaataatatagacgtatttatttttcaaatgtatagatcataagaggaagatcaaaatgataagcaaaatgtaaattgttttaaaaatccaccttgatagcactttttttatttcctttatcatttataagttttgataagtaccttcaagctcaaaagttagtttgaagcctgctaagaattcactatcttttatctcctatacatgagtaaataaacatttaatagtgttccgtattgctcctaaaaggttaagtccaacaaacattagagttcatgttaccactttactgaaattcatagagacagttcatgtagacaagttcaaatagagaggtgggtataatattgacctaactaaactgacaaaaggggcccttacttgtatgtttttggacctgaaatgatttggtttcaatcattccgtgctatatataaagagttataatatatagctctctatacatgaaactctacctctctgtctttctgtctgtatatcaagagagagagactgagagtgagatttcatatatgtacatatatatgaagcatgtgctatgtatacttgtatatgttacatgtatgtatatctaggtattatatataagtatgttgtgaaactaatgtcttcatgcccattttgaaaaacacactttcctagttaatttcatatgtaagagatgaggtgtgctactgtgtatcacatgactttgtatgccatgagagacctttcataaaaggaataattaacttatctttggcttcattatgcacaatgtattgttttctcttctaatttcttgatatcaatattgagttactgaattccattcttactcatttcagtgatttcttaccaacctttcaagatccaatagaattatacaatccttacatactacaataaggtattaccattgataggccaggcacagtggctcatgcctgtaatcccagcactttgggagtccaaggcaggtgaatcacttgaggtcaagagtttgagaccagcctggcaaacatggtgaaacctcatttctactaaaaacacaaaaattagctgggtgtggtggtaggcgcctgtattcacagctacttgggaggttgaggcaggagaatcccttgaacttgggaggcagaggttgcagtgaaccaagatcacaccactgcattccagcctgggcaatagagggagatacaatctcaggaaaaaaaaaaaaaaaaaaaaaaaaagctgggtgcggtggctcatgcctgtaatcccagcactttgggaggccaaggtgggcagataatgaggtcaggagatcgaaaccatcctggctgacatggtgaaaccctgtcgctactaaaaatagaaataataataataataataattaccattgatagttttcattttgtaaatcagaattaaggtttttttcattttaatgaattgttgactaaagactgacaaatacttggaaacaaatatcaaaccagttatatattttgatttaatttattgcatgaaataaacagtgatgtttttcaatttaaattaggagtgctttattagagattatgaaacctaggaagtgagataatatcctattttgaagagacctttctccttccaccaattcctttcatctaagttatcaccactgctgattggtacatatatctgggaaaaccaacaaaagaaaacaattctattgattcccatgaatttgattaaatctgacaagttgctttctttccttaagccagaagtccctgattaactaagatagtctttcccaccaaatgtttgaaaatgttttagttttattgatagatattacatatcttgccttgtcttgcttcagggtttactcacttttgaactttgttcattattggattgtatttctacaattaacattttatatgtaaatattttcaattggaagccctcatgtggaaaatccctttcatgaccttttttattttctcttaaatgatgaccttaaaatcacatcaaatattatgaaaataaacttcctggggatgtgtcgtaacaggcatgttgaaattttacttaagatgtttaagcgtcttttaatttttccatagaacttgacttgccaacttatttttaaaagttattttctcatattttcttactcttgactatttctttaagttcatttactgtgttcacattaacagagtttctaatccagtgaaaaagaaaacaatttttacacagatgcttattcaaaatcattttacagaaggtaatagatttagagattttataataaagttactaactggcaaggacacaaacacaacccatccaatggttttaatgttagctcatgtgaatcaattttgaaaaacttaacatccctttcttgtttcggaaataaaaaagaatggggtgattttcattatatcctaacatttaaaacttttaattaaatttgtaaggcatattctttctacccataaattagagcaagttttattttataacataaaaaagaaaaatctataacgcaagcagttattttcatttaaacttatgaaaatacagctgacacctttatacatgattattgaaaaattaaatatgtacattcttttgaaagggcaaattttaagcttttaacaaaagtgtgtatctatattttttatatacaaattccaaatctaggcaactgcctttatatggtcacaaagtgttgtacataaaaaaaactccttgtagcattcttttaatgagtgacaaaaaacaatctaaatatacgtcaagaggaaaataatttgatatattgcaacattatgcaatgattttaaatagtttcatgtctatatgcttacaaagtatcatccaaagcactcaggaacactcacttttagaaatctctatctaggccgatacataaccaacattaatcatacttaagaatttcgagagaacattattatggtaatttaagtgtttcccgatgtagattaaccctaaggtcatcatgtgcacaaaatcttctataggcggacattaggaccattcatgtaaaaactaaagcagaagcctagagaaggtcatttctacaacaggttcacatgatgaatcagcctaaattctcaaagctcaaggcaaccaatgtccagctcaaatacaatgttaaactcctttaaagacaacaaattgagttacataaattgatctcttttcccaatagacattatgacacattatgacataaataaggggacacactgtattattgtgtagagtaacaaaactgctcatggaattaatttaacaccatggggaaagggagcaaaccaccttttcttttcttttttttttttttttttttttttactataagacaaaccaagatgtcaaataaacttattagagcaaagacagaattctcatttaagccagtcatctctacagtgagaagctaattctgtctaaagcatgcttgttttgttttcaagaagaggtcatcattaaggtatgcacatgtaaagtggtatttctcatttgtggtcttggagggaatttattgtgggaacaaaccaacatttttttagtcattgcaagctgtagatagaaaaaaaattcaatcatatactgtattcctgtaagaggattcagaatatatggtctcagtagttgtttatcttcagagcaataatcagaccacatacacaaatgcatactcaatgccttgcacttacattttcagacctatggcttgttcttgctgaagatgcaacattgaattattgtggaataccttgtaaataggtggtttcatttatacagaggatgttgatccacctggattaatatagccaagctatattaatatcaataacaagattagtagttcctgttaaaagagtatctactaggagccttaaatacattatttttcagactcacaggagcattacaaagtaataaggattattattgagcacttaggatgtgctaggtgttgtagtaagctctatccttattatatattttaattctcatatgttacatattttaattattgtaattctcacatagcatacatatgataaaagaaaagagaagagaaaagtgagataagggaaaactgggatgcagaggccttcgtgtgtcttccccgagatttcacaatttcttagagtcaaattcatgaggaacctgcgcaattcttgtgccaaacctattgctattctttggctatcagaaactgaccttatctctgtatcttatttgaattgagtacttagatggtaaagaataaaaggaaacatgtaaactaaataagcagatagaaacaaacatgtatacaaaatagtatatcaactaatttttaaaaatagaagtggggtctttggagaggtataaaagagacaaatattctagtttgggtgaataaaataaaatatatacagtcatatttctcacattttcccacaacagtaaatgatggagaaataccaaaatagtagtattaatagtaatagaagaaagaacaataactacaatttaactgtttagtccaagaatgataatgtagtaataaaatttaaatgttatagaagttactacaataggtaagagtaaacatcaccttgacaatgatatagcaatgtttcagaagagggaagtcaaaactgaggtacttaacgtgtgtggggattgtggtaaagtgatttaaactgagtcatttaaggtatggaattaactgagattatacagagtttatgatatagtaatttaagactggtgggcagagcgagatgcatgtggaaacaagcagcctcaataagtaaactgttgtttgataaattatttattcagatgagcagagtgttgtctctaataaattgatctgtggaaatttcctgaagaaaataataaaattagttggcttatgattttatcctttcatagaaaatatttttgaagcaaacaataaaaagttttgttaacataggtggtttcttatttctcagaactctcttgtagtcatttttcaacctaagctggaggataaataataatcatctgcacaaataatcaatcaaaatcaataccactgtcttcagggtcctgattgcatatcagatttctggtgggatcatttcaactatcatatacattaggtttttatgtttgtttgtttgtttgtttttgttttggctgcatgatcatttattgtcatatcagagtggctacatagaaatatttttgattatgaaaacctgatatttgaatgctgaatcacagacagatactaacagaagtattttacattctaagccaagagccaaaaatgcctaaattaaagcaatacaatggaacccatgaccaaaccaaaaagttttaatggtcagatgtgggaatactagatttatcaccttgtcttgtaatttttaaaaaatttcccatattttcttaataaaataaaaacagaaagaactataggaatatgagtaaactttcctcctgtaaaatgcctcatgtttcatcctgacaggccaatattatttctcgtactgctatgttttgaagaagtaccacctcctcagtattatgaaatctccaggtgatgatttctatggcctcactgaaattgttcagtgttcctgataatatctgaagcacagatagtatgatttaaagacaggagaaaactattcagaattagacatgagtaatgttgtatatctcaaaatgaggccctgtttttctctttcttgaatgaaattatctagagttctctttttctagggtttgagggggaaatgtgcccaaatcatccatgagtaatattaggcaccattctgaaagtatagtgtctaaatttacaaagataacaattttttggtataatttgttggccacacccaatagacttttgttttgcaaacctaacactggtctttagaatctacccaaagacttatcattgtccaaaataccttccttgtgtgattaaaatttactgtacagttttggtgacattcagaggtaattaggtgaagagtagagaatataatgcagaaacatcagaagattacccactgtaattacccactagtctggctgttgcccttagacaaggtgagtagccttttgccactgagtctatgaaaaatttatggataactttaaagatgaatagtctttaaagattctgataaagtaaagtcaaaacaccaatggcttgtccaaattgatcatgcacaaattggtaaaaagatctaagataattaggaaggccaaataattaattttaaatcacacagcctcctactcctcccacccccaaccccaaccctgccactcccagggcacacagagacacacccctacagctaattatgcttataatacaacaaagagattgagttactaacaactaagttaaaatttagaggtacagtaatttcagtaatattgggaacccattgcatgtaataacctatgaaatctctatggagtggccattctttattcctttactttcctaattaacctgctctcactgaaaaaaaaaaaaaattcaccccctacagccgaaaaaaaaaaagtctcttaaaataagtatattttcttaacagttttagaaaaaaaaaaagtgttttgtaatctctccagagtgatggattataaatcatgttctaaatagtgcattttcttcttacaaaattctaatttttctttgaacacattatatactttctgagctataagtagtagttggaatcaacctgaaaaattatctcatcttgacaacatagcaaaaattgtctgcatgttggataagagtagaattatagagagattcaaggtccttcagtgtctagcagaagacttgtataaggtacctgggtgcctcagtacacttctgcagtaaaactgtccaggtacatcattgatttttctagagaaagactaatgagtattttctattatgatctaaaagggacaatacaaacagcagaacatggatttagaatgctaaaatacataatctcaggtagcatggaaattaaaataatatagaattttggcaccacaggaaaacagggctaaatattttatttatagttgcaaggtctgaaataaatgggtaccccagcccactgggatctcttgatcagaagaataggagtgttccaaggactagtgcatagtattcgtaattatttttctgttagacacaactgctggcttttgtcctttccctttggttgtagagggcaagtgtagatggaggcttaaatgggtcagtgagaaatgtgaggtgttcttccccaataattcagccaatatcagtagatcttcaatttgagtttgatgtcgataccaggctccttgtactccatagtccaaattaggtgtgatatgattatgaatgggtgattcttttttttcctttttcttttttcttttcttttcttttttttttttttttttgagacagagtctcgctctgtcacccaggctggagtgcagtggcatgatctcagttcaatgcaacctctgcctcctgggttcaagctattctcctgcctcagcctcctgagtagctgggattacaggtgcctgccaccacacccggccaattttttttttttgtatttttagtagagagggggtttcaccgtgttggtcaggctggtctcaaactcctgagctcgtgatctgcccgcctcggcctcccacagtgttgggattacaggcgtgagccaccgtgccctgctgaataggtgattctttagagatctcaagagaaagcccatcaagagagcacttaaattagcaattctgtttacataggaaatccctacctattaaatgaggggaagtgctgtctcaaatgagcaaacgatgttaaagatctgagggcaaaagctatagagtgatacacaataatctgtagatttttgcaaatactcatctcctaaatactttattgactctaggggagtgactgaatgcatgtgtggcagggtctgtaaactatattactgtgcctgaatcaatcagaaaccttgatactgtctgttaatgtttagagaaatgggacatcagggaattaatgaccccacagatcagcatcaacttcccttatcacatccttcctttttaaaaattttcttttagtttcacagttagtgcagaatagctattttccaatgtcctttatgaatctttttccaatgtcctttctgcttacagttatctatcaatgtttgtattcaggaagcttcctcctctgatacttgataaattgaggagaaatagccagttgtttcatctgtaaggctgttaacttattcagaggcttattctgtttttattccatgactttttcaaaatgttcagttaggaattggagttctgtttgtcaatgaagtcattttccgatgtactttttccattttacattccctaattttggtttagggctctttgcaaaaatgatgagagggtttaggtcctgtctgtctcaagatctactcctgaatattttctaaaggtgttggaggtcctgttcctaaagtttcaaattgattcattctttctctttttataatgagatggaagtccaacctattttcaggaaagtcttggggtagcctccaaaatattttctccactgtgtatagctttcctaaatacttctggttttctctaatattcagggtctttcattcaccttagattatcctaagtcttcattttttaatccaatttttttacattaattttcttactaacataagaatcacttacgtagatctgggaaacctacgatatatgttgttagaatgattctaaattcctctgtactttgtccagacttttacattgattcttagttcagactgagaatgaaggctaaaaataaactataagaagcttgttgatgtctaaagaggacttaactttaagaggcaattgagatttgtgaaactcaggttgtgtaatccaggaggtaaggggccaggtgagaaaatggagtaaggcaaaagggtattgagtaaacaaagacaggggaaaataaaaagtagggaaaaggccattaagttcacattgtaataggaattttacctcctttccattttaagactcctctcaaattaacaacttctgttaatataaaaatttcaccaagtagcctcttaactgtaaattatttgtaaagaaattatgcctttttgaaagacagtcatggaaattagatttataatgtagatacatatatgaggcaagggttcagcctacagaaggcatacacttagtgtgattcaaagccatgagaatctagcaacaagcagtagaaagtgttgcttttgcatagtgttttcaggcctccaagttaatgattttttttttaatcccagcctcgataatctgaggttcttggataacataaacttttttaatgggagattttatacagaacctgactctcaaagactgaacaggataagaataagaaacatttgcctaaggttttgaagagttgactccagggaaaatttatgtgagggataccagtccgaggaggaaccttctgaagttattaattccagagctggctctaggaatcaacttatcaggatccatgtctggccatttttgtataaacctcctcttagagactcacaaaaatgaggacagaaggacacaattgagtaatttagcaataaagcagatttaaatcaaacattaacattttccaatctaaacagatcacagaaaaagtcctaaaatagattctatttcccattagacaaaataaaactaacatttgggaacttgacagtgaccaaagttgagacacaatatcaatacctagaccccaccatcacagttgcagagtctctcaaggcttccccagtagagcattcattttgcaagtcaaggatcttaagacacatcagagaggggatctcagctagaacacagtggtgcttacagttcattgctctcctcaatatatcaccagataatctgtaagtaaagtacacctgaatttattggaatacattgtaatcaaaaagcacaccaccctgacagaatcttagaagtgtttaaaagaggtcagaatgggatatttatggagctttggagtctggtctcaagttgtgtaatgcagatctttcaagagaaggaactgattaggaatggaaaaaatccatgacataataatttagaattggtaggtatagtgaagaaataaacttgtttcataagtgaactgtttgcacaaataagcagactattgtcttcagtaaattgatctgtaggcatttcatggaaaaataaaaaacagtgaagttctttattttttacaatacattgatgaacagaaatttcctagaatcaacaagtcattgccatgaactcttaccagagtaatgttgacacaaattattagtggacttcaacccacaaccccatatagtagatactaatagttaatactacttttacacttaccatccactagatactcttttgtatgtttcacaactgcattatttaatgcttccaccaattctataaggtagacttgcatattatacattttttaccaataaggaagctgagacataaagtgtaagtaattttcccaaaacaaaggaggagggagccatgagctaggtttcaaactcaaggaagctggtattagcggctgtattcttaatcactgcattgtaatgcctgtaacacattcattaataatgccatttaagttttggagacagaactgacattgacatgaaaaagttttaaataaaggcttaattctcatactatcatttacaaagagtatcacagtaggatataggcttcaaggttatgagctgccttttcttcaactgtgaactatgaataaaattttctactttttatgattttgaaaggtttcataatggagctagtgcataaaaatagatgaggggtggtcctatagaatcagaggagagtacattcatgaagggaggagtttaaacaaatatgtaatgttgaatataaggcaaaatcttcagaacatactgaaatatgtctaatttaagtaaaataaacatagcagggaacatggagagataattataggtgtgaaattattacagttatatgagtctggaaatgatttagtggaagctctaattaatgtggttgaaaggtagaattcaaatatttccagcatttcttgttcattcaaattatattagcatgcttttatttattttctttttcataatgtgttgtataagatgtaatatgtgtttataaatatgaaaacacatgagtttctcatttccatttgtgggctataggtgagctcagattctttttgatgttcaaaataaatttatactatattattttaggaatacatactattttttgaggtagctgtaaatgaaaaaattgtaaaaagagattcctaaatttagagatgaaagttcttttaaaaaatctgattgaaacaaaaacagtatggaaaatatgatacatttaatttctagatttgttttaaagtcattcagtatatacatatttttcaagagaaaagggtatgtattattcagaatgttgggacattgtacaccaaagtaaaaatcaaattttgcttgttatattttctaatatctgtgtagctatttttataatattttgcccaaaaattattcttttaggtcatcttccatttgggtaagtttattttattttaatgagcttcattctgttatgattcagaaagtttaatcttacaatgcccaaagcatccatatattaaaactagctgacatgatacatttaatttctagattaacatccctttaatttagtttagttcatcttgtttttgtatagaggcgatataaatgtcttgattcaatatgaatgcaaatttgtccccactcccactgtctgtttatatttgtgagtatatattactttttcctttacactgtgataatttttatgtttaccatgtttgtgatattaattttttttttttttttttttttttgagacagagtctcagcctgtagcccaggctgtagtgcagtgttgtgatctcagctcactgcaacctctgcctcccaggtacaggagattctcctgcctcgtccactctagtcctgagattacagatgtgtgccactatgcctggctaatgtttgtatttttagtagaggtggggttttgccatgtttgccaggttggtcatgaactcctggcctcaagtgatcctcccacctcagcctcatcaagttttgggattacaggtgtgagccactacaccctgcctaaaagacatttttaaagacaatgtaaactcaacctaagcagagagaaatttaattgtatcatccaacaaatattgaatgcttgatgtggattcacctagcattaaaagattataatagcaatactttatagaaaatcatatacttgaataaaaggctgatatttcctgaagaaaactctgggataatttagttatctaacatttataggtacttgcatagaaaattgatgtagaaagcaatttgtctttgcattgcatcattaaataattttcatggaaggccagctttaaatttcaagtttagtctcagttaaccagaaaaaaatacaacaaacattgtatatgtgtgtgcacgcacatgtgacacacacacacacacacacagacacatacactaaggcacaggggcaaaaataagagaactcactggctcaagaaaataatggcaaaaaataatttttaaaatataaattatgtttagtttaattgcatgcagctcacctaacaggaaaggggattatattttgatatttgcaaatactatttttctagcgagagagaggttgcatagtggaagttgtaagaataacagttggtttcctatttcaggattttagctgactggaatttcagaaaactactccctaaaaacacggataacaaaaacaaaacaaaacaaaacaaactctttttaaaatgtggtgataacatggaaaaagaaatagaatcattcaacaatcagataagataagaaagcatgagtctattgatgtaagaaagctttaaaatccacatttgttttggagcgtctgtaaattgcttgtggtctggatcctatattttaagattttaagagttttaaagagtctataggagttaggagataaaatctggtgcctgaccagatcataaagcattaaggcaaaaatacactagctataaagaaggccactatacagtaattataaaggttcaatttactaagaagatgtagcaattctaaatatgcatgtacctagctacatagtttaaaatataaattaaaaaatcgcagacgtacaaaaataatttaacaaacatcactgtagaagatttaaacacattattgtcaacaattgatagattagcagacacaatatcctatctcaataagatactgaatatatcaaaatatacttaaactttccagtggacatatataaaaacctataccaaaggtataggtttgatactactactactgttaagttgtagaacatacattatttttaataacaaatgaaactttaaaaatgggccatatactaggcattaaagaaggtttcgataaattttacaaaagaatctattagtatacccacattctctgacatctacataaattagtaattcagtaataaaaatatgtaaaataaatacatttgtatttattaaaactatcttttaaataacctatgggtaaaaaagaaatcataattagaagacaattgtagctaaattaccactaatataaattttcaacatttttgaaatgtgattctaaaagcattgagggggcaatttatagccttaacttctcatggttgaaaagaagaaaggctgaaaatcaacaaaataagcatctatctgaaatattgtgtgtgtgtgtgtgtaaagaaaagagaataaggacaaagaagataaaaataaataataaaaaacataaagtatcaaaataatgcagacttaacaaagccaaggattatttaatttataattaaaatgaacaggaaaaatagaaattaaagaaagaagccaaataaataatattaaaactggtattgccgaaattatagctgcagaagagactgagatttttagataaagatgatatgaaatatatatgttaataaattgaaaaaagtacaaaatagacacatttctagaaaaacattaactatacatagcgacatctgacatgatagaaaacctaaattctagcactagcaattatgttttccctacacaataaaccccaggctcaaaaagttttatggaagaaatccaagaaacatctaggcaacaaaattacaatgttcttcagccttcaaagacacaggaaaatgttgtcaccaaaaaccatagaaagtcaggagggataaaaattttcctaagaaattattaacaaattgaaccaagcaatgttgtatatatatgtgaaacaaacatatgtatatatatttatataagtattatatatttatatataatatatactatatattaaatatataatataaatatatacaataatatatattatataataatttatataaggcacatatacatatatatataaaggtacagaaatggatccataatataccatggaaaatagaagtataaataggtgatatttagaggtgaaaatggatataattaactttccttagtttttcaaataatttatttctcatgtggaaaattaaaatggttcttcaacacttaataaataattacaatagataatttcacatatatggatgacatatatgaaagacaaaaatctaaaactgttaaaggaaacttaagaaaaatatttttatgtctctatgatcagtaaagtttccttaaataagccacattaaaaaacatgtgagtattttatatatgtataaaatatataagtatatacatataaaatataaatataaaatgtaaatatataaatatatatataaaacatatatatatatgggttttttttggtttttttggttttttttttttgagacagagtctcgctctgtcgcccaggctggagtgcagtggcgcatgttttcattaaacacatgagaagttgccaagtagtcagaaaaaaatgtaaatttaaaaacataaaatatcaagtctcaacaatcaaaatgacaaaagtttaatatcatatcaaatcttatagaagatggggagaaagaggaattctgaaattgctggtaactgagaaaatggcatagccaatttggaaaataatttgattttaactaagtaaatataaatatatactatacccatgacacagcacttttgttcgttcctaagggtatgtcctaaaatattcctcaaattgtgcaccaagagagatatgccagaatatgcatctggtctttgttcataatacaaataaaaattattgcaacagtaatctctccaataaagaacaggtaaatagtgtgatccagttatataatggaatactttacagcattatttccctaaaggtatatacatcagtatggattaacctaaaaacataataatgcagagaaatagccaagttgcagaatttgtgctgtgtaaatctattttatacagccctaaaacttgcaaaagtctatcaaagtgcacacagaagatttataagatagtggcaggattttatttctgattgtaggtggtggtgacataaatattcattttattgtagtattattgatttttaagctctacaaatatatcagatactctattgtgtgtctgatatatttgacattttagaaaaggtaaaacaaaataatagtaaacaaagagaatagtgacagaagatggatagcaagccagcttgctatgtatataaagcattttgtttgagaagcaatagggttaaatgtcatattaaacttcatctattttattgtatctttgaaaactcttattaacttcctttgttcatggtggaacatatctcaccgtgcaatgaatggaagaaaaattgagcagaaaaatgggagagtgcttgaagttttataatatagcaaatgccaacaaatattgactggaagatagctcttccctggtttgtatttgcctttgatctgaatatgaagctcctgcctacagctttcccacaatgtcattacagacttcatggagcagaagactctagctcagttgcccaaatgaatatgatgaagtcattgacacattgagattctctctgtcatatcaccatcagtgccatatgtcaaatttcaaaatatgaattgaggagaatcatgcggtgttgaaggaggtgttaaggaataactgttgctcttcatgtatcagatgaaatgacaacttctagaagttttcagtgtgtgacactgataacaaggcatatccaatggcttaagaaattttaaatctaaatgtgttttaacaaaacagatttcacattacagtgtttcttacgttatattgtgataaggttattattctatttagaatctttgtgatatttactataagtattctaaacaaatgaagttccttatttttgcttccaaattgtgtttgtcatgttttcttataataaatgcaatgcatttatttcttataaaaatgcaaaggacactattttcttataataaattcctaaaagcaatttaggaattcaataagaaatcactaataacaataataatgtttcatttatttagtctttaatattaaaaagactttatatattcacactcaaaactaagaatgtacagacagttctaaaacctgctttataattttttgactttccatgagaattactcatcccatcaaaatttatttaacaacatgaatatatattttaatggcttattcattcatccaatttcatagaatccaggtagcctctttcatctgtaatgaatttactaatgtggtctagtgacttagaagcatcagaaaactaagcttggatgccacagcggcaagatcatgagagccaaatagatacctaaccacgaatctgaactttctagtggaaacctcataggtacaatccccatcatggcaactatcataacctggtgttgcactaatttctctaccacagctgcccccaaagaaccatacacttcctgcccagtgattaactgacttccctttggctcacttgttcctttatgttcttgtgtcatgagagtgtcttctgcttcgcagattccaaggtagaccctatccgcaaatgagtctggcaagtgcagttttaagtttatctgcctcaatagtgcacaaaaagaaaaatacaagaagaggtgttagagtgggtggtccaatatacagtatctgtcacaattacagagtgtgtttaaatcataatgatttaataaacatatataatgttttactattataagtacttttagcagcaatatatacttctttaattatctctatattgctatagatcccaaagtaaaatttttcattcaaaggacagtttttaaaagttcttggtatattggctttccattttgtcttctttctcttccttccttccttccctccttccttgctttctctcctttctttctttatatagaaacaacttatagctacaccaaaattataaaataattttaattccttacttgaaccaatagtggctattatttttaataaaattttgacaatttgacagaagaaaaatattactttattttaattaacatttgttttggttataagttccatggatacaaatctttctaaaatacattgcatacttttctattatttaaagagtttgcataaaataaaaattgtgatgatgagttaccatcattaacataactgttaattagtacaatctgcaacaaagtagtattgaagctattttagtagagaaagacattatttgctccagacagctatgctttgtgaattcttatatctactgtaaaaatttctctgtccttgctctaaaattggaaacatgccttcctttagccaggtgtctttttttcccacacattctccacttttattagcattttctaatccattctggggctttcccttagtgtcaagttcatgaactttagagtacagacatttgtgattagagggactaaattgatctcatttcctaggtcttgtctctgattatgataattgaaaaattttgaaaatcccaacctcctgatgatagacatattaccaaaatttatggcataaagtctaacaacagaataacaattctagcactgtactcaagtaaattaatttgaggagagatataataaaatgctgttaatgtaacagaaatttttaacagattaatttccactcttagtagttttaccctctttttgaacatagtagagaaaaccattgcgtgtatgccgttagaactaacaatactgaaggtggaaggctggttttatagtaagaaatcatatagcttggaaagcaatgaaggaagttgttatcaactataaagtgctcttagagcttactgttggcaaaatgtatgatatatgcaaacacaattaaattaaatatggagtaccacccttgggaaggcctcataaatagcagcagatattcaaaattgcaggcgtctgtatagaaattgtctaaaattgagcctatgagaactaagctcagcaggacataaaactttccacatcatatgttatacatgtggataacaaactatcaaaaacttcatttctaaatgtcaagggtggtaaaatacttgtcttagcactttattatattcagttttagagaattcttaagaaaacttccaagctccaaaaaatgcagttaatcaataatgtgtttttatccttatggccaatataaaaactgttatcctagctcattttccttgaagtaattcatttgtacatatgcatacttcagcatgtggccaaagtcccttttgctaaacttgccaacaaaagttttctttcaccccaagaaatgtcagatcaaattactgatctgacttggtttggatattattctctcaaggtttatgatgcagaatgggattgttgaagtcaaaatagaaatgtggagatggatctctaaattcaatgttttctttgagaataaagaatcacaatttggagcatacacacgggtcaggtgttcttcggtatgtctgaagaacaaagagaaggttggtgattttataaaaatgagaaatgttatgtattgctcttagagaaagtgcattgggactagtaagtttctggggagctggcaaactctgtttggtgagcaacagcggtggggaaaattagccctggagttgcaagttgtctcagcagttataaataaaactgtctcgggttagaataggcagtttcaacagccagacttgcagaaaattacgtttctagagcgatgctacatgtcctgattttttttcccctggctagtcaactttcttttaattgggtgtgacaagaatgatccaaatcatatgatcaaatttcataggccagttcattacatgaaatattatttttaaaaacagttgacataggtagacatccatcccttgtcacttctttattgtgaaacaatgaaaacgaaatgggaaaggttcccttgtcctcctcgcagggcatgcgttgggggtgtggatcgcttcttcagtgccccgctgctcaaacctctaggggagcatgcaaatgggcaggatgtggggctctgaccccagtgtctagggatgaaggcccagtaggcatgtgttacagggcatgtgttttagtttgccatctataggcgatttgtgttaaccagcttaattagacccccttccttatcacaaggacagagggatttctgtatcccggggtttcttgccttggtgtactggaagaatcggatcacacgtgggcttggagaacaactgcaaagttttattgagtggaagtagctctcagccaatgggggagccagaagggagatggttttcccttggagtgggccattcggagttttggggggccacggctctcctccaacttccccggaccaaactccgcctccttccaccagtgggtggcctgcacgcgtgccagtgtctgtcggtgtgctcttccgctggtgtgctccctcgacatccttttggagtctaggagccgcttatgtcttctgccaatgtgttcctcaccacatccacctgtatttgtatctgcctgctagggtcttggctttttataggcccaggatgggggcatggcaggccagggtggtcttggaaaatgcaacatttgggcacaaaagcaggagcgccagtcttcacctatggagccctagccagggaccacgcccttctccactcagcacttccctttcccccttccatgtcatttaaagggaccacgctcttcccttcccagtactcccgtatcaaaaagaacataggttcatttggaacttcctgttctatatgaaacattcctctgtaatgactttggctctatggctctaaggaaggtgttatcaggtgggtttgtagcagagaaatttctgagaaagcaagatgtgatgtatggaaaaagtaggaaatatttgctttatgctttctgttatttttttcagaatcatcttctttcataactctcagccacagtccctactcattccacccttggatattcacctttcatagtagaacctcagtccaaacactcttcatgacaaggaataagaaaataaggcaatgaaaaatacttctaaatttccagttacctgtataaactcaaatatataaactttctctgccagccagtgatacgaagtactttttcctgctatgtctaacaactttcctgcttcacacataagtgaaaaatagttatatcctagatgatgaaacagaaaggtaaatattagcacagtcttctgaagttccagaaatataagcctatattacttcacttaagtaggaaaattgcttcaacatcccgtaccttgtaaatgtggcacatctatttcatgctaacatctgtcacaactggacagctaaggacatatttacatggatatgttctttaataagtaattaaatgcttataatttttgtttcaaaaattaatccatacagtttgctttttttaatgcagcttaagtacacataactgtcttgtggcaaagaattttatttagtagtcaaagtactctgcaaacaaagacttattaagaatctctctgttggaagagtgtaattttaaacagtgacattgattctgcagcttttatcttttgaccttgttgagtgtcttagtaagaatcatgattaagaatttcctctgagcctcctcattaagaataattagaaaaaataacaaattagctttcagaaacaagatggaaataaaagctgcttttcataaagtgtttgatgaataattttgttttccacatggacacaaatattatccttttcctttctcctttatatttcaattacaaaacacagagacaagttggataatgttgaaaaacaagctaataacagaaaagttcttttggaaagattttggaataacagatcttatttcaccatgtaaagagcttttagaagctgtatactgtctactgtatgtatcaaaaaagagttgtttatttttagtttatttataaacattcctcagataatttttaaaaagaaagtatagttccattatcactatgtaatttaaacaatcggtggttatatactgaaatatattaagtcatgattttagtatgttaaatgcacatcaaaaatgttaatatatttttatagattgaatttgtatcctcaaactatactgaagccatttatcagtttcaggagctttttggtgatgtcatcgaggtttcctggttatagaagagatagtttgacttctttagtttcgtgtttgggtacattttctttctttctcttgcctgaatgctgtagttaggacttctagtactatgtcaaatagaagtggtgagaatggagaatggtatccttgtcttgttccagtgcttaaggggaatggttccagcttttgcgacatttagtttaatgttagctgtattgtgtcatatatggctcctattattttgagatatgttcccttgatacagagtttgttgaggatttttatcatgaagagatgttggattttattgaaagctttttctgcatctactgggattatcgtatagtttttggttttaattttgtttatgtgatgaatcacatttattgaattgcatatattgaaccaatcttgcatcctaggaatgaagcctacttgataatggtagattaagttttttatgtgcagctttatttggtttgaaagtattttgttgaagatttttgcatctatgttcatcaggaatattgacctatagttttctttgttccttgtgtctttaacaggttttggtatcagggtaatgctggcattgtagaatgagttagggaggagtctctcctccttgatattttggaatagttttagtagatttggtaccagctcttctttgtacatctggtagaattcggctgtgagttcatctggtgtggggcttttgttcgttggtaggtttcttattactgagtcaatatggaactcaatgttggtctgttcagggttttaatttcttcctgattaaattttgggagattgtgtgtttccaggaatatatccatttcctgtatattttctagtttgtgtgaacacaggtgttgataatagtctctgaggatttttttgtgtttctgttggaccagttgtaatgtcatctttgtcatttatgttgtgcttatctggatcttctctgttttgttctttgtttatatagtcatatagtcagtggtctatagatcttattcgtcctttcaaacaaccaacttttggttttgctgatgcttttatggatttttatgcctcaattttatttagtcctgccctgattttagttatttattttcttcaggtagcttttgagttagtttgttcttgtttttctagttactctagatgtggtgttagatcgttaatcagagatttttctaactttttaaggtaggcatttagcaccatacactttcctcttaacatatctcttcccacatcccagagatgttggtattttgcgtgtctttcttcatttatttaaaagaattttttaaaatttctgccttacaatccaaaactcattcaggagcaaagttgcttaatttctatatatttgtgtgtttttgagagatattcttgttataggtttctattttaattccactgtggttggtatgtgattggtataactttgatttctttgagacttgttttatggaaagaccttcttttggattttttccaacttgctttatggctaaccatgtggttgatcttagagtatattctgtgtgcagatgagaggaatgtatattctgtggttgatatatggagtgtcctgtaaacatcaattatgctcaatttgtcaagtgtcaaatttaattccagaatttctgcggaagttttctgactcaatgatttgtctaatgttgtcagtggggtgttgaagacccccactatcattgtgtgctatgtcagtctttttgtaggtttagaagtccttgtttcatgaatttggatgctctaatattgcatatgtatatagttagcataactaagtcttgtctttgaattgaaccctttatcattatgtaatgcccttctttgttcttttttattgttgttggtttaaaagctgttttatttgatataacaatagtgacccttgttccatttggtattctgtttgcatgatagatctttctccagccctttactttgagcctatggggatcattacatgtgagaagcgtctcttgaagataccagatgaatgggtgttactttatccaacccatcactctgtgccttttaagtagggcttttagatagtacgtctaaccaagaagctgaaagacctctgtaaggagaactgcacactgctgaaagaaatcatagataacataaacaaatggaaaaagcatttcatactcattgactggaagaatcaatattgttaaaattgccataatctctaaagcaatcaagagattcaatgctattgctactgaactttcaatgccattttacacagaattagaaaaaattctgaaattcatatggaaccaaaaagaacccaaatagacaaagcaatctgtagtagttcattgttgcatcattataaagaactacctgagactgggtaatttataaagaaaagaggtttaattggcccttggttccacaggctgtacaggaagcatggctggggacatggccaaagtaggaggaagagaatgaaggggaaggtactacatacttcaaaacaaccagatcttgtgtgaattcactcactatcacaagaacagcaagggcaaatcctacacccatgatccagttttatcccaccagcccctcctccaacattggaggttagaatttgacatgagatttggatggggacacaagttcaaaccaaagcacaatcctaagcaaaaacaacatagctttttttcaaactatactctaaggctatagtactggtaacaaaacatgttattggtacaaaatagacacatagaccaatgaaacagaaaagagaatccaaaaagaaagccacatacctacaatcatctgatttttgacaaaattgacaaaaataaggaatggggaaagtaccccctattcaacaaatggtgctgagttaactggctagccacatacagaattaaactggacccttactttcactatctacaaaaattaactcaacatgcattaaaagtttaagtgtaagacctcaagctgtaagaatcttaaaaggaagcctaggaaacactatccttgatgtttgcatttacaaagaatttatggcaagtcctcaaaagcaattgcaacaaaaccaaaaattgacaagtgggacctacataaactaaagagcttctgcccgacagaaaagactattaacagagtaaaaatacaacctacacaatggtagaaagtattttcaaactatgcacccgcaaaggtctaatctccagaatctataagaaacttaaataatttaacaaacataaaccaaataaccacattgaaaaattggcaaaagacatgaacagacttctctcaaaaacagacatacaagcagacaacaaacatgaaaaaatgctcaacatcactaatcatcagagaaacgcaaatcaaaaccacaatgagatactacctcacaccagtcaaaatgctattattaagaagtcaaaaaacaaaagatgctggtaatgctgcacagagaagggaatgcttgtatactcttggtgggaatgtaaattagttcagccaatgtggaaatttggagattctcaaaaaccttatggtttttggttttaattttgtccatgtgataaatcacaattattgaattgcatacattgaaccaatcttgcatcctaggaatgaagcctacttgataatggtagattaagttttttatgtgcagctttatttgccttggaagtattttgttgaagatttttgcatctatgttcatcaggaatattgacctatagttttctttgttccttgtgtcttcgacaggttttggtatcagggtgatgctggtattgtagaatgagttagggagcagactctcctccttgatattttagagtagtttcagacttgataccagctcttctattagactcacaatcctattactggttatatatctaaaagaaaacaaattgcggccggtcgcgttggctcaggcctgtaatcccagcattttgggaggccgaggcgggcggatcacaaggtcaggagatcgcgaccatcctggctaacacggtgaaaccccgtctctactgaaaatacaaaaaaattagctgggcatggtagcgggcgcctgtagtcccagctactcgggaggctgaggcagaagactggcgtgaacctgggaggcggagcttgcagtgagctgagatcgcaccactgcactccagcctgggcgagagagagacgccgtctcaaaaaaaaaaaaaaaaaaaaaggaaacaaattgttccaccaaatagtcacatgcacttgtatgttcattgcagtactattcacaataacaaagacatggattcaatgtaagtgcccgtcaacagtgaattggataaaggaaacgtgctgcacatgcaccatagaattctatgcagccataaaaatagaatgaaatcatgttgtttgcagccacacggatgcagttataggctgttatcctaagcaagttaacacaggaacagaaaaaccaaataattcatgttctcacttatatgtagcagctaaacattgcatagccatgggcataaggatgtcagtaatagacactggacatctagaaaaggggagagggtggaagagggacaagtatttaaaaaacaactattgagtgctgtgctcattacctgatgatggaatcaatcatatcccaaaccttacagtatacccagataacaacctgcatattgtatacctcctaaatataaaagaaaatttgaaattattttttaaaaagttaacatatgccccattccttatttgatctactaataaaatgtggttttcctttgaatgttaaaaatggaagaaacttctactgaaatattaaaaaaaaaaatgacagtcattgctttttaaaaaacagacatattttaagtgatttgctcacttggttagaataaaaatttacctcacaataacatagaaagcatttccatatgccagacactactctaaaacaacatctattttacaaataatgcaactgagctacagaaaatttaattaactttcaaaggtcctaagagtgagcaaggtgttaaatgtgactagtatttaacctaggcagtctgtctcaaaggctatgttcttaaccacaacattatatggcctcttttgatgtcagtggtaatattacaccttggaccaagaattgttctgttcatcttaaattcctcaaattgaatcatggttgcttgctggaagcttagacaagaaaagaagagttgtaacccacaatggaaggaaaacctaaacagtttctaactcatgtggtatgaattatatgtaagagaattatgtatgaatacaaagattaacatgttttgacaatgtatttacataaaactataaaataaagtacaataatattttcaatcaacaaaagcaatcttaaaattatatacttcatctttggagcagccttctactgacaatttatttcatattctgcctttttcctaaagcccctagaaccttaaacttctttttttttttttttttttttttttgaggtggagtctcgctctgtctgccaggctggagtgcagtggcaccatctcagctcactgcaagctccacctcctgggttcatgccattctcctgcctcagcctcccgaatagctgggactacaggcgcccgccaccacgcccagctaattttttgtatttttagtagagatggggtttcaccatgttagccaggatggtctcgatctcctgaccttgtgatccgcctgtctcggcctcccaaagtgctgggattacaggcgtgagccaccgcatccggccaaacttcttaagactaagtatgggcttctggtctctgaccaaatgccatttatgttcaagtctgctgttgttgatagaccagttagaataaaataaaataataagaaattgttttttttaaaagtacagattgaggtagctatggtctctagagtaaattgtattgatgaaagcaatgatgttgagtaattaccatgaatgaatttggtggatattactagacaatgttgttttaaagtcttcatcaaattatataattcaattaataatgacactaaggtacataaaatatcatttgctcccttcatggtgaaatctgaaatctgcaaatagtaatgccaagagagtaacacaagtagcatatcctgttcttgaattggaactgaattacttgctctgtccttaaatttactcagtttattttgcttttgttctatcattgtctttttccattagtttgttgactgtaactttagatcatacaagttagattattgttccattgattttataaattcaagatcaaactttttcttttggatgaagcagtcaaaatgtaaaataagtagtatctgtcttaagatttcactcctgtgtgtattttcctgaaaatgaatataccaaagatcaacaggaaaaatgagaaaagtccctctcctgctgcttgtgacatgcaaattgaaaacagaatgcttgtgtagcatgaaatttaaagagaacacagtaccttctttgaatgaggtgccaaattgctttgaacttagcaatagattcagtgtgtgtgtgtgtctgtgtaaatacaaacacatgagcaagagactagattactctgaataacgaaacagataatagagaaatgttggcaggaatagaggtttcacaaaatctgcaactcttccttgatctttctgtggaatctcaccaactcatatcaggggcatactgggaccagtagaggactgtgagaaccccattactttttttaagcttcaagttcaaggagtctatttttccctagtaaatttaatccatcagagtatatctagcttggtatctgggataggaattcaagcaaatttttgtccctacagaccaccagtgacatttcatgtaattacttttattcttaataacaatatatttcacaatcccatatataactaagatctgccctcactgaatatttgggagagctgagggtttatttactatatttactatcagcccttgcatgaaaggaaaaaaatagaaaaaacattttattcgaatatattcctaatgaaaataaggatactaataaaagcaaatgtaggcctagtctgtctatacattttgccagacactcttctaagaaattaccatagatttcctcattttgtccttgttgtaaaaatatatgagttagttgtaattactcttatccccattaatgaaatacaagaggttaaataatttgtccaatattatacaactattaaaaaccaaagttaggatttgaagttaggttttgtgactccaaagcacatgttcacaaccactataatatattagaaacccatttctttaacatcttaaaacactcccccaaagatttgaaatggttaaagctaaggatttgatggattattcattttgttaattttccatagaggaagatatttcctaattcagcaaataaattaaatgattatgttaagtcaaatactctactaggtgccacagagttcactggtgatttaggcagcttgtaaggaaatagcttaaaaattctaagatgacaaaaaaaaggtaagttgatctttgatataatttaaactttagtatttgaaatttcttagttttattcctttaagatacagtttggtaaaatcataaaacatcttggaattctaatagaaattatagacatttggaagcaagtgaacattttctccttttttttcatcactttactttgtctattattgtgagctctctctaatctttcataacttgttccaaataacctcaaattcttgcagaattatctacacctttcttactttattggtagcctttcacatctgctgagttgtcaccaatgaccttatctttagacaacaaattatctgtcaattttttcctcattacagtaagtcttcagttaatattgtccgtaggttcttggaaattgagactttcaatgaaatgacataaaatgaaaccaattttattttaggctaaacaaaatataaacaagttcctatgacatagttatggttacaaaaacatcaccacacttctaaataaagaccaaaaatttcttatattaaatattgaagtaaatgtgagctatacatgcatttaagaaagattaatcaaaaaaagtgagataattatttaccagttcagggcctcccatcagggagcctgctagcccagtacctcagggcataaggcaggaacccaccttggacaggataccattccttctcagggcaactcacacacacacccacactcactcacactggtaccatgtagccatgccaatgaacctagcatgtacatctttgagatgtgggaggagactggagtactcagggaaagtcctcacagatttggggagaacttgcaaaatccacacagatagtggctcaggcctggaattagttgtttttttttttcattgttataatgaaatgacattgaatgaaacaatgtcattcaaggacctgctgtacttgcacttgagaaagacatttgaaaaattaaaaagaaaaaagggaattaatgtacagagtgttgttttaattttattgttacaaatttgattgaggccctttgtttttgcattcagtaaataattgcttggaatcaaaaatgtgccaggaaaatctgccctgtggacacaaccgtgaggaatagaaacaaggtcaatgttatcactgagttttctttctgtgaagaatcaagtaatcataaattgatattatgaggcagagttatgagagtatatattgggaaaccttacctagtcaagggatcaaaaactattttgctttgggaaaagagggacatggaaatagatgagactggagagggaaggagaaggcatattgtggaggactttgtaggttatataaaatatgttagtttacattctagaatcatatttgtgatgagttgtagatggccaaaatattttagcttataacctaaaataaatggtaaattcttttaaaaataagcaaggttttaattataaagatcactctgcttaaagacagaaaattaactcagagtaagggcaagattgattgtaaggaaagcagttaggaaaacctatttgattaggtaagagacaagattagcctggtaccactgcagattgaaagcagtgagtggatatgacaagtttttctttaggaattaaattcaagacttatcgatcggtacattttggaaagctagaaacatgggtaaaatgaaatgtgacttcctggtttctgacttatgtggcttggtgcagaattatgccattcactgaaataatatatattgaaaatatccagttttcggctatgatagcaactgggatgcgatttggagggctacatttaagacaactttgaaattgcaagtacagaagttgtctgggcaaatgggacccaggctcagaagataaatatgggtaggaaattcaatacacaagttattaacatataagggcaattactatgttaatatattttttaaagtaaatagttttgaagtcttattgaaaacacattgatcaacgttaaaagaacattttgagaataggctaaagtgggaatagaatttgaattcctgggtgcttgctctcatttctacgaaatgagcatattcggaaaatcctagattttcaaaagcctttgtctgacctgtctgtaacatgctcttaaaattcaggctacaatgacaacagagtatcacaggcttagtatctgtgagatcagtcattatttgtctttttaattctcctctttggattttaaatcccatctattgcatatgaatatttttaaatatatggcttatttttagcattgtgacaagtttgcagaaataagccacactgagcattcagttattggtattcatatcctgtactttaccacaaattggatatggaaaatgagtataggcctaacaggctagaaactttaggcatgaaaaacaatgaatttgtgatttaaccaggacagtcaagggtgaaattaaatagattaaggaagtccatttccagggtacaggtatcagcagctcacctgactttcctgtggcagacagatgatccacagaccatagggtacaatctccccatcccccaaattgctttctagtcttccctttgatttacatttggatattttcatacataatatatagttggctattacatccaaattactttctttccaagacaattctaaatataattgttcttattaaaaatgcttttgtgcacttcaaaactaattaattatgctgtcgtgaatgcatcgtttaaaaacaaacactttgttatgaacaatgttattaatagattatttattatgtgtctgcttaacctcttttcattttgtgttttgagtcttaaaaaagtttaaattatttttgtatttatccagaagtatatgtagtatataaagaatgttttattggggagaattttgaatctactaaaataataaatcgtagtgggaattatctaagggtactgtagcaggagaaaatgtagttaagcagcttcttctgggctgtttctgctattgaggggttagtgagaacagagacttctgagctgctctcatggagaggttttaatggaagattgtagcttagcagactacattgtggaaaaagtcaacaaacattctttcaggaccagtatcatgttctgaggttaccaaggtgaaaatgatgcaggcatggtctgaagaagctcttgtgagagagaaagacacattagtattgtgccaatggggcaattagtccaatgggatacagtgtgtactgcaggaatacagagaataaggacttaatctagaatgacaacgagaaggattttcaagaagaggtgatgcgtaggcagattcctgaaaaaggaataaaattaaccaggggaagaagagtggaaagtatattttaacagttgatgcaaaaaacataaatttggtttggtatgaatggagaattaactttgagaatgggaaaggcggagagtgaggaagggctggaatatgaagatattatttggcttagcttcataaagcctacttttaaacttaatagtaacaaactgtaaaaaggttcaaaaatatttatatccaaatttccccttcttttattattctatattctgcttgcccataaagttgttgattaaatatttattcctctaccaacattcacactaaaatacataatttttatctattttcagtaggtattatggcattggcacacagtgacatgagtgtgtgtatatgtgtgtgtgtgtacatatgagagagtgcataccttacaatacagtgctttccaaagcctaattattcatttctatgtacataataattggaggaattttataaaacagtaaataaataaagaaatgttgaaatcatttttcaagtaacatgaaaatttggaaggctttaatcaaaattaattcgcactaggtgcaaatatgtgaaatatctaattctacaaaaagaagcagagatttgctaggcaaaaaaaggcaacaatgaatttagataacaaaattttgctaaaaatacaggctacattccagcaacagtaagaggattcatgtaattgaaggacaggttgcttaattctcaataaaggatgttaaggccatgtgaagaaactttgttcttctgatttttttttcattttctccaaaagaaacatgtaaggtttttgttcagaggaatgctattatttcacttttgatttgggtacatgaaaatcattctcatgaaaggaatagatgaatgcaggatgagaacaagacttctgggagatcagcgaggaaactaaatcaagagcagagatgacaaatagtgtagtgctgggctctgtaggagggcataaggagaggaagaggcgtaatgagtgtgagatattttagatctgaaaatgttatgacttggaactccttcaatattgacaagtgtaaagagagaaaatgtgtagatctcccagcttctttgcttcatatgagagcgtacataccttacaatacagaatagtgcttcctgaaggcctaattattcatgtatatgtacataataaatggcagaattttaataagtaaataaaccttgaaattatttcccaaataacacacaaatttggaaaacttcaagcaaaattaatttgcactgctgtacaggagtgtgccatgtatgtataactgcatgacatagccctctctgcctcacaaagtatttcctagtagagtactttatgtctcagaggtgcacatttgacatcctgcaggcaaagttttcacatttcaactgtcatggatattatagctcatactattttttatgttcattatcatgtgatacctggaaggatattagcagtgtttgaaataatgaattaatcatcactactgattgacaggcactattcttaaagttttttcagcatacagataacagactgttcataagtaattcgtatttaccttttcgtaagaaaaataccaatttactttatgttattttctagtcttttttgtaacggcttttaaaatgctaatgatgtgtattatccagtgaatgtgttaacattatattagaagtaggaaatctgatagggattttatatattctatttccacaaatcattagataatgttattgtataatgctttttatatccttaaatctctcactaaatatatacatatattctctcttcctttctttcttccatttttctgatctgcttccattgatgactctatacttttgactccagactggcaatatgagggtaagatgacaaaaataaaaaccccaaacaacctcatgagcattgcttgtctgtctttgttttattctctttagaacattattaaaattctattcactctctctaattagaccctttatcacaattaaagtccaattatgtttgtttctgttgtgatgctttaattacaatttatccttgttaatcatccctttctgttatttctttgggttaaatttccatcccattatctctgtcctgaaggacttctgctctccagtggtccctgctggtgttttctcagtaagatttgagtagttttgtgatgcacaaagtgactgtattatgatgtggtaaggaatctatgtggttattataaaatgtttttaaataatattaattgtagtgatgcatattaattagattgcaagattttcctttttaaatattaatatacatctcaatgaatttttttctcattgtgtgtgcccctgcagtcaattattacttttggttattttctctctttagattgcaaactagctaggggaggaccaccagctaccatagttgctattgatgaagaaagtcggaatggtaagtgagttttttattttacaaatgtcttatctaagagggttttcttcagattttaattctcaatctactatgagtagaggtactaaaatgaaagtttcaacccaaatccatggataattcccctccagtatgggtttaaattatgccagtctctggaaattcatgctttacttggaataatttataaaagtctcattcaattaatataaatatttagttttggtttaaaagaaattatttgattcagagtcatctcaagaatgcatccagatatgggctggaagttgactatcatgtgtatagtcatctaacagaaacacaacgtattcctccaaagaagtggtccacaaaataagccttacattgctaacttctattggctgggatctggtaaggatctagatccacagccgattagacatggtgattgtgactgattaataggaaaacctaatgtgcttagaaagcgggaacatgaaataaggccaagagcagagaaagaagtctgaattttcacttgggccttctgaagtaattaacaattaatatctaattcataccaagttcttctttggaaaaactttttttccttatcattagtgtttttgttctgcatcggccaccttgactctctgaacgttaatgtagaaatattgaaagtgttttctcctcaactgggcagcagtaaaatggttatctcttgggactctgtttctattttaaactaagtatgtaaatgtggtctgtggctcattttgtctgctaattacatgatagactcttccattaagcttgtacctaatatttgttctaaagtatgtgcttgcactttcatattttttacaaaataattgtcagttgccttattagaaagtgacctttttcttgtaactcaatctacacgcgtacatgtactttggaaacctgtataggcaattcctgcatcagttacttcttcatgattgattttgctgcattacagatgctccttttactcatttaaagaattgacgcagatgtatattcccacacattctgtgaaatcactcagaaatatctacagtactgctggcctctgattaaacaaatttaagtattaataaaatatttgccacattaagtaattacaaaaatgtgaacattttgattatgtttttaaaatctatccttattcataataaaatcatatggagttacagttattatgatgcatttatgtaagttggaaataaatcccaaatgtgtctacagtagagaaaaaatattaaaatactataaagtaaaagatatatgaaaaaagattctctgttacagtgatgaattatggcttccttatggctaactatttttaaagaaagaaatctatattttctaaatattccacagtgaaaacagttaacctttttaaccagaaataaaaattcaataaacataatgcaaggtttatcaacaatttcttttctaattgttaaccaattcatttgaaaatgtaagctgggctgaaataaaacatttagttttcctaagcaaatttgttttaatgtgtgattctgtatagatagagcttattttgccaactaggtaattatagcaacagcaatgatgatagtttatttccttttgtgctgattagatcctacttttcaaaggagcttaggaactctacgaagatgttgccatagcactgctgtacagtagcaggtggtaaaagttcaatatttgtgttttagaagaaaatgacatgatatagtatactaatgttgtgctccttacttggcatattttgtagaaactgccaactactcagaaagctgccagagttatttaagtcatcacaagaagtataaatactgatctagagagtaaatgttttgcatttctcttttgcattaaatttctaaaaatatggtgatcaaatgaacctctgccagatattataatgtagtgctttaatcatttttgtcttaaaaatctaagggaaacaatccatgcaaatgtttttatatttttctttaggcaatcaaaacttcccaatgacacaattatttttggccatgttgggtggctcatgcctgtagtcccagcattttgggaggctgaggcagctggattgctagagctcgggagttcaaggccagcctggccaacatggcaagaccctgtttctactaaaaatgcaaaaattagccaggtgtggtggcacacactcacagtcccagctacttgggaggctgaggcacgagaatcacttgaacctgggaggccaggaggggaggttgtagtaagctgagatcattccactgcactgaagcatgggtggcagagtgagatcctgtctgaaaaaaagaaagaaaagaaatacttatttttagccttgctctatactctcttaatttctcctttccagtatcttttaattggtagtaataaaacatgtgggtttcctattttaccagaatgatgagcactcatttttaaaggctttgaagcttctttgaaaagaaaggcctaacaaatctttaatcagctaaattagtaaatttacttgaagtcaaattgcctgtggctcacttaactgatgtctattgctaaataatctctatatctaaatacattcactactaaagcaaagcatctaaatagctcattttttaaattatagctaattgtttatgtaagtcattgagctacatttatagaacacttatttatacacatgtctctatctctcaaagacttttataatttgtgggacagaaatattctttgtgaatatatatgtcaagtgcatttatacatatgtgcatgcttggaagaattatgaatttaacaggcagagatccataaacttctttctcatcctgggctctgttagatgctttcaattcctgatctttgtcctcaacagcaccttaatgacagattcattacatcatcttgggctgaacaagagattattttcatcacaattgctggtaatactaagcttacgttgtaaaggggcaaagtggacacacaaagagatatgttagttcctgactaccaccagaaagctcttgaactagcatgtagagcgtatttagtatgtaatttcattttgaggggagaatggatttagagaaacagatcacattatctatgtttaattaagtgagaatgtctaaaatacctttctgaacagatattttctagtttctcttgactctaagttgcttatagcattgaagccttactgaaagaagagaggtggggacagttactctgggactacttaaagacctgccactgagtgccagccacatcagagtccttggctgctttacagcaactatagattgacattaaacatactttggaaccactcattcaaactaattctcagaatctgccgaagtgtacaggcactgctacgtaaagagaaggagaaaatgattttaagtcatggttggaacacaccactgtgactgtacagaaatggacagatgcagagacaaaaggatatcactacgtgagagattagaaaacccaccctgaaggagcttcatgaatttaaagtttaaaatatattgtacactctcagtaaatttgggaaatgaaaggtaaatctgagttgtctccataatttgaaagcaacatcaaccaaggatgccatgatggactcaatgaagaagtttacatttagattgtataattttttaaaagttatttggggagtgagttgcttgtggaaatttatcgatgtaagaggggaggaagcaccaaagttcaattactggctttgaaataaaggtcatgaagattttctttgtacagaactttcctaagcagtatttctccatcctctcttccttacacgggctctcttgaggtcttagattttaccattccctgtctttaaggcctttcttctctaaatttccttttgccgtaaacagttatttcatttcttccattccttatgatcaaatattgactgttagacttcggatttgtgttgctgagacaattggactgtgagtttcttccctgttaagacactgaaaatctgatcactaccttcacttttgaatagagtgcagtaatcaacagtataaagtttcttagcaattgctagatataaatagtaattcaaaaactatcttgaaaatattttggacttaaaatatttcctacagcagttttcaaaacaaatattcaaatgccaagtattcctaaattgaattacttatgtaattcaactaaatgtaagtatgtcatgtgatttaaagaacatgaaagtacttgctatcccttcatctatgactacttcatacaaatttgacatatatactaaaatgagcatttattttatatttatatcaggtagtgtagtttaagcaaagaatgtataattacttttcagtatgaatagaaatgaatctgttaagtatactcaatataaaatttttatgaaattgttataatctacgcactgttaaagtacactacttttggttaaattcaaatgggtttattcaacaaaatgtagatatatactaatatattgagtgcttttttaaaaaatccaccaaagcaacttgccattgatgtcaagaatcaagattttgtttattattgatccaagtttttgctttctagattctccattttgtcatacagtaatccttggttctcattccaaaaatgctgacctggttagcactaagctcttttcatgtacctcaggacacattggaaactatgatattgcttttactgtcatttgtgtgtttgcttttgaaaatttacaattttacagagcagtgctttgagttgtcagacctgggtgtggttgagagtgttgcttcttaagttggttttgagtaagaaagacaatagttcctagtcaaagtttagtattaaaattattctcccaaatttgtcttcatttttacaacaaaacagctgaaatagaatgtaagtaaagaccacctgcttgcaattctctccttccctgttacaaacaatcttgaacacatgcccaatacataattttgttgttcaatcagtcatttcattaatcatttgtttgcttagttatttcttcaaggtatgattattgacactctatattgtgtgagaatctgttctggtactggcgatgcatcagagaagaaaacaggcaaaaccactttccacatggagatagagacagggagtaaaaacgaaacagagcaagaaaccaaggtgtgattaacaactgaggaggcagtgatgctgtttcagatagacgacttgtttctttgaggaaattacattagagcaaaactgcataaagttaagactgaagatgtgagccatgcattcatccagggaatttacattatagacagaggaataaattcaaagactctgaagatgaatatgctgataagtttaagaaatggcaagaagatagctggagaagatgagaaagagcatatgtgattgaaatagagaagatggatgttgattgaatgtatgtagattagtcaaaaatgtttttgactttttaattgatttgccaacaaatcagttgatggtgacctcatctagtaacatataatttacaaagaataattcttttttcatcactcaatgtcatagcagcgcataattaaaaattcaaattcacaactgtgtgtagatgtttgttcacaatcacagataattttattcctttttttttttttttttttttttgagatggattctcactctgtcactcaggctggaatgcagcggcgtgatcttggctcactgcaagctcagcctcccaggttcacgccattctcctgcctcagcctcccgagtagctaggaccacatgcacccaccaccatgcctggctaattttttgtactttagtagagatggggttccaccgtgttagccagggtggtctcgatctcctgacctcgtgatccacccgcctcggcctcccaaagtgctgggattacaggcatgagccaccacgcccggccaactttattatttaaaaatatattttactcagaaaaaatcagaaaatgcattaagtcattcaatttggctcagtggtatcactgcctcatttaacacaaagtagaggattattacagtcataccaaaggtcaatatgaatgtgatgatttctattggaaagtaatacttagtgtcagaaaatttcatagtgtggtaccatcaaaattaataagtgatttttgttatattacattctcttttaaaaaatcattaataaagagggaagattcaatagtagcagcttcacatttcagataaatccttacaaatatatttactttgcttgataaaatgatcttctttattgaatatattttggtgaaaattgattaatgtgcttggttttatcttaatacttcgggacaggcaaggagtgagcattatttgtgagaaaatagcaaatagcatcccatcagtattctctaaggagtttattcagtatctttaaaagggtttatttagagatatgagggatcttattgacaacagtcagagtaaatattataaatgacttaaaaacagtaagtgattaattttctattttgttttattattattatgctttaagttttagggtacatgtgcacaatgtgcaggtttgttacatatgtatacatgtgccatgttggtgtactgcacccattaactcatcatttagcattaggtatatctcctaatactatccctcccccctccccccaccccacaacagtccccagaatgtgatgttccccttcctgtgtccatgtgttctcattgttcaattcccacctatgagtgagaacatgcggtgtttgtttttttgtccttgcgatagtttgctgagaatgatgttttcgtttcatccgtgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatatccagtaatgggatggctgggtcaaatggtatatctagttctagatccctgaggaatcgccacactgacttccacaatggttgaactagttgacagtcccaccaacagtgtaaaagtgttcctgtttctccacatcctctccagcacctgttgtttcctgactttttaatgattgctattctaactggtgtgagatggtatctcattgtggttttgatttgcatttctctgatggccagtgatgatgagcattttttcatgtgttttttggctgcataaatgtcttcttttgagaagtgtctgtttatatcctttgcccactttttgatggggttgtttgtttttttcttgtaaatttgtttgagttcattgtagattctggatattagccctttgtcagatgagtaggttgcaaaaattttctcccattttgtaggttgcctggtcactctgatggtagtttcttttgctttgcagaagctctttagtttaattagatcctatttgtcaattttggcttttgttgccattgcttttggtgttttagacataaagtccttgcccatgactatgtcctgaatggtattgcctaggttttcttctagggtttttatggctttaagtgtaacatataagtctttaatccatcttgaattaatttttgtataaggtgtaaggaagggatccagtttcagctttctacatatggctagccagttgtaccagcaccatttattaaatagggaatcctttccccattacttgtttttgtcaggtttgtcaaagatcagatagttgtagatatgcggccttatttctgagggctctgttctgttccattgatctatatctctgttttggtaccagtactatgctgttttggttactgtagccttgcagcatagtttgaagtcaggtagcgtgatgcctccagctttgttgttttggcttaggattgacttggtgatgcgggctcttttttggttccatatgaactttaaaggaggtttttccaattctgtgaagaaagtccttgatagcttgatggggatggcattgaatctataaattaccttgggcagtatggccattttcacaatattgattcttcctatccatgagcatggaatgttcttccatttgtttgtatcctcttttatttcattgagcagtggtttgtagttctccttgaagaggtccttcacgtcccttgtaagtcagatttctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctaaatatacaatcatgtcatctgcaaacagggacaatttgacttcctcttttcctaattgaataccctttgttttcttctcctgcctcattgccctggccagaacttccaacactatgttgaataggagtggtgagagagggcatccctgtcttgtgccagttttcaaagggaatgcttccagtttttgcccattcagtatgatgttggctgtgggtttgtcatagatagcgcttattattttgagataagtcccatcaatacctaatttattgagagtttttagcatgaaggattgttgaattttgtcaaaggccttttctgcatctattgagataatcatgtgatttttgtctttggatctgtttatatgctggattacatttattgatttgcatatattgaaccagccttgcatcccagggatgaagcccacttgatcatggtgcataagctttttgatgtgctgctggatttggtttgccagtattttattgaggatttctgcatcaatgttcatcaaggatattggtctaaaattctcttttttggttgcgtctctgccaggctttggtatcaggatgatgctggcctcataaaatgagttagggaggattccctctttttctattgattggaataatttcagaaggaatggtaccagctcctccttgtacctctggtagaattcggctgtgaatccgtcttgtcctggactctttttggttggtaagctattgattattgccacaatttcagctcctgttattggtctattcagagattcaacttcttcctggtttagtcttgggggggtgtatgtgttgaggaatttatccatttcttctagattttccagtttatttgcgtagaggtgtttgtagtattctctgatggtagtttgtatttctgtgggatcggtggtgatatcccctttatcatttttattgcgtctatttgattcttctctctttttttctttattagtcttgctagcggtctatcaattttgttgatcttttcaaaaaaccagctcttggattcatcaattttttgaagggttttttgtgtctctatttccttcagttctgcactgattttagttatttcttgccttctgctagcttttgaatgtgtttgctcttgcttttctagttcttttaattgtgatgttagggtgtcaattttggatctttcctgctttctcttttgggcatttggtgctataaatttccctctacacactgctttgaatgtgtcccagagattctggtatattgcgtctttgttctcgttgttttgaaagaacatctttatttctgccttcatttcattatgtacccagtagtcattcaggagcaggttgttcagtttccatgtagtcgagtggttttgagtgagtttcttaatcttgagttctagtttgattgcactgtggtctgagagacaatttgttataatttctgttcttttacatctgctggggagtgctttacttccaactatgtggtcaattttggaataggtgtggtgtggtgctgaaaaaaatgtatattctgttgatttggggtgaagagttctgtagatgtctattaggtcctcttggtgcagagatgagttcaattcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaactcctgccgttttttgttttccttttgcttggtagatcttcctccatccctttattttgagcctatgtgtgtctctgcacatgagatgggtttcctgaatatagcacactgatgggtcttgactctttatccaatttgccagtctgtgtcttttaattggagcatttagcccatttatatttaaagttaatattgttatgtgtgaatttgatcatgtcattatgatgttagctggttattttgctcgttagttcatgcagtttcttcctagccttgatcgtctttacaatttggcctgtttttgcagtggctggtacctgttgttcctttccatgtttagtgcttccttcaggagctcttttggggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatctgctgttactctgatgagcttccctttgtgggtaacccaatctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctaggttggggaagttctcctggataatatcctgcagagtgttttccaacttggttccattctccccgtcactttcaggtacaccagtcagacgtagatttggtcttttcacatagtcccatatttcttggaggctttgttcgtttctttttattcttttttctctaaacttcccttcttgcttcatttcattcatttcatcttccatcactgataccctttcttccagttgatctcatcggctcctgaggcttctgcattcttcacgtagttctcgagccttggctttcagctccatcagctcctttaagcacttctctgcatttgttattctagttatacattcatctaattttttttttcaaagtttttaacttgtttgccattggtttgaatttcctcctgtagctcagcgtagttgatcatctgaagccttcttctctcaactcgtcaaagtcattctccgtcagctcagagtagtttgatcatctgaagccttcttctctcagctcgtcaaagcattctccatccagctttgttccgttgctggtgaggaactgcattcctttggaggaggagaggcgctctgctttttagagtttccagtttttctgctctgttttttccccatctttgtggttttgtctgcttttggtctttgatgatggtgatgtacggatggatttttggtgtggatgtcctttctgtttgttagttttccttctaacagttaggaccctcagctgcaggtctgttggagtttgctagaggtcccctccagaccctgtttgcctgggtatcagcagcagtggctgcagaacagcggtggctgtagaacagcagattttcatgaactgcaaatgctgctgcctgatgggtcctctggaagttttgtctcagaggagtacccgaccgtgtgaggtgtcagtctgcccctactgggggatgcctcccagttaggctgctcgcaggtcagggacccacttaaggaggcagtctgcccattctcagatctccagctgcgtgctgggagaaccactactctcttcaaaggtgtcagacaaggacgtttaagtctgcagaggttactgctgtctttttgtttgtctgtgccctgcccccagaggtggagcctacagaggccgcaggcctccttgagctgtggtgggctccaccgagttccagtttcctggctgctttgtttacctaatcaaacaactaactcggcaatggccagcgcccctcccccagcctgtctgccgccttacagtttgatctcagactgctgtgctagcaatcagcgagactccatgggcataggaccctccgagccatgtgcgggatataatctcctggtgtgccgttttttaagcccgttggaaaagtgcagtattaaggtgggagtgacccgattttccaggtgccatctgtcacccctttctttgactaggaaagggaattccctgaccccttgagtttcctgagtgaagcaatgcctctccctgctttggctggtgcacggtgcgctgcacccactgtcctgcacccactgtctggcactccctagtgagatgaacccggtacctcagatggaaatgcagaaatcacctgtcttctgcgtcactcacgctgggaactgtaaaccagagctattcctactcggccatcttggctccatcccccaagtgattaattttcatgctacacttgagactttaccaaatcttagaaacaatcagtctaaaatttcttttcgatgagtaagttttatggaacactattataacaaatgttttctttgtttttctgttactgatgaaccattgatacctctattagaatttccattctgtattgcatagcaagtatgaaagttttgctaagtaaatgttttatttgtattatttgaatattcttttaacaccttggaccctgatggatttgaaataatgtttcacaatgaatagatttgtttcagttaaaactgttttttttttttttttgaagtctattttgaatcccaggagaaaagcaattatttcaattttatttcagccaatttcaaaattccagctaaatctcacaaaatataatttttattcatacttgttcatacttttttaaaaaaactaactgtgtgctactccttgctttcattttttttttcaggagaggtaaatcagctaatattcatgatagattttcagttgactaaaataccagcaatttaaaattaacagataattattatcctttcacataatcctaaattgctaactttatatatttatctgattaaaaatcactattttgtataaagtctttattattgttggcaagtaaaacactgataggaagctgtgtgaacattattataattatatatatgttttctttagaaggaatcagagattaatttatttctgggtttttcaattattgactattagttaaaattaagactacacaaagatgtgccttcttcattctgtgatatagttgttcagagatagcactaacattttaacaatatgtaaaagaaatatcctctgtaaatcttattacatgagtaaagcacataattgttttcatgttaacaaagtggttagaaaacaagaagaattccctatataaaaagacagaattttgtaagcctgtgaatacgaagccatgctctagggagaagacagatggaaggtaaacatgcaagcctgtggctaatatttttctgcaaacaactgtcagcaccttttatctcagaatagagaatatttggatcattatattacatgcaatttctgtgagggcaaagactatcttttttgattcattgctgtaatccaagaatttctccaggtacatagtaggcatttcaaatactgttttttgagaaagtgaaccattaacattaacatgagtttcacaaataacagctgcatcagacttaaatgagacttacctgcctatttaggatagtttggagtattaatatgattaagattttttaacataattaatctttaatcaaaattcaccttgcatgtataaaaatacatagtgtgattctttttaatttcaagtatgtttttgcttgcattgtcatgtctacaatgatgacaaaaattttgttttgtgttcaataagatgtttttgaaataatagaaaataatataacaatattctaatgtgagggaatactggtgtgtttgtgtgtagacatataaaattagactgaatattattttagccaggcatgggggcgtgcacctgtaatctcagctacttgggaggccgaggcatgagaatcacttaaacccaggaggcagagtttgcagtgagccgagattgcaccactgcactccagcccaggtgacagagtgagactgtgtctcataaataaataaataaataaataaataaataaataaacaaaaataaatgaaatggaatatttggccaaatcaaagaaaaagaaatctaacactaaaatattttaaaacccatactatcacaaattaaagtataaaatatacatattttatgtattcatatttttaaaatgttttgtacatttaagaatatttcataaaatgaaaaatctgattattcagataaccaggtaaatttataaaattatattttattttaggggtattagataatttcatatgacagatgaagtttatcagccttgtcatgtggtatgatttaatggctgtgtaaaaatactgtctaattcttggaaaatggctcgctttagtttttaacttttgatggtaaaatcttcacttaggtcttttaggctttaagggaagttagataaagtagacacgtgcatcatgaaatgacatttttaaagagtataattagacagaatataatattttgaattaaagaaaataatggaaagtcaaattatactttcattaataatttgctgtctattctacgtgttagtaattttaaaaaataactattctgcatgagtaaatatttttatttaaaacctctaagaaactgcaaatgatttaacaaacatcaatatgttatgtgagtttgcagttcatgaaatgaggaaaaaacccatttgccatttgacatttctagtttaaaattaagattaaattttcagaagtagtaactaaattttgataaccctttcttcattaaaaaattaaaatgaaatgtaatgccatttttgtaggatagcaagatattattgtatgtacagttaattggtagacatatacgcatcatcccccaataatacacacacacacacacacacacacacacacacacacacacacaatgccagaaatgtctataccatgttcaaaaatcaatagagttttaaaatattcaagctatgataggtttcctgaaaccatacctgcatctacactagtgaagaaagaatactctgtacttttaaatttaataagaactcttactcaaatttcagtaatccatattaaatttatatcatggaaactttatgttttattagacatcttggtggacagaaagatatccggaggtcaagaaccctagaaggggtgttttgaattttctcttaagaaataaattgctggcttttgacattataaataacaacaccaaatgtcaacttggaatttgaaagatgaaatctctgggttttcattattgagctggattagcaggtattagttcttttataaaatcaagggttatggtatgttttcttaaatgtttggttagtgtccaactgggcttcaaagttcatttgaaaacactcccccaaagaaaaaaaaataagcactcacataccttatttgacccaaaatttcaaaacattttgaggtcatagaaaacatatccagggacttgtattaaacaatgctattaaaaatgtatagagaaaatttgaaactaaaaatatagtagctatataaatctatttcagtcatattttagaaagttagactagatatgtgtttggtttgagactaagagttaaaattccaggagttcaaagactattttccaaatttaatgtgatcacccaaatgcattatccataaagtgaccgtatgatatatcacataaactgaagacatcagttgagacttaatatggaaacaaacaacacaataatcaatatgaatcaagattttctgtaaaaaataaactctataaaactgggatctgttgtagcaatctgtgaagtgctattctctctgtttctggtggtaggcgtgaagaatctgcaggtcacctaggctggcagctgggaaggaaaagttagtgtgaatcagaggagagtgagggcaaactgatatccatgaagccaaattagagtccatggggacaataattgtaacccatatctgttaccacctttaacctgtatgctactaactacttcatactgacaaggaaagtcagcagatcagcaacagcatgcaagagcagaacagggtacccacacgaggtacaatgggtgctgcagcaattttaacaggaaaaaaattattcttaaaaatatggtttcactaaagtttacctctcaaattgacatcaatgtattccattttaaatcacgtttacattccaaataaaggtaacggtaaaatcatgcttctttccaaggtgacgcatctatacttctaccaactgaaagcacgctaaccatcactctgaaagtggatacaaactcacaaaagtcatttgttcaccagtggtcgatgttcattccacttctgatacacttctccctctttagtatcatatgagttaaatacggtgacataaagttaattactattatcacatttttatgttagatggcaggagacgtggaaaaaagggaaactttggttaatctttttgaaatacattcacaccaaaataagaaagaacttttcataattatcgcaattcttatgtttgcaattggtcacatggtcatagcttgtttatagcttccttcttgtactacctatttcattattacttttattttaaccagatcatcaggtccttttgtctgaaacaatgacctgaaattttgttcctgaagagccttggccattagtagttcttcctgtgttagtccattgtagttttccaataactttgatcacaacacaagggagtactaaggggacccacttgatctcctacaaatggtttcacttatccatctgctgaagttactctttggttagcacctatatgtgacacaaatgtgtttaagctctgtacccaagtagagagaattaatcacataaatcttcttcagtcctccctgtcaccgatgctccaattatgttcaagtactgtcagccaaactattaacttttcccagggcatcagggtagatatgttctttggctatcactcttttcaggagaaatgaagaaccaaatatgctgctcaaagttctgctgatgtcaagggtttggctttaccactaacttctttagggctctgcataaagacaatcaggaaaagtgaataaacaaacagaaataaaagcaatttttttgactgtgtatttgaaactgaacaaaaccacattcattcaaccaatggaacaaggagcaatagctcccttcaaagtatatttatgccaaggatttgtgtagattagtgaagtgactgagtctggctgacttctccaagagttttggaaaagtttttacatcctaagtgccatccagaacatcgcaacagcatgggaagaagtcacacagcagtgcatgatcggcatgtggaagaaagtttcgaagacatatgtgaacacattcaaaagctttaacaaagactctgctgttgatgaatagtaggtaacaagttattagcacttgagaaacagctaaaattgggtattgatgaagaggatattcatgggtttgttggcactgagttttcaagtgatcaaactgtaggaagaaagaagtaaagaagttgaggcagaggaagaagttaaaccggaggaaccaagaaagtgtacagcaaagaaacctgtggaggcctttgctgcattcagcagtggcatacagatgttaaagaaatggcacgtcgattaggagagactcatgagaactgacaggcagagacacagtgctcttgcttgttacagaaagatatgtaataataagaaataagctgtacaatcaatacttgctatctttccaaagaacactgtgaattcagaaaaagaggtttaatggactcacagatccacatagctggggaggcctcacaatcatggtggaagacaaaaagcacatctttcatggtggcagacaagagagaaaatgagagccaagtgaaaggggaaacccttataaaaccatcagatctcaagagacttattcactaccacgagaacagtatgggggaaaccacccccatgattcaattatctcccactgggtccctcccacaacacgtggaaattatgggagctacaattcaagatgaggtttcggtggggacacagagaaaccatatcaaactctagaccatcaataagtgtcaataaccagtttcttctacaggtggaacatccctaatctgaaaatttgaaatctgaaattctctaaaatctgaaaatttttgagcaccaacatgatgtcacaggaagaaaattcaacatacgacctcatgtaaaaatatcacaaaattatttaaaatatcatttaaaattacctttaggctatgtgtgtatacgtgaaatgtaaatgacttttgcattttgacatgggtcccctttccatgatatctcattatgtaatacaaatattccaatattcaaaaaaatctgaaatctgaaacacttcttttcccaagcatttcaggtaagggttactcaacctgtaccagctatttttgaacctcatcagaagaaggagaaattggtgactctgttgctgtagcatctccatcatccggcgattaattttagttcaatgcttcaaacactctttatgtccactgtgctttcagttatgtacataaatgatgaacacccctataaccattctgtttttcacttcagtgccatattcaatgaatcacatcagatattcaacacttaattatgaaataagcatttgattttgcccaaatgtagaccaatataagtggtctgagcacatttaaggtaggctatgttatgctatgacatttagtaggttgggtagatgaaatccatcttaggcttagggtattttaacttatgatgggtttattgaatataatctcatcataagtcaaagagcatctgtagtagagtatgactgaggcttgcccagtttttttcttgtttttaattccatggtactatattgacttcaagagcattgcccttaaccatgctgcaatgcctctaagtgaaagataaggatatctactctgtttcagtaaatgtatgatagtgtgctggctaaggtttttgatgtgtaaaatacagtaaaaattacttacaatgtttggtgataagaaaataaatatctttgagtcacatacagtaggatgttaactccagatactctatgtcctagttacatgatcttgggaaaattaatttctctgattcttaatttttctaactataaaatgtgaaatgttcgtcttggggatgtgttatgcaggttagaggaagtaatgttcacagtgcttctggtatacagtagagacttagtaaatggaaactattattattggcaccattactctcagtactaagataatcactaatttaaacataatatttgtgctatgagtatcctaaaagttgcaatattcatactgaaattttaatatgaagaaattgaggcttagagaaaggaagcagcttttgaaataagttattgccaaattagtgctgttaaagtgattaacagtatttaaaaatcagattccacagacacattgttatgtttcagatcttgacttatacttgcttagttgcttgggaaacttacttacctttttatatttcagtactctcatctgttaaataggagcaataacaaacatatccaccattaccgcttgatgtgagagatcatatgagtaaaatgcatgcaaatttgttatgcactttatgaagcaaaaagaatctaataaatattagctgcaagtgttgtcagaggttttcattttttctttccatataccatactgtgttcctagtagctgaaggaagcatagttttcaaaaggaatgcatccttttataaagcactgattataaaataaaacactaaggaaaaaatgtaaaggcattaaaaagcatgcatatgagatgtgcatatatatatatagcatgtatatttttgtataaattatatatgtattaaatatattacataatactctatgcaggaataaaagtattattattatttaaatgaaaatctgtaaaatgataaggctaggagacttacctcaaaagctcattgggatttccaaacaatgtgagatcattaaagtgcttgcgtagagtaaagtgcaagacaaatgcttctaataataccctggaatgttctcataaggaacaagtcagtatttatatatgcatgaggaaaagcaatagtttattagccatgtaattattaaaggaatcctaaaggcaaaaattagaattgtgttgttattaagaaaaagcctaaggttatatggaaataaccattgctttgcatattattatttttttgaatcagttgatcaaaaaaaaatcatgttttgcccataaaaagaatctgtctcctgaatttatgaatacatatttgtttttttccaaatgttattctgtcctggtaccttcacacagtcaatagaataaacacagaaaattatatatacattcttctttcatttttttgtctcctaccctttgaaagtaaagctgcggaatactaatgagttaataattggctttcttacattcaccttactgaaatgcaaacactgttttttcagtccagtttttgtaggcaattcagtaccaactcacagtttagtcaactgaagaatgtcttaggagtccttctgctttgttattctattagacccaaaagtgttaacctttaacattgaaaatttagggcagaacaatggcaatttattacatgattcaagctctatgttaaggattacttactaggtattaggacaagcattctttacattttagaatactttgttccatttttataaaacatgaaaatgatttaatgttaatttctcaaaaaaaaactcatctcaaaaactctaaaattgagattccaaatttaatcatattttttagtccttagtattcacattatattaggtagagtacttttgaattatccacctaaatactgactatatagaaacgatttttaagcaagtatacatatttccaatatgctttatttggattgagaaaaaaaatcagtgtgttggagtttcactatactccaaagttccaagtggctcagatgtgatattttccacgcaaaaatttcaagtttaataaactatgatatatcagatatataaaagagctgatctgattcatgaactgtgcatttgatacagtagatactgtgatggacaatgcaaggtgaaaaatatctaacaatatgagttacactttaataccgaattccagaaaaattataccaaatgggagtcaaaattttctttttaagtaattgttataactaaacaatgatcatgttaaataatatcgctactctataggaagagagatctaccatatcactgatcattttatttgttgtatcttagttagatcaactttcacaagctaattttatacagctttaagaataatttaaacacacaaaacgtctttggtctttttttcattattatactttaagttctggggtacacgtgcagaacgtgcagttttgttgcacaggtatacacgtgctatggtggtttgctgctcccatcgacccgtcatctacattaggtatttctcctaacggtatcccttccctagcccccgaccccccgacaggccccagtgtgtgatgttcccctccctgtttccatgtgttctcattgttcaactcccacttatgagtgagaacatgcggtgtttggttttattttcttgtgttaatttgctgagaattcattacatgtaaaactgttgaaagttatttgaattgtatttggatgtccaaagcagatagaacttgaagggggacatgttttggcatatgatcaaatctgtacagataatatgtaaatatttccatattacacacagacaaatagggtttttaacttaggagcatgggaaatattgccttcctttctttcattttgccctaagtatgttattagctacatacagagacctgtgtatacatagaaattcatgagaaaaactgaaaataactttgtaatatatgtgtagttcctttgataagaggcatatgaccttggatgatggaaaaaagatttttcttaaggcaacccattttagtggctatgaattctcaatttgaagttaccagattaatatttataactccttgatttgggtacagtcactataagcagaagtggagatttaggaaaaaaacaaaaaaacaaagtgattctttttattgcaaaggaatcttcatttctgtgatctcagaaccgaccagctggcattttttaaatttccaagtgaactcccctatttgaaaaagtctgcagtatgttaataattgacattataaatctgtctattataaatgattttcccagcatagtttatttattgttggtgacattctagatatattctcaatccaaaaatcatgtacagagagagtacagagagaaaatggcaactctaccttttcaaacatccaagatctttctcctctgtacctattaagatgtgtgttaggagaaccctgtgttcaaatttatatatgtatatatgtatatgtatatctgtatctctacatataattagctgaacaaaagtgatagaaccagaacttggtccttactcttagggtcagtgtaaaaatgctaaattcagcaattattaattcttcattaacatgtgccaagtagtttgctaaccactaataccaaaagtaattttcaacccttcaagaggttacgctttatttgtgaagatgacaataaagccaaaatataaaataggcagtaaaataagtatctgcaaggcacagaattgatatagagaaggaatctattaaccatctagtggagggaaggaggaataatggaaagcttggagaagtgatcagtacctgaacaatacctgaacagggttgtgaggaatttgtagcaattttccaagacaaaaagaccaagttggcagggaagatgttcttggcaaatagttgtaaaatagcagggtgtttagggcatctaagtagttcttcatgcctatatagtcatttatttcacttgctggagcatgtgtttagaagtaaattgccaagtcacatccaagaaatatggaattagaatctttgaatttgaggtccaaatatgtacatttttacaagcttgctgagtgaatttatgtgtattttaagattagaagacaactatgaatatgtgagctgtccaagagaaacgtgatgttagctaagaactaacagttcttcactaggagcctgaagtgagattttaggattggaccaccacggtcagttcacatttaagaggaaaattccggacactgtgcattggcctcaggcatcaggggaacaagttgttgggatcctgttttcattcaggggttaaatgatgagaatttggactgcctttattacagtaaaagtggagaaaaaggaccagacattccaggtctttaagtgttgaaagaacaatctaaacacctcttgttgcctcacattctacatagttcttcatttgtctctaattataaataaaagaaggggttaactttcaatgtcaagtattacacaaaccatgattttgccagcctgatgatttaaagggtgcatactgtatattgctaggtaaattcttgtatgtctcgggagaaaatttccaaagatctcttggtttagtttcacctcagtacagctatgtgagtcaagcccattctaagcagtagctttcaagttttttttttaaatattctatctattctgtttttgttcctatttctggctgcaatatcccacttatgttcacttggtcattattgctcagcacagcaactaccatagcctcccttatttcacaagcaatgactgtttcctacttctaaattgctgtcgtattaaacatattctctctgtgttgtcttatgccttatatatatataatataaaacatgtatatattatataatattttatatattatatataaatatatataatcacacacacacacacacacacacacacacacacacacacatatatatgtatatttggcctgggatttgccttcaatctgctacaccagttgaagttcagaaaccatcaatgtcttccaagggtttcagagacatcccctgcatacctattgccaaattaattttaactatcaacacctaaataaacaagtaagattttatagcaagcttagaaaaggatattttacacatactatgtattttacatatatgtattagacaaatattttacatttagaaaaagcataaacccatgaagggaagaaaatcattagtaataaaaaatgcatattatgtacttattgtgagcttataatttttacatagagacagtaaaatgcatgattcgaagagatttacaatctcataaagctaattttctgtgtattttaaaaatgcataacacataggaaacagtggaaagaatacaacacacagaaaaggaaactgcattcaagcccaattcaacagcttaactatcaataaagcattaagcctcattgttgtacttttattatttataaaattgaggaaataatacctatctttatgggttactctgatactaaatatcaaatggaattttacagtcatccaacaagtacatgttaaaccataaactctgtgtcatgcatgatattaggctgtagagacacagtgtagaacacaacaaaccagattccaacttttatagaacttatatatagtactttagagggcaaaaagaagcagaaaaagatgcgtaagtaagttcatagtaaaatacctaagggtgaaacaaccagtgcaaaagccctaaggcaagagaaagtttggcctatttaaggaagagagaaaaggctgttataactgaaacactgcgaaacaagtgaaaaatataaatagaatggctggaaagataagcagggtagttaataactgcttacactgattatagtctctttatgtgccaagcattatattaaacatttttgtatatgaatatatattctaataccaaaacctcaaatgtagggcctatgcttatcctcattttacaagtgaggaaatgttatcttgctctaggcaacatatctgcttgaccaaatgtttgaatttaagcattctcattccacacttgttagccagaagaagggagtggtctgatcaaagaagataaagacagaggaggaagagaggaaaggggaggagaaggaggaggaaaaggaaaaacaggagaaaagaaggaaaaaagaacagctaacatattatattaagaagagcaatctagcatgtgttatttacactgattcatttataattacagatggatatgcatgcatgcatgcaaaaattggaaaatacaagtattttcttacccttgggggaattatcataacacattaaaaaccaagccatagactaatatgtatagaatattacttatttaaaaatcaaataaaacaaatcatatataattatatacttttatatgtataatcatggagaattatacacatcaaattttcatagcattggatatctttaaataatgagtttaagaacttcatattaaagaacaaattaaaaatggagaagtagaagagtagaagggagaatgtaaaatagtgatctttgctgtcatttgtcattgtgtatgtttacaaaatatacactgatcaaaaagtagaaagaagcataaggattctggcatcagactggactatgaaattcttttcaaagttgttggtttaacactgtggaaatcaattatcactttagatggaataatgtggtgtttattttacaagttgtgaattaacaaaacacccttgttttgcagactgtttatgccaaattagagagataatttagtctgttctgaatatcatcttttttttatttcccaatattctcaaatcttttttattcctatacctttggatatccaacgtgaaagtgttccattatgatcacccttgcttgtaccttgtggaaccttttttttttttattattatactttaatttctgggatacatgtgcagaacatgcaaatttgttacataggtatacatgcgccatggtagtttgctgtaccatcaactcatctacattaggtatttctcctaatgctatcccttcccttgcctcccaccccctgacaggccccattgtgtgatgttcccctccctgtgtccatgtattctcatcgttcagctcccacttatgagtgagaacatgtggtgtttggttttctgttcctgtgttagtttcctgagaatgatggtttccagcttcatctatgtccctgcaaaggacatgaactcattcttttttatggccgcatagtattccatggtgtatatgtgccacattttctttatccagtctatcattgatgggcatttgagttggttccaagtgagatggagtctcacttctgttgcccaggctggagtgcagtggcatgatctcagcaacctctcttgcctgggttcaagtgattcttctgcctcatcttcctgaatggctggaattacaggcgtgcaccaccatacccagctaatttttgtattttcagtagagacagggtttcaccacattggccaggctggtcttgaactcctgacctcaagtgatctgctcacctcagcctcccaaagtgctggggttacacctgtgaaccaccgggcctgactatggaacctttggtgaatcatcatatcctagacccctgtcctctcctaagtgacagtaaatcatttgggggttaatatgtttttgtttttttctattctcaacttttaggttcatgggatacatgtacaggtttattacatgggtaaattgcatgtcactgtggtttggtgaacaaataaccttgtcaccaaggtagtgagtgcagtacccaatagatagttatttgacctttgccctcctccctcccccttcaagtaggcccttgtttttattgttcccatctttgtgtccttgtgaactcaatgtttagctcccacttataagtgaaaacatgtggtatttgattttctgtttctgtggttatttgcttaatataatgacctccaactgctttaatgttgttgcaaagaatgttgttttgtttttctttaatggctgcatagtattccatgctgtatatgtatcatcttttctttatccagtgcactggtgttgggcatctgggctgattccatttctttgctgtagtgaatactgctgcaatgaacatatgtgcgcatgtgtctttttggtagaaagatttatgttgctttgtgtgtatacccagtaatgggatttctgggtcaaatgttagttctaagttctttgagaaatcaccaaactgctttccgtagtttttcttttgtgtgaattttcacatctcaatgtcattctggtcagctctaatttggttatttctttacttctgctagctttcaggttggtttgatctttttttcctacttcctcttggtgtaatgctagatagttaatttgagatctttctaacttattgattgatgcatgtagtcctatgaaccttcctcttaacaatgctttagctgtgtcccagagattctggcatattgtatctttgttttccttagtttcaaataattttttttatttctgcctaaattttattgtttattcaaaggtcattcaggagcaagttgtttaatttccatatagttttatggttttaagagatgttcttggtattgatttctatttttgttgcactattgtctgagagggcagttggtataattttgctttttttgaatttgttgagaattgctttatagctgagcatgtggttgatcttagagtacattctgtgttcagatgagaaggatgcattttccattgttattgtgtggagtgttctgtagatgtctgttaggtgcatttggtcaagtgttgactctagaacccaaatatctttgctagttttctacctcagtgatctgtctaatactgtcattggggtattgaagtctcctattatcattgtatgtttatctaagtctcttcagaggtttctaagtacttgttttattaatctagatgctccattgttggctgcttacatacttagaatagtgatatggtttggattcttgtccccacccaaatttcatgttgaattgtaatccccaatattggaggaggggcctggtggaaggtgattggatcatgggagcggatttctcccttgctgttctagtgatagtgagtaagttctcatgagatctggttgtttaaaagtgtgtagtacttaccccttcactctctctcctcctctggccatgtgaggaagtgcctacttccccttccatcatgattgaaagtttcctgggccctcccagccgtgcttcctgtatagcctgtggaaccatgagccaattaaacctcttttctttataaattacccagtttcaggtatttctttatagcagtgcaagaacagactattacagatagttaagtcttcttgctgaattgaatcttttatcattatgtaatgtacttcttcatcttttttttaataattgtaggtttaaagactgttctgtctgtaataagaataggaccctttgcctcttctgtttttcatttccttgatagatatttcttcattcctttacttagagcctatgggtttcattgcatgttagatggttctgttgaagatagcataccattaggtcttgcttctttatccaacttgccattctgtgtttagcccatttacatccaaggtcaatattgatatgtgagggttttatgtcatcacagtgttgttagctgtttattaatgtagagtgaattgtatagttcctttgtagtgtcagtgcagtatgtacttatgtgcattcttgtattagcaggtattcttttctttacatgtttgccactccctgatggaccttttgtaaggcaggtctggtggttacaatttcccttaacatttgtttatttgaaaaagattttattcatccttcacttatgaagcttagtttggctggatatgaaatttttagatggaatttcttttctttaagtatgctgtatataggacctcagtttgttctggcctgtaaagtttctgctgaaatgtccactgttagcctaattgggttccctttttatgttgccttcccctctgtatagcttcctttaatattttttttctttcatgttaacctagaagaatctgatgactatatatcttggcgatagtcatcttatatattctctgtctggggttctctgagtttcctaaattgtcatgtcaccccctctagcaagttggagaaattttcatagacaatattctcaaatatattttccaaattttttgctctccctccaactctttcaggaatgccaatgagtcatagacttggtctctttacataatctcatatttatcaaaagttttgttcattttcttaattattttttctttatttttttcggcctgcattaattagaaggtacagtcttcaagccctggaggttctttcctcagcttggtccattctattattaatgctttattattgtttccaatcatattctgaaattgctgtagtgaactttttatttccagaggttcagtttggttctgtcttaaaatagctgtaccatctttcaaatattggattgttttgctgctttctttggatttggtttcaaccttctcctgtatcttcctgaggttacatgtcatcgagattccaaattctatgtctgtcattttagccatttcaatctgcatgagaaccattgctggggagttagtgcagtcatttagaagtaaaaagacactctgggttttatagtcaccagaattcttgtgctggttctttctcagctgtgggggctaatgttcttttaatctttgaagtttctttcctttggatggggatttgtgcttttatattgtttggtgcccttgagggtttttttttttttcctgtggtacaaattgggtttagtcaattggctttctttctttatgctttcaggggactaaagctaagctcagcactcctgggcttcctgctctaaccctggatggcttggaccaggatgtggctttgttctctggccccttgaggtcaattgcttgatgtgctggaaaggccaagatattccaagtccactggcagtaacactcccacaagtgctgccaacaaaagcactatggtccagtgccaggggactgcaggagagtgcactgcagtgaggcgtgggttaataagtgttccttggtaatgtgataatgtgtttaggcatacattaccctctctatgtacaataatacagaacgggtaaagttatggatacaacaagggtggtcgtaagctgataatcttgagtttgggcaatggataagtgactgcatttcatagtatttactatttttaaatatatgtttgaaatttttccattaaaacttttaaaataagggaagtattgagaggctgagataagctctctcaagttttaaatttctatcatcgcagtgttcagagttgagcttagtataaatgttggagaaaaggtgaaaactatttgggcatcctatcacaattggtattcagataaaatgcatgaaaagaaaaccttcagagatggtagctttatcaaataaaggtttgttttgtatagttgaatgaactctggagtgggcagctctgggtgatgcagtggcttgatgctatcacaaatgtcctagtatcagcttctctctttcaactgtgccatcttcaatgtgtgacttgtttcatggttgcaaaatagttcctgtatctcaaaaccccagaccttaatttcagacattatgaggaaggtggaagcagcaagaaggaaagagtggtggtgtctacataaagaaaacaaaactctctccaaaggacttcctctccaggaaactggaagtttccacttggaaacttagtttcatggaaatgtaaatctaggaaatgaaattttaaattgaaaaaattgccagcccctgaccaaactgaagtaatactagtgaagaagaaaagaagaatgcatattgagtcgcaggtaacataactatagtcaccgttttgggtaaaaaacatcccaaggcaaacatctttccaaggatatgtaaagcacaatcctcccatcatatttcccctgtgagaaacaataacctgaaatttaatctagttttcatgttttacttgaagtccagaattttacccttatctgaaacagagtcctattcttaagatttctgaaatgattttaaagtaatagaggaatgcttgtagattttttattaagaagagagcacattcagtggagtgtgtgaaagcaaaatctgacttgaaaaggaccaaataggagactattgtgaaatccatttgagagacaagtaatgtgacattgaactcaaagagtagaaaactaaagttttggacacagacctgaaatagatccagtaaatattgcatggatgggggaagataagttagaggtggttaataagagagaatccaaaggtgattacaaagtttaaatatgagatgaataaaaaagaaaagctccccatttgtcctttctctaacttttattatctctatggaaggaccagagattatcaagggcattcttctcaaggaaattatatcctctcttatttctgaatgctactcttaaacttagaatgtaaatggtagtagcaaatattgtttattcagtacttattatggatcgagttctatgtaaaacgtgtcagtattatctcatgtagttatcacaacaatctcttaataaaggagatatattttcttttatagatgcagaagctatttagaaaaaaattacacaacagggatttaaactcaaatttgcattgctacatgagacatatctccttactttatcatactgcttcatatacattatatatagccacatatatttgcacttttgcagatgagttattaacataaaatcatctctaaattttaatatgaatgtagaaattacattagaacataggttgctttctggggatcatagaccattattagcacttccccccacaccacctgattctcacactctgtgcaaggacagtagtttcaatccatgacatttgaattttgaaaagtttcagaccctcaaatacaaaatattatctgtatcaacagagaaagaaaagagctggggagaggagagaatggctgctttagttgaaagctatcagagcatgaactccatgctaaagtcaaaggttgtgggttagacaactgtagggctgcataaagtagggcctccagaattgagcaatggattcaaccccaccaagacatcctcttttacttcttgtccttccttgcctctgactttccttggctgtggccttcattttcaaagtcaaaaagaggaatctggatttagcaaagagagaccctattcaaaagaattattgtgaggtgaagaaagggactattaaaatagagaaaaaaactatgaccataatatctgccagcctcacaagggttaggcaaaaagggtatgtcttttctagggagaagtaggtaaggttatatgtggcatgaaagggtggcatgattggctgcatcatagagcagagaaagttttactctgcggcctacctaatctccggagaattgctacactgattcaggctgaagatgggtcaaagtttagagatgtggcagaaagagagaaacttaaccgaaattggttaaaatctattttgttccagttaatcagtggagaaaaaacagtttagccaatcatttatgaggcaacaatgtgaatttggaggatctgtgtctgatcttttcatagataaaaaagggatccatctgtgggtcttatctaagttgtatgggaaagggtgattctttgcagtaagccattctctggaatacaaaagggtgggggagtttctttttattattattattttattattatacttttagggtacatgtgcacaatgtgcaggttagttacatatgtatacatgtgccatgctggtgtgctgcacccattaactcgtcatttagcattaggtatatctcctaatgctatccctcccccctccccctaccccacaacaatccccagagtgtgatgttccccttcctgtgtccatgtgttctcattgttcaattcccacctatgagtgagaacatgcagtgtttggttttttgtccttgcgatagtttactgagaatgatgatttccgatttcatccatgtccctacaaaggacatgaactcatcattttttatggctgtatagtattccatggtgtatatgtgccacattttcttaatccagtctatcattgttggatatttggattggttccaaatctttgctattgtgaatagtgccgcaataaaaatacgtgtgcatgtgtctttgtagcagcatgatttctagtcctttgctatatacccagtaatgggatggctgggtcaaatggtatttctagttctagatccctgaggaatcgccacactgacttccacaatggctgaactagtttacagtcgggtgggggagtttcttaaccttcattttttttttcagggtcactggatttgggtgaagtttaagattgtcatctcccactctagatgttttctctttagagtggttctctccaaacatacactttaaagttcacaatcaaagagcaaaatagatgtatccatctcttctaatttagaaaattctatgcaggggtgacaggatacaatatgccaatatctgtgttcagtgaaaataaggtactctgatgtaaaatgctggtttcacttggttgggtaggtgtaggaggcaccataatctatccattctatgagttttgtttgcccccacccccagagaaatgaaaatacattagtcccctcttatccacagacaatatatcccaagacccccagtggatgcctaagaccatggataatactgaaccctatttatactacatttttcctatacttatataactgtgtgatatggttgactgtgttcccacctaaatctcatcttgaattcccatgtattgagggagggacccagtgggaggtaattgaatcatgagggcaagtctttctggtgctgttctagtgacagtgaataagtctcacaaaatttgatggttttataaagaggagttctctgcacaaattctctctctttgcctgctgccatctatgtaagacatgtcttgctcctccttgccttccaccattattgtgaggcctctccagccatgtggaactgtaagtccattaaacttctgtcttttgtgaatcgcccagtctcaggtatgtctttatcagcagcatgaaaacagactagtacactgggataaagtttaatttataaattaaaggcagtaagagattaacaaccctaataataagattgaacagttataacaatacactgtaataaaagttatgtgaatgtagtctgtctcttaaaataccttatagtactgtactcatccttattcttgtgataaaaaaggaatggagaggtgtaacagattttatcatgctactcagaatggcacacaatttgaaacttatgacttgtttatttctagaattatccatttaataattttggaacacagttgagtgtaggcaactgaaaccatggaaagcaagcacttgaataaaggagaactactgtacagttacaagaagtagcaacataataaattacggacagccaaagacagtaactactataatccaccacattttattcatttatgatcattctgaaattttactttgaatccttcacagctgtagaacaatttacagagacctgaagactcacagtatttgcctcagacagctgagcgtctttgactcttgaatgtctcagcacatctctctactgggagtggtacaggtctttgtatctctcactttagtgcaaagagatgaatgtctgttcaggttgacacgtcttgcctcttttattcagggagccatgtatgatactgacattttaagctactacttggaatgtgtttcaccttgaattcttacgctacacttaaggtttacaattttgctgttattgcagctgtccttttaaagggaaatagattgagtggttattaaagagttgtaacactaaatatgaataacaaatgacatattactttaaatgtgataatcagaggatgtgtaatataagtttggatcaccgtgggtgcttttgtaactaacctttccaaacaggtacaattagattctcaactgattgcaaggcatttctcaataagattttaactcttcattatgcagatgaatcagtaatgagcaaatagggaaacttttaccatatattcctaaaagggatagcaaagaccagaattttgacttttcagaaaatatcgtaaaacctagtcagtttcactttgatttttacagatgagcttaaagtagtaaaaagcaattactacctgaacatagattgatgaatcttctctgtattgctcttaaaaatgaaaaataaaaaatgatataaggggttccaactacaagaaattgtccccactgctttctttatttcttccctagcaatatcaaaggaataagttaaatttctcttcttaacctcttaagaacttattactttctaatcatctactctataaacctaacctgggaagttacaaggtaatgtagttttggtttcttaaaactatgtggactgttgaagaaagaacttagatacttgaaaaagctatctttacattcagaattttccagttgttaactgtgtgaatttgatcatatttcttggagtttcatttcttttttttttttaacttttctttctttttttttttgagacatcatagggataatactttgttagtggattttgttaagaaatttaaaatatgagaagagacttgcatgtaacacacaataacatttaaaattcaatcttcagctttgaacttgtcctacaagatacccttttctgataactttgaattgatcccttaactgctactgcatttctactacatctctcttaatttgctatacttaccttcagagaagactgaatgctgatagctgcctttcccttatacgttagtgcatttcctaaagttcacatttgctgcagaccatactgctgtcactaaggaaatatccctggccagggtgggctaaaaattaaaccaccacccaatgccattaaagctaatgcatctggagtaacatgtaattgttgggttttggagcattacttcagtatctgacttaaggaaaggtgatatttttggaatacacctatgtaaaatggtctctcctaattttatatcttcacaaaatcatttatttcaggtaaaaaatagtaaattgacaaaaagccctacatatgaaatattcagttaatatgatcagtattttgacttttactagtcattgatatttttgatgaagatttgtaaaatactctacttcagacattctgattcagcggatcgggtgggatggcatatgtgtgtttttaaagttatacagctgattctgttacgtggcaaagtttaaaaacctgtgatttacattttcaacataaacttgaggacatatcatatgataacttttttaaaaatttttttattaaaaaattatttatttttgagacattatttatttatttattagttatttattatttatttatttatttttgagacatagtcttgctctgtcacccaggctggagtgcagtggcgtgatctcagctcactgcaagctctgcctcccgggttcatgccattctcctgcctcagcctcccgagtagttgggactacaggcacccgccaccacgcccatctaattttttgtgtttttaatagagacagagtttcaccgtgttagccaggatggtctcgatctcctgacctcgtgattcgcccgcctcagcctcccaaagtgctgggattataggcatgagccaccatgctcagccatatgctaacttttaaagttcctgtatgaggaattagaaagtcaagatgcattgacagccatgcttgttcctctggctgttagccactcaacatttctcttcaattaattataaagtgttcatgtcagagaagcagaaatataatcctaatgctttctcattttgagttttcattttaggatcagatttataatttaattctgatcacatgccagttattgaactaaacattttacctaggtgcacttgtggatattattttcctcatttgaaattgaagacaggacagttgaaatcaagcaagcaagcaagcaagcaagcaaatcttaacctggcaaagacagaattaaatggctatggcaaatttattagaggaccaacacataaggataaagaatagtaagatctattaaggtataatatatatttagtcataagggtatttagtaattatgttctgaggttaaaaataagtataaggatatttataaatctccagaatgtagtctccagaatatgtatatgtacatctctctcttctctctaatgtatgcctgtatgtgtgtatgatgtatgtatttcagagactctacactccagagaattatcaatatatgtttttcctgaacaaaactatcttagagaaggcttttgtttaacaactcctcttgtagctctcatcatagtgttgagctatgtaagaaatgaggagcatatccaacaactataattattttcagcattactcttttttatagagtaaaagacaaacatttgtgatttttctgtgatcatctgagatatcacgaagatagtattaggtataaaaggcacactaaattgtatttttctaaatttaggaattaattttgagaagaaaatgtcaagagttatcagagggatctattcacttgattagaatattaatatcagtatttgagaacaataaaaggtcatggcttgaatacaagttaatcaagggaaaatacaatattttaaataaacagaaagtattaacccaatttaatggtatcttagctccttcagaattgattgatccagggcataataaattcagcacaacacacaggaaacaactctggtgagccattcatgtcagaaggttacatggaaggaaaataattattatatattgttaaaatcagactaagtaattcaagattaatttattatttcaatagaaatagtctaattttgcgctgttaatatttggcagtaaaagattcacaagcttctttatgctttcagtattaactgaccaaccatgaaaactaacctactcttgggaaaattttaacatattctactacattttttgagattccttattttttgatattataatctaagataattaaattctcgtttccaaaaactatgacttcctgtatttgcttaggttttatcatttactattctatttcacatctgaaaataactgatacttcactttaggataaaactgctctcattttcccttaataaacaaaagtgcattatctttcttttcatacacaattcttcttatctgccagtactgattctagtatattttaaattacccatattaacataatttttagtatttaacttctacatcatggagtgaaatggggtttagatttgtctaacactacagctatgctaatgaatacatatagtatgatatctgacggccatacacatttttttttttaccataccttaaaaaggcaaacattaagacattttcaaacacggccctaagttattgctactctataacatgtaaaaataagaatcaaaggaatgtatgtcaaaattacgctggtaaccaatattttaatattctactttagttaaaaataatccaagtatccaattaatttgggtttaatataagttcaaaactatattccattactataaaaatgtttcttaaaattataatctaatttgattgaaaacatagttttaaatttattttacttatatgtgaaagtaatgttagctcaatagtaaaacagtatgaaaagtttaggaatttcatattaactcgtcttttagtgagaaaaatacacattatattttaaaataaaatttataattatcttttgctgttctcttctaaaatcaaggaaaaaggatacagtttctttaaaacccaggttatcaaactagtctaatttgtcaaaagcttcactttgatcacgtgaccttgatttattttagaaaaaatgcttatcagcattttgcataagaaaacagttttgtgtatatatgcatttttattgtttgtttaaaatgaaaggctaggacattacaatattagtttagttcctttactatctgggtttagcctacaaaaccatattatttacttatatttatagcaacttctaacaacttttgactatgactttaagaggagaaggggacttgattaatgtgtggatccttttagaaaactgtatagttaataacctttagaagtaattgatagatattgatgtacggatagatctatagagatattttatatcagttatataaatctagatagaaaatttcctttgtagttattttgactgaaagacaccactcatgagtacttaaataaacctcataaagctaataagggaaaagttgtaattttagtgatttatttttatttgtataaatttatgtgacaacagtgtaattttgctacatgaacacattgggtagtggtgaagtcagggcttttagtgtatccgtcaccagaataacacacacttgtatacattaattaatttcccatggtgaaccccaatcccattcttcacccttctgagtctccattttcaatcattccacactttacgtccatgtgtacacattatttagctcccatttttaagtgaaaacatgtgatatttgtctttctgtgttttagttgtttcacttaagattatggcctgtagttccttccatgttgctgcaaagaaatcatttccttcctttttatggctgaatagtattccattatgcatatatccttttaaaatactctgactttttaaatacaaactatttattatatggcttagcttcttgaaatatagaacctcccaaatatataataatgacaagtatgaatggcagtttgcgttttatgaaagaagtctagatatatgaaaccagcagctagtactgcagctctctgaagacctcattaactcaccttcctcccagatcaacattattccatggccacggtctaatccttaatctcatggtctataatggctgcttaaactggaatcattaaagtagagtcccaagaaagagaatggagagaagaagaaaagggcaagcccctgttcccccaaagatgctttctggaagttttatatagcactataaatacatttaagtagttagaactcagtcctaacatcacaaataactgagcagagaatggaaggttttacagtcttttagacttacaaaaaaaatcaagatttttactgctaacaagaaaggaaaaaaaatcagtgtacaggaaggagcagtattttaaaaagaaagaaagaaaagaaaggaaggaaggaagggaaaggaagaaagaaaggaagaatgaacatatttgggaataactagtagcctctactatgtgaaattaatagatctaagtttaatataactgtatgtaaattacttaattatacatcataagtacaaatgtgattcaaaaaggcaaattatctgaaatattttaagaatataaaatagtaaatattgatagatttcaaatatccatactctaatatgattctcttaaatatgtatatgcttagttctaaatcttaccaggatgaaaatgagcacctgttaaggaaagtcttgggagcatagtgcttctgattacctctctgggcaatgcttccagtttctgtcttagcttaatggagttgttaatgactagcagggccctgcccaagctactgactgaattgttctctgtgacgctggtgggactcactgattcccatttatggtaactatatcaatgtggcttcacagtctttattgcttagattcaaattactaacacctggttagtctgactgctcatggaagataaaagtcagcaaactccatcctcaacgttacatcattgactagatttttaaattgatgccactgaaaagttacttaaacatcttttcataaaactgttagagatcaacacctctcatggctttgtctttgccccaacttctaatattatttcactacaaaagagctttaaagaatttattcaagttctttgttgccaggctatgcctcgagaatttattttgccagatttatggataaaccagaagtcttgtttcagaactcaatgtgaattgcacacacgcatatggatgctccctgctgaaggctagacttttgaaaaataaatggctaaaaactcgtgatctgtataaaggtaaaaagcaactccatctgtcctgcttagactaggctgaaattctccagcttgtgtcttctcatgaatatatcacagttgaagtctagcaactggctaatatctagcttcatgaaaaacaaaaatagtagcctgttgtttttggctttcagggagcagagatgaaggtccttccagaaggagacaaatttgaaatgtagcaagcattatgcaattatactttgctcttattttgtatcctaaatattaaatataagtaactccattcttttcttagtatccaactttggccttactttgatatgctgcttacaaaaggaaaagaggctcaattgcttggctgaggagctagatccccatatgacgtattttggaacacttttctagaaacacatttttagttaaaggggtcctttgattttctagggtaaaatgaaagtttctggtatatagaaagtcggagatttttttttattgctcaaaacttttgacatagtgtcagcactattagcagggattacttctgcttgattccccaaattggtattctgaacaaaatttatgagaggaaaagaagaaaataagtgttctcatattgtggaatttcacaatccctgcctatttcagccttatgtagttgcttatatattgttaattatgagtgtcttcacacaaagagttctcactcttcctgtagccttaacttttagatctaagatgtttgacttggaagattattatttatgggcattcttctttatgttcaccaaatattatttgagtggtcacattcagctgtgcagtgcttgatgggatgttttaaaaggctctatacacatgttcattatgaatacagttaacactatcaaacaaggcttcttgtaactgttgaagtaaattggtgtacttttttccctttgtttttaatttttttccaactccttgcattgtcgttcgatttctgtttatgagactattatacttttttattgattttaaattcatcccaagattaaaaataaccctctcctccttctctgatgagcggggatcgattttatttcacacttcttatctcaattcattaatgtggcttgtatctgatttatagctactattcactcctatgctctatgtcttcttgtctgctactacttgtgaattttccatttgaggtattctagcattcttttgaagattcttacaattaatgtgaacagtattttcttttaagtatttgaagaggttgtagctggtgcctctacccaggcaagtgaaaacacgctaactggggaattccattatgaatgtattaaaggttgaacagcattattaggtgtttgagtgagtcccttgagtgcatgaaggggaaaaaaagccatgtccttgctttatgctcaaaaaaaggatattcagaacttcacacaggatgtcaagcagccaaattgcaaaaatgccacttattatgctctgttcacattatagaggtgtatgtatattttttctcttcacaaagaatcatcactgtctttctgttcaattcagtgggctggcatcactcgttgggttccattgcaacagcaaaattgctgttttggattttacagacaatttttcctccttaaagtggcaaaacacatttctgaagattatgaaggacataaaaaattagttttggacagtgggaaaaatcatctataacctaacatagcttgtaaggaatagcataggtattaaaaatgtgtcaaactcaagtttggatacaggctctgctaattactaagtgcatcactgaaatctgaacatcatcacccttatttgtcaaaacattcaaaatatctttttgatagggtgaatgttaggatcaaatagaaaaatattttaaagcaattgaaagaaaacaaaaactaaaataatgaatatactcttctctacatttttggaactaaaagggtacctttcaaaagaaaaagtggaagaaataaaggagaaaaaaaatggagtggacaaagtataggattgatttctttaggttttctgtttcttttatttcatttgtttttatcacctgcgatcctatcaccttctgttggtaaagacatcacaattttctcgcagacctattttttctccattacactatgacctcactgagaatctcaatttaataaaaaaagaaattacaagagaatgagaagtattaggagctgacattatctaatggaagattcctaaaatgaaaatctaccatttctgcaaatggaaagcctcaactgaaatttaaaatttggtcctctcccttcataaaataaataaaataaataaagcaattttgctcaaaatcccacaccaatataacttgttgtttgctcataacataattgctgagcattaaacacataccatgttgtaattccaaattcacttgactccagaaagaccctgcaaatatgacccctctaatgttgctgttgtccatatccctatgttcatgttgactgtaactcagtcaagaataatttttaattataatttccatattattttgtttcattttagactttctgtcacatatagaattttagaagaaggatggcagaaacagaatcatttgtgatcattacattgtttctatactgtttgactactgttatcttttattagtctgcctgactctctactttgaatctctgccatgtttgtttctgatagctggtagatatatacctgcttatcattgtttagattctggtacctgcctagaaattaatattttactccttgcatagtccccctgcagtcagtatgcaagctctattctctggatcacttcctacatttctgattctgggctacaaatggctactttgttctattcactacctcgccactgctatatgtgcttgcttctaatcttgatgtgtgaggggtgatatatgggcataggcaaatctgaagtcaattgattgtgagttaaagaagaattttggagatctaaatctccttacaagtgtttcagttaatctttcccttttttatttttcaaatatcccaacctcattcccattgcctgctaaggtacctggtaccttcttttcctgaacaccttctgagaaattgaggtgcaagtagcattgcttattattgacacaattgacatccattttcacaaggacaccagtggggagcatctaaataaatacactctctacttacctactcataataaagtatcatttttattgaaaattatgctgattttctgggcattcttttaatttaattgggatatcaatctctatcacttgaatctgcttttatactttttccagaatataatatctgttcatatgatgttcttgtcattgcactcacccttttcagtattattttgttactgaagagtgtatttcaactttgaatgagactattctcacaatcgatattttaatttcaaaactgcatagatttccaaccaaaaattccaaacatttttaaataacttttttcttaataggtattagaagttcaaatgatattcaattgttatctttttttaactcaaaaatgggtgatctaattgccaaaaatcagttagttctcagcgagctatgctatgaaaactgtttttcctaggaaaacactttcagcagtacagtggtatttctgatcccttatgagatttgaagtcaggtcctaaataggatttttcattgttcctctctgttaacacttacctctgtattaacattgaattttacttgatggagctctgaatatatgcaatacagactgacttgctttggacattgaaatcttatgtactctgtggaagtaccattactcactgaccaaagcttgtataaaaattaaaaactattgaaaaataaaaataaaagagaaataggataatatatattttataacatcttaaaatcgtgtttttaatgtttgttcattgtagaaatatcaaaatcaagaattacaagataaaatgatgtgcagtcccatcacccagaaattaccaatgttaacatataaaagtctatctttccagacaaaggaagcattcaatacatggaagctattagagtagcctctagattagtgagaccccaattaaaatgtagctattaatataatagcaagttgccatttttgatgcaaaacatgtatgaaatcataataatattgtgaatgtttatttgcatttatcaacatattttaaacatttttgttaattagaatttgacaagagtatgtacacaaacacacacacacacatatatttatcagcatttgttatgtaagaaatatggttaacccagccaaatacttattattgattattaaatttcttataatttaatatgaagcaatttccagtagcgccagaccgatttaaaatgcagtaagcatatatatattagagaaaattttgtaatataagaatttttgtgaaacaaaaatatttcatcaaaaatgtatttaggctaatataaatttggctcaagcatgaactatatgactgtgctattcatatagaagaaaatcaagtattgagtaagtgggtgagaattttaaaaattcttttcaattcagaaattaggtgttactaaaatcttcgcttaatatcaaattatagaatcacagattattagagttggaaaggacatagacatctctttgcaaggaatgttagtctccaaacatcagcaatacgggctctcatacttctatactaatgtttatactgtcgatagaaaaaaatgaaaatcactgtcttatatctgctgttttctagaaatacgtgttttatcatacttagcaaatacttttaatgtttctatgaaaaaaggaacacttgtcttcagaataataatatttattccattttaatttgattttctactctatgaagttgacaatcacttgccccagaaagctttaagaaagaaatttgtagctactaataattcaaaattccagtccttggctttgatcttctctatttaggtttaataatggggataaatacaactaagagcatccactttcagcatgtattcatataagttttagactctgataaggttgatagttgtcaaatgtgacacattttatcttgggacaagtcctctttctcctctatatattttgaagtagaatggtttgcattttaagtagcaaataacactttttttcagagtctttgatttagataagattatgagtctattgcagtaatgtgctaaagtcccacagtctcacaaggccacttacggttttgctgaggcccaccagtgctagagaatctctttggcagtgatatgctacttaacctccattgagtttttaggtgtgcacaagcaagtctcttaactactaaatgtctcctactgatccaattacttcttcttacttgacccactggcatagattctaaaagcagctcattacacaaataagtatttaattatgtaattattttcaagtttgctgttattcataattatcagtatcagctattacagtttgctgatggctggccaagatggcatcacttgatcgtgattctaccaactagctagcaaaaccactgtactttacaaatggtgtgtagacttgttcatctagctcatagaactcattataatagtaatttttattttcaactctagtgagtcataattatatttcgaggcaaataatttaacactcatctaaatcaaatcactaaaaacagactcaagagttttttctggagatgggtacttattctgagagttgtggtagctgaggcggtgaagtgaggtagtgaatggtggatagtaaatgcaatgtgacatcatttacactcacagttgtaagaaaatgcttactatatgtttatataatttaacagtattattttttcaaatccctcatttttttctgtgagaagtgagatatttttgttcagaaacgggtaagtagagggaatttttagagaaggaactgcaaagttatatggaaaaaagcataagtagcgggagggcaaataaatggagccagtaatttcaccaaaaaacatagttttgattctttttaacattcttatttttttctatgaggatgaggaaaagggatcttttactttttaatgtaaagataaaagttattataattgagataattaattttggattacaattcaaaacaaacccaggcagctatatgatgatatgatgtatcacacataaattagataattagtaaagcatagtattaaagatattatattaaattacgtattcaatatgttacacacacacatttaagttttaagcataaatactattcatttgctggaagttactctccaaaccagacatgcagcatcactaaaggactaataaaatcaggaggtacctctgtaaatagctttagggaagaatttaattaggaccattcaaactagtaaattcactaaattcaaaaggaatgtcagaaatttcatgatccaaaaaacattttggagaactatattaatatagaaggcatttctcttggtctgaaattttaaataaaaaatctatgtacaatttcttttcaaaacgtattaccatattaagattaaaatgtttctatgtctccatttatgttgctggcacaatcttccttctttctttcttttttttttttttcttttccctagcttatcctcaggtagagcatattgtgctaattttgtgaggctagattccagtatgacacacataataactctacatttgtattgcatctgttatttctattttgcctctagacttgactgtgatcccaagcaacacaatatgttaccatttaattttataacatgccatttgcacagattttttttaccgcagctgtattaatggtactgctagagtaagtctgttgaagacatacgcgaaaaaggaaaatgaggccaccaatgacaatttaattcaccaattatttttaaattgcttgttaagtttgctcccagatggaaagagatggaataatgtaaagagagtgcaaagcaaaacaccacttatactaatgacttaatgtactctcctgaaattaggcaaatgcttatttttatgttaattatgagtattgtgtcactttcttttgaagtagaaatccttttcttgtaaagatttggcttaaaggaatgagatagagcattcagtttcaaacttggcaatacatagtaacttttttatcttgaaaaataaaatatgaataacattgaattttggtgcaactggctatcattacaatttggggcatttagcttttatagtttgctaggtaactggtttcaaagtctttttccttaggacctgttttagtaaactttttctctgtaaacctgttacttttaaaatgtcttatttcattttttaaaaaatatccaaatctgcatatgcctgccgattggaatttctcatcaaaatgcgccaactagcagcctcactctaagcaaagaagcaggatatttgtgctagtcagtgtagctttgagtgagcagtggagtgtcattagtaaatgatcaaaatctgtaagcttttgaaaaacactgaaaatattattagggcgactagatatttgggccctttgaacttgaccaccataaaatctcacatgacaataaatatataaacatttaaaaatataaattttgatacctgaaattagtgttagattttaaagactatagaatgattgcgtaacagtaggtggtctctgccaagtaagtatttcattttaaaaagaaaaattatttgtttatttggctgagtgcagtagctcatgcctgtaatcccagcactttgggaggacaaggtgggcagatctcttgagctcaggagtttgagaacagcctgtctctactaaaatatattaatacataaattagttgaacgtgttggcacacgcctgtaatcccagctactggggaggctcaggcgtgagaattgttgaacccagaagtcgaaggctgcagtgagccaagattgcatccctgcacatcagcctgggtgatagagtgagactctgtctcaagaagaaaaaataaaagttaaaaaatatattcgttcattcattcaacacacatgctttataagaatgtagtacacaacaggccctatgccatactctgtgtgcaaaacacatactcactgatctcaaagaatttactgtttggtgatggacgcagatgcgtagagatgcaattctagcacatcatgatgagtgttgttataggaacagtaataaaaataaaaagaacactaatagggatgcccaaccaagaaataaaggatccaggagggcttcctgagcaatggcttatcatatgaggactaaaggatatgtaggaattggccaaagaggagtatgtgtgaggaaaggaaaagggagaacattttcagaaaaatggagcagaaagtactctgagaaaatttcagatttttgcatgaactattttgtagtatttaagtcatgagttctgagagataaggctggagtaagttacagctgaaccatgaagagcctcaccttattgtcagcttaatgagaaagatgtaaataaattatcagggaggtaacatgatcctatttatggattaggaggctccctcagtagcactaaggagaatggattaaacaagataggctggaggcaaagaaggaagttggaacagaaattaaggaaagagaaatggtgtctgaaataaattaatgaaaatttgatactggaaagaagaatgcaaatctaatatatctttagaaattgatgacaaattgaagataggagagaagagtgatgatggaatcaggattacaggtttgaccccatgatgggcctgtatgcttgttcattcatagatgaccacagaataacagatgaccacaaaaagaacctggagtgtagaaaaggtttctagaagtctgaaggtaaatagtgtaaagagttgaaacataaccacaaaattgaaagtacatgttatgaacaaacaattctgtctttcctccaaatttctgatcacccttttaaaaaaactcagctttcaaaacttctttggattataacctaaaagaaacaccttttatataatgatccagtatacatacatgcatatatgcaactgaaatgaaaattttatcaaataatttaccttattacctgtaatgtaccctaacattttcccatttcactggggaaaaaaagttaccacctgctaaattgatcacagctgttcatctgaaagaaaatgattatgttatcttaatccattagataatctgttgatttcaaaatacagagataaagaactctagacaacagtcagtcatggtactttctatttatctgtgtcctttctacagcagcaacatcaggcagcatgaggggccttgagtgtatgccttgtggattcagactccctatatttgcaatctggttatgctatgtgtgtaatcttcagtcaggcacttaagtatttcatttattaagtagagaaaatagccttatcatagtgttataaaaagaccatgtaacttattatgaatgaaagtgttaaagcttgtagcataggtcctggaagtgccctataaatgtaatcactatgcatatatatatatatatgtaatcactatgcatatatatatgcatatatgtatatatatcatatgcatagtgattacatccaatatgcatagtgattacatttatagggcacttccaggacctatgctacaagctttaacactttcattatatatatataatgggttaaggcctggccttgggggaatttgttgacagtttatgtaaaaatggatcaatataagtttattaccacttttgaaataattcatatggcattcctgcacaatcatcatcatcatctttacctgcagctatgtccataaatatcacagataccagttttctaatagaaatctcttgccctcagaggcaatgcaaaaatgataataaatgacactgatttttatttctgctaattatgttttgcttatctgaataaatatgtataaataagatatatttcagaaaaaaatataatatgattataattgctgtactgtttaaaggtctgtataggtccagcatgattaaatgcaagtgaattaagatttgggtgccaaacactttattagttgctttacatgcataatctgtaatatgtatagggatcttgcaagtaagaattgtaatcggaattttataaatagtgatattaaggcttaaaaatgttacataaattttccaaacatatacaactcaaacaatgatttagttagaaggtaaattaagatggctggtcatgttcttaaataaagttttaagtttcaagtaaaataaacgttgaatattataattattttttgcaacttccatacagtgcaataatcactggcattagtcgttactgaaatgttaaataagtcaaatcaatagttcacagccacttaatcgtggcaatgcgacttgaacctgcatgatgaaacttaattacacttatataaaatacttggaaaaatgtatgataaaacattttgttctttgttgtaagtagcccaattaaaagtctaacattaaaaaaaagtttaggagaataagttgtagattatataaaattgtgaaaacatatcagaataggctaaatttcatactgttttccatgtaaaagaggttggacgtatttatataatctgtagaacttagtttttattccttttaagaaattgttttatgtaacatttgtattgatataatctgtaaaaattaattttcactctgttcaaagaatttgtttcattgaaaaacctcgaaacattttatcaaaatcagtgttgattgtttactgtattctatttagcaaaatatgccaggatttcagtcatgtgacatttgtagcttcagagaggtttatgttttgtttagtgttttgttaataaattatgtaattcaaaggcatataaaaaattcctatggattatacttcgtccattaactaactcagtcatagactgttcttccttactacacacttagatctctgtctatttatcagcagcctgtcctgagaacctgctgtgtttaaccctatccttagggagtactaccttagttgattacatttaaaaaggatcgtcatcatatgaactactgagataaatactttcatagaggtgacttaatgacctggaagaagcttatttacaggctttagcataggatttgacataacaaacccaattcctgttttgatcctgaaattcctacctggataactgaacaaatcacttaatatttttggatccaatttttcctcatctgtaaaacaaggattgatttgagactatttttttttctttgtattgaagaatctaagctttggtatcattctaaacttaatttttattgctaaaatttcttctagttgagaaattaggatactattgtgatggattcagcagacatcttttgaccataatttacaagcaagaaaaatagcatattcattattgcaaatttttttgcaattcgaatatagaaatgaaagttttatttatttgcatttctgtttacactaaatttactttatcaggaatcactctttagattttaattgtttaaaagatgtatatgtaatgtgttcttttgcaagcttgcaaattattgtttctaattatttgattaaagtggcttcacaattatgtttatagagaatttaaaaataacaaaatatataatactttagaaaatctaatggaatttggaataatcaccttcatgtatatagaaaaattattagaattcctatgtttataaattttctttaaatttattggcacatttttataatatgctgagggttactcatgtatttcttgtttacttgaagataataaaataataacctaatgacaaaatattttagaatacccttttaatggattgttatattatttttatagtgtcttgaaaattgaactcataataaactgaagacagcatggtattttaatattgaatgtgcaagcaaataattaaagtacttattttaccaaccacattagtgagaatggaagtgttaacaataaaatagaaggaaaactgtgaagttaagtaggaaaatcttgcatacagtcatagcgtgctcagaaacagagagacagacgagaaaattcattctcatctcaaacaaaatgaccattaaattttttctctccaactctttcttcattgcttaccctagtatttctcagtcctaaaagtttctagaacatttatcaaggacaatatccagtatctttggatatgttttagttggcaataacttgctcaatatgcttccaaatatccccttaaaaaagatattcttgcttatgttttactttcttagaacttcttcctcaaaaggtatttttgactcgtatctggcaaaatctcaaagagtatgtgtttgcattcactttaagctagtgttgtctcttcttaccattttccggctcttaatgactcctgtggccattatctaaaactgatctataaaaattctgtattaaaaagaaagccacctcactgaggtctatctgtcacctgcatttaggtgaaacaaagtacacaattatgtagaagtctgtgtttcctcacatttttaaatcaacaattttttactctaaaaatggtgaagaatggttatagaagagtttattttaaaaaataactcttttcaactgtgaagataatttacatgctcctctgtatataggatatattttaccatctggtcattcctctcttcccatgcctctacctatgtgcaactctgtctgcataaacacctgtccactcctttccaggctcgctcccattttctaaaactgtggtcagttattatttccttctgaaatcttcttttgaccccacgtccttcctgacgacaatccactgtgcctgttgctatcactgccatgcgtttttattttaattttaatttttctggatttgtgtctcttatatgttccttgcagatcatgacgttcttgagggttccaatgcttagcacattggctgatacatagtagataacaatcattatttattaaaggaatttctgttgtttcatacgtgggttttgaaaaaaacacacatacagtggcttttggctagtgcctgaggatgtatgaattgaagaaacatgtgacatatgtcatcttggcaacttttcttcacactcagttaaaactgcaactattaaaagcaacaaaaattaggtgaaatttcttaataaacctaattcccactgactaatttgtctagttttcccatcaaattgatttttttttttttttgcataacatttggaacagcaaccaaataccatttttatgtttagttctaagtcatgcagtttaggggaaacatgttaaaacaacattttttgcagcagaacaatatgtagaatctgcctgaaaatatatttaagatttgttttcaaaaaggacacactttatttttgtaacataaatataagaacacactcttttagaccttattcatagcctactaagttgcccactttcctttccccctatttctttatatttggaaggtgacccacatgattgcactggcttaatgctaaaaagtaatttgtgctctcataaatcagagtgtcatataaaaattatgttttatattctgtgctatgactgagcattactcaaaatatgtataattacttttttgaaaaaaagatgtttaaaaatatacagctctaattttaaaagtattttgcagtatttaccaaaacattctttttaacttataaaattaagtattttaaagtttctgacctagggaaatattgttacacttgattcattgtttgaaggattaattttaaatataacactttgctcttttatcatacctcatgtttttgtaatgaatatgcaggaaactatattctatagtaaaaaaaaaatcaaaaaatataaataaaatttaaaatagaagattctgcaataagtcagctattttttaaatgcctactatatgccaatagtataaaatcttctattaaataatttcagaaaattaaacaaaagtagatctaaatagctgctcacataaaacagaaactaatataagacattgtatgagtaattgctaaatgattgcatggcaatagtttctacagtagttaaaataaatacatgtttatttaggtttggatagcctgagaagcgtttttagaaaaaatacagctgactgttaaaaaacacaagtttgggctttgtgcatccacttatatgtggattttcttctgcttctaccaccactgagacagcaagaccaacccctgttcttcttcctcctccttggcatacttaaagaggatgaggatgaagttctttatgatgatccacttccacttaatacacaataaatatgttttcttttccttgtgattttcttaataacattttttctagcttgctttgttgtaaaactatattgtacaatacatgtaacatacagaatgattatatgttaattgaatatattatcagtaagacttctagttaagggaaggatattagttaatttttggagtagccaaaaatcacgtatggtttttcaattgtgtggggtgttgatgcccttaacccattcatttttcaagggtctttgtacctgatcagtgaataaagagatgaaggggcgccttcaaaatggctgatggaaagcatccggtactcacctccttcacaaaataaggagtagataatgacactttgaatagatcacctaagaaaaaatgctggaattcaacagagatgtgacagaaaacacctaaggcaagaaaggagaccaaagcgaggcagcccgcttggctacaattggcaaggagtatgcagaggctccttagtctggagaaagagtaagcaaatgctccccagtggtccacatttccacagcagattcctgaaatcttagccatggtagagtccttcaacccatatgggcactgaaactatcataggaagctgcatggggatggcaagagcattgctctgggaagggagttaagaatgggtgccatacccacactgaagcctaagcagccacagcagagtgctattttgagagcccagtccccaccagtttgcatcctgccctagagtccaacttctgcctctccagattcctagaacgccactgacctcccccacctgcagccaggcaccactggtggctactgttgctaggaccaaagcatgaggcactgacagtgacccagcaacctttagcagcagggtcgccacacgcttaaaagcaccccgaagaaaggctgcccggtttatagctgtcacctagggctgaaacttgcattcctcagctatctgctcgtgtgtactaaaactgaaagtaacctctgcttccccaccccaaccccacagcagtgctgcaagtgcagcttctgccaccttcatctaaacattctgttgggggtttggggatcactccacccctgtataccacagccagtgactgtaaacactaccggggggctgagggaaggcccatgtgatgtagctctaccctcctgagtgcacaagcacacccttcaagggcctgtgtatcatcctgccccacctacactattagcagctgagcactatttccaggggcttgaaaatgagtccactcaacctatgctaccaccacagctagtacccgcatgtatgcaccaactgcaagcctagagactggccattgcagcctgtcacagccaccaccaacaccagtacagatggcttgagagtcagaggattgaccctccactactattaccaccaaacccactgccttggagccagaggacccactcacccacccagttcatcactgtcactgccaacacccaagcaagccacacagggacaacagaattgcatagacctgcttacatagacctgctgacaccagtgctagtgtatgcagccctgaaaattagggaaagacataattgacctgcactgccgccaatgggggccaaagactggcccacctgatggccctgtccccagcaagacttcaccaccacctgcatgtatgtgtggtgaattatatgtgactaagccctcacatataaaaataaagttgaatgtaaattgattaaattttgtagttcaatgatatagactggcttaatagttaaaaaaaggcagggatgggggcagcatgctggctcatgcctgtaatccctgcactttgggaggctgaggcgggcagattacttgaggtcaggagttcaaaaccagcctggccaacatagtaaaatctggtctcaatcaaaaatacaaaaattagccggatgtggtggtgcgtgcctgtagtcccagctactcaggaggcagaggtgggagaaaagcttgaaccttggaggtggaatttgcagtgagcagagatcgtgccactgcagtccaaactgggcaacagagcaagaatctaaaacaaacaaacaaaaagacatgaattttaaaaattacaaagtctcaaccatatgctgcctacaaggaacacatctcacctgtaaagaaacatatagattgaatgtaaagggatggaaaaagatattccatgcaaatggaagcaaaaaaatgagcaggagtagctacagttatatcaaataaagttgaattttaatcaaaaacagcagagacaaggttattatacaattataaaggaataaattcagcaaaagaatataacaactgtaaatatatgcacagcaaacactggagcacccagacatataaaacaaatattattagatcaataaggacaaatagactgcaataatgtaatatttgggggacttcagtaccccattgtcagcattggacagatcatcttgacaaaaacatcaaaaaagaaacattgcctttaaattgcactttaaacccaataaacataaaatacttttacctaacatttcatccaacaggagtagaacacacattcttctgatcagcacatagaactttctcaagaatagaccatattgtaggacataaaacaagtctcaatttttttaataatcaaaatataccaagtatcttctcagaacacagtggaataaaaaataacaagaactttgaaaactatattaatatttggaaattaaacaacatgcttctaaatgaccattgggtcaagaatataattaagagaggaatcaaaaaatgtattgaaacaaatgaaaattgaaacataacataccaaaaactatggtattcagaaaaaaaacaatactaagaggaaagtttttagcaataaacgcctacattaaaaagtagaaagatttcaaataaacaatctaatgatacacctcaataaattttaaaagcaagaacacaccaaaccaaaattagcaaaaggaaagaaataataaaaaatcaaagtggaactaaacaaaatacaggctgaaaataataatacaaagggtcaacaaaacaaaaagttgttttccaaaaaaagataaaatttataaactgctcactagactaatgaagataaaaagaaagaggacccaaataaatcagaaaaatggagacattacaactgatagcactgaaatacaagagatcaccagagacgattacgaataaccctacactaactaatttgaaagcctagaaaaaatgaacaagttcctggaaaaatataatctgccaatattgaattaggaagaaatagaaaacctgaacttatcaacaatgagtaataagattacatcaacaataaaaagtctcccaacaaagaaaagtttgagactggattgcttcactgacaaattgaccaaatttacgaagaagatctaacaccatttctcctgacattattttaaatatttggggaggagggaatttcagccaatttattttgtgaggccagcatcaccctcataccaataccagacaagagtctaaaaacaataaccaaaaaaaaaaaaaaaaaaaaaaaaactacagcttgatatccttgatgaacaaagatgcaaaataattcaacaaaatactatcaaattgaaacaaacagtaacaaaagataatgcaccataatcaaatgggatttgttccacagatgcaaagattgctcaacatatgctaatcaataaatgtgatacatcacataaagagggtgaaggacaaaatcttatcatcatcttaatagacacagagaaatagggaaaatttaacatcctttaagataaaaactcaacaaattaggcataggatgaacatacctcaacataacaaaggccatatgtgaaaaactcatagctaacataatactgaaagggaaaaagtggaaagccattcctctaagaactggaaaaaaataaagatgctcactttcccaactgcagttcatcatagtactcaaaggcctagccagcatcatcagatggattaaaaaaaataaaaggcattcgaactggaaaagaaaaagttaaatttttcctctttgcagatgatataatcttctatctaggaaaatctaaacattttacctaaaatttcttagatttgatatataaattaaataaagttacaggatacaatattaatcatacacaaatcggtgttcatatataccagtaatgaattagctaagaaagaagaatcaagaaggcaatcccatttacaacagctacaataaaatacctagaaataaagtaatccaaagagctgaaatacttctacaaggaaaattacaaaactctgataaaagcaattgaagaggacacaaacaaatggaaagattccatgctcgtggattggaagaattaacatcattaaagtgaccataccaaaacaatctacaaattcattgcaatctctatcaaaacgccaatggcaattttacaaaaatagaaaaatatttatgtagaacccataaagaggccaaatattcaaaacaatcctgagtgaaaagaacaaaactggagtcaccacactacatgacttcaaaagatattacaaggctatagcaaccaaaacagcataatgttgatacaaaaacagacatacagacaaataaaacagaaatagattgtccaaaaataaatctgtgtatttacagccagctgatttttgacaaagacaccaagaacctacactagggaaaatacaccctcttcaataaatggtgttggcaagatcagatatccacatggaaagaatgaaaaggacccttatttctcactacatagaaaaatcagccaagatcaattaaagacatagtgttaggacccaaaattataaaactactggaagaaaactttggggaaacacttcaggacattgatctaggcaaagattttatggctgagacctaaaaaaacacaagcaacaaaaacagaaaaatttctgcacagctaaggaaacaatcaacagagtaaagaaacaatctgtagaactgggagaaaatatatgcagactactctttcatcaagggactaatatccagattatacaaggatctcaacacattgttaaaatgggcactagacattctcaaaataagacatacagagaacctacatatatatgaaaaaatgttcaatatcactaatcatcatggaagtgtaaatcaaaatcatgagataccatcttgccccagttagaatggctattatcaaaatgacaaaaaatatatataaatgctggggaggatgtggagaaaaaagaactcttatacactgttggtggcaatgtcaatcagtgcagtcagtgtggaaaacagtatgaggatttctcaaaaatgtaaatatagaactgctctatgttccagcaatgccattaacagatatctattcaaaagagaagaaatcagtatatcaaaaagatacctgcacccccatgtttattacagtactattcacaataacagagatatggaatcaacttaagtgtccatcaaccaacaaatgggtaaagaagatatggtattggcacacaatgaaaaactattcagccataaaaatgcatgaaataacactagttgcagcaacatggggtaaaatggaggtcattatgttacatgaaataaatcaggcacagaaacaattatcacatgttctcactatatgtggggctaaaaaaggtaatatcatgaaggtatagactagtatgctagatgccagaggctaggaaatgtatgtgggaaggataaagagagtaggttaatgggtctaaacatacatttaaacagaaagaataatttccagtgattgagagtaaactttagttactaaacaacaatgtactgtatatttctaaatagacacaagagagtatttgaaatatttttaacgcattgagatgaaaagtattctagggaataaatactatgacatgatcattacatgttatacgcgtgtaacaaaaaaatcacatgtcccctgtaaatatatacaaatgctatgtatcaataataagatagaaatatatatacctattatgtacctttaattattaaaagtgaaactttattttaaaaaggataagggaaatatattgcagacaaatgtagtggtgtgagagggtgcagaagtacagaggcaagaaaacataaaaggttaaactacttcatggcatgttattgctttttagtctgtaaaccttgtatcataacctcaatctccaacactaaatttaggccctccttcctcccttagcttagtgaaacatcttttttaactgttcactttctctgtctcctgcagtgatcattattctgtcttttaaatcaatagaattaggttgctcttgtttaaaatagctagctagctagatactcaaccttggaaataaggtcaaccggagagggaagacatggtattttactatcatactggagcactgtttaagaggcttgtgtaaagattaatgaattacatgggataaggtacctatgttgacttcactatttattatttgatgagagcctagacattgtaaatatagatgttagttatagattttgtctaggggagacaataaccccaaatatgatagttttactatctgtaagctattataattattctgtgtaaacacaaaaatattatttaaatatatttcccccaaaatgcatataaactcctagttcctctcaatgcttaaaaccaggtaagcagatttatcttcttgcaagttttgttattaataaattaatgtcaatcacatttatttattttatatttatatataagcactctgtttcgaactttttgaaaacttaattctatactcttcaatattaaaatctccttttgttttagtcatttataacctctccccaactgtgcccttgttgcattttattaaaatttgtaatgctcataaatggagagactaaatttcaaccacgctgaggcacaaatagggtgttcccagctcttggagagcttcttgaaactgtacccattccctctactgattccagtgcaacagagccctggctgtgcaggtgaagctatgaaggtgaaagcctgacataaaggttttccttcctaaaccgccacaaacccctgtccagaatcttgcccgacactatctctggcttccctacatccaaacgcctattatttagatatatccattgttctcccacttcaggccttgttcacacatgttgttttctctgtctcaaatgtcctcttctctgtgtttcttccttgagtacctatatttatttttttaagacggagttcaaatgtcgctcgtacatactgtaaagcctttttttttctctagccctactaccgctttggaatcactttgctataaaacaacagcacacatttaatgaggtcctctatggggtaggtgtcatgggaggctctgggaatacaaagtcaaataaaatataatccctgaccttgagggtcttccaggatggtgaaaaaaattactgtctggtagaagtgtttatacctctctgacagtactcagacagttttattaaaagtttatgtttacttggcttcccactggaagatggtgaaacgcttcctggcaaggctttggcgtagtgttgttaatacatttaggggcttagtgcaaagtttctgaggccaaaccacctcatttcaactcctggctctctcaccagctaacactatgaccctggataagtcatctatccttactaggtctcagattgcttactgataagtaatagccattattttttgtcttattattattagagttggtaaaacataattattttgaattgttgggttcagattgcaaatgacacttaatgtgagattatatagcttgaaatttactctaatagtaggtggaagtccttacaatatataaaatgaaattggtaccatcaaagcaacatcctatatcaatatttactggcctattggcattcactcagcttattagatttttggaatatgttttatatatgcttctctaatgactgaacagagttgaacatgttaatgttctcattgagtactgatatgaacagactgattgatcttataacgagcttaaaagtttttacgttaatacccaacatgtgtggactctactgttaagctacttaggatattgttttatgtttgaaatgttttaaaatgatgtaaacatttttagtgttttatgaaagaaacaaaaaccaacacaatacaaactaaaggaagagaatgtgaaaatcatggagcaacccagcagttgatatataacaagatcaagattaacaaatagtccaggcgaggtggctcacacctgtaatcccagcactttgggaggccgaggtgggcagatcacaaagtcaggaacttgagaccagccgggccacatagcaaaaccctgtctctacttaaaaaaaaaaaaaaaaaaaaaaaaaaaaaaattaagcaggtgtggtgacacgtgcctgtatttccagactggggaaggctgaggcaggagaattccttgaacctgggaggcagagtttgcagtgagccaagatcatgccactgcactccagcctgggtaacagagagagactccatctcaaaaaaaaaaaaaaaaaaaagaaaagaaaaagaaaaagaaaagaaaagaaaagaaagaaagaaaggattaacaaataggagctgaagaacttggatgtaaggaattttccaaatgacttgtattcagatggaagaaaattgatattaccaatgcaaaataaacgcagcaaatataaatttttgtgcagttttaggtcaagtaagataggatttcattttatatatatatatatgtgtgtgtgtgtttccttccaaaaattaggacataaatgctaaagacaatagttcaactcattaaatatcgactttacagaaagtcctaaagattttcaacattgacaaaaattattacgcacatttgcagaacacttctcagattctgaaaaataactactagctacattttctttgagatggtatgagaaattgaaagctgagtaacataaaaggataaccagtgaagattattttttatttgcattgactatctcaactcatgtaacatgattatatattaagcaatctaatttataataaaattgttaaatttctctaagattttatcatatgctagtaggtattctaagaacttcatatatgctgaaaaatgaatattttaaatattaagttcttaccctaataacttggtaagaattaaatattaaatccttatcataagaatttggtaagaattaaacattaccataagaatttgtcaagaattaaatattaagtccttaccataagaatttgttaaaaattaaatattaaattcttactatagtccaaagaaggaggttctgttttatcattggtttcattttacaggtgaggaaatatgtgcacaggtagttgaaaaaaagtttctcaaggtctgaagcaatatttaatatttgcacacagtttgcctaattccagaggtttcagctatttaatatctaagcagttgttgttgttgacaacatgtgttgctatatatgcttataaagacctataggcagctcgaatattataggcacagagtcataaatccaagagatggtctaatctcaaatggttaacttggtagttaaatcacacatggaaaaactagcatggacatggatgtgataaacagcagtgctaagaaccgagaaccacaaccactatttttttgtgtgctaatgttacatacaacttgcaaaaagtaaagaaaatgtacatgatctgctgtacatgaaagataggctattgtgcataaatgattttctgagttaattaggttgaacctaatgctacaatagcacaaatatgtattcatgcattgcagaagaataattgctagaaaatgttgctaggcattacattttctttattattcacttaagagaaagtttatgaacacaatgaagaatattctttgatgttgcttctgaattgcatagtcgagcatgaataccattggctaatatgctgtcactcttatagcaggtgatgtaaatattctctaatctagtatcatttaaatgaatgatcaataatttataaaaaagaatcctttaggcactttgtatctgtttatcagacattaatataaatggtattattcaaaaatatgttctttctagttttaatgtcatgatttctcctaaaaatacatttttcaatgaatgtttctaattagcattggctatttaacactctcccacgttggagttcctcaagtgcacttcaaactcagtggttcaaaattcatatcatccttcaactcgctacctcgataaaatatattattctccattttccttatctcattaaatgccaccattgtctactcaatgtttctcaagccagagagatgaaagttatttctgatgcctttcattccctcactccctatattaaatgcatgatgatattttgtgtattataccaaatacatgtctctcaaggcttctcttttaatcttctgcaaaaaactgggattcccgctccatgttttacttgcttatttcttggtgtttggtgccctgttgcattagcatcttgtttgtctccttctccttgcatatactctaccttccttccaactgtctccaaatattttttctgaaatgacgttttaaaacctgaaatatggtaatattactcctttcagaaaagtacttccatggctatcagttgtccctatttcaagttttatgattatgatgatttttattattatgaattctacagcaaaatgtgagcattgtgagtgtaggaaccatgttaatcttgctaatcaatagatgagtcaggcacatagccggtattcagtaaaactttatcaaataaataaatgaatctagttaagaaatcacaattcctaaagagttcagtatgaaattatgaatatcttagtggactgctttataccccatttattcttctgttttagttcaactgatctctgtttcaatagtgaaattagactgtattatttctccttttttattccccaaatcatctgtggaaaagaacagcttgggtatgtttttattttgaaaaacttcaatgcaggcttataatatacatttaaagtaatggcaaatagaaagagctaagtcaagtagtcaacaaaaggtcacagaatgcctaaaaacattaagagcaagatttgacataaggaaaacacgttgcagactttagtcaaggataaaacaaaaacctctctggaagagaccagtgaaataggagtttattcctatatctgctttaaacttgtgtgacttcacaggccttcagttccttcatctgagcactggaatagattttttagtaaatccatccattactgcaattttatgattacatatagaaattattctttcttggaaacgatgttttcaatatttatttttcttatttctatcctgtctctcacctgtctttttctaatatcctcataaaacactgacttcacgtcaatctctaaaatctttacattatgggactaattatattaagtcatttttctccaaataacctaagaattttatactgcaaatcctcacttaacatcctccataggttcttgacaactacgacttcatgcaaaacaacttatataggaacaaacttgatcatagggtaattgatataaacaagagtcaagttcctatgacataattcttttcatgaaaacatcaagcttctaaataaagataaaaatatttataatattaaatattgaaataaacatgagctatatgtacttttaagaaagattaataaaaacaagtaagataattattcgccttcttgttcctgtcgcaggtgtccaaagcctttctgggcaactcagggtacaaggtgggaacaaactttgtacatgacactgttctatcaagggcacactcacacagacacactctctctctctctttctctgtttctctctctctgtcattttagcaccatgtagatacaccaatgaacacgacatatttttgagataggaaaggaagccagagtacccagagaaaacccacgcagacatggggagaaggtgcaaactgtatacatgcagtggatcccaccaggaatttgttttttctcatcaatgttacaatggaaggatgttgaatgaaacaacattatttaagaacctgctgtacactagtatgagcacactagtaatgaaacttatgatactgaaagtttaagtaagtaacttgctcaaggtcagacagctagtacgtgaccctgggatccaaaggcaagaatcttggcccctgaatacgttgtttttactactaagctacaatgactgttgagttcagtcactgaagtatgttttgaaggaagtcagagggaggcatgtatggtgaatgcctgtaatcaaagaacaagttctgcaagtaaatatataactaaaaacataagctatgatagatgtttatataaactattagccataggaaagattcaccctgcaagcatcacaaagggtgtataaaagagatgacacttgagtaatctgatataacttagatacagcctggcaaacagaaaaaaaaagcaaagaaccacgaatggttatgtagttttaagttttgaggttgagtgaattgtatggagagaagataactgccattaagttaaattgtgaaaggctttatatattaagccagatatttaattgtaatgccaaaggcaatgtagaatgattaaagttttctaagcactacattcacatattggaaaatttttaagatactaattcttacggtagtgtgaataaaagtaattctccatggactaagggcttctgttgggcctggcttcatgcccaacattgattggtgagaaacaaatagagactctatggaataaacaacaaaagttagttgtctaaaagtaaagtagaacagaatcttcaactttaataaaagaaaagcatatggaaagaaatcctttaaataagggagatacataaaacatacataagaaatacacaccctattgtaaaatagagtctcatttggcagtagccattacaagcatgccttcatgagaatagaatgtgagttttattgttattcagtggccactgatgtatggaaacaacatcccatatacagcccaaacttctccacttgaaacaggaatattgtattatgtttgggcataaaacagtgctgaatgcagagtagaaactcaatacacagattttatagatattgtagactgtttgagaacttttggattatatttttccctgtagcacatagttttgtgttcctaattttcattttgatattactttattttatgggcttatgactatgatttatcattaaattttaagtattttaaaaaatattgtttagcaattttagatgtggttatataatttttatgcctagaattttcccatggaaacatattgcaaattagctttcatttaccagaagaaaaaaaataaaattttacataaaccagttttctccaaacatgagctgagagcaatagcaggtggtccatacactgaggagtatctggtaacattccaactgtgaggcagaaaattctgaaatggtgcaatataggaatgtaatgtgaaagattaggagggctgacgttagcagaagaataaagcgtccagaggtactagaaagaataggacattgttaaagtctttggctgtcaaacagtacattacattatgggttttaatcttcctaatattgctcattgtttagttgttactattagtaaaatagtgcatacatttttgaggagggctgatgttgatagctcgtttttttgtcactttgatagttagagttgaaattagtcatctacaatagatacttttgtaccatatacaaaattgtgctttgaattagctgctgaattcatgatttatagaagtcttagcaaggctgatttatactacactactctcttaccttaacttgaattgcatccctaagaaacaaaagctgaaaaagattgtattagttcattctcacaccactatgaagaaacacctgtgactgggtagtttataaagataagaggttcaataaactcacagttccatagggctggggaggcctcaggaagcttacaatcatgtcagaaggggaagtaaacatgtccttcacatggcagcaggaagcagaagtgctgagctaagggagaaacaccccttataaaccattatatctggtgagaactcactgtcataagaacaacacgagggtaaccaaccccacgattaaataacctcccactgtgtccctcccatgacatgtgaagattatgggaactgcaattcaagatgagatttgggtggggacacagccaaaccatatcattctacccctagtccctcccaaatctcacgtactcacatttcaaaacacaatcatgctcttccaacagttccccaaagttttaactcattccagcatgtactcgaaagttcaagtccaaagtctcatctgagacaaggcaagtttcttctgcctacaaacgtgtgaaatcaaaagtgagttagttacatcatagatacaatggggatacagtcattggttaaatacatccattccacatagaggtaattggccaacacaaaggggcttcaggccccattcaagcccagaatccaataggacagtcattaaactttaaagttccaaaatgatatcctttgactccatgtctcacatccaagttatgcctttccaagaggtgagctcccacagccttgggcagctctgctcctgtggctttgcagggtatgcccccccttcagctgctttcacaggctgacattcagtgtctgtggcctttccaggtgcacagtgcaagctgtggatggatctaccattgtggggtctggatgatggtggccctcttctcactattccactagacagtgctgtgtggggctccaaccccacatttcctttccacatttccccaggagaggctctccatgaaggctctgctcccacagcaaacttgtgcctgggtatccaggcatttccatacatcctctgaaatctagacagaggttcacaaagctctattcttgacttctgtgtacctgcaggcccaataccatgtgtaagctgccaaggcttggggcttgtacccattgaagaacagcctgagctgtacactgacccgttttagccatggctggagctgaagcagctgggatgcagagcaccatgtcctgaggctgcatgggttgtcggaagaggggcacaaaaccatttttccctcttagggcttcaggcctgtgatgggaggggctattgtgaagttctctgacatgtcctcgagacattttccctattggcttgaatttctccccagaaaatgagattttcttttctctcacatcatcaggttgcaaattttcaaaccttttattctctgcttcctcttgattgctttagcacttagaattttttctgccagataccctaaatcatctctctcaagttcaaagttctgcggggcaaaatgctgccagtctccctgcatagcaagagtgacctatactccaactcctaacaaattccttatctccatcaagacctcaacattgacttagttgtccatattactttaagcattttggtcaaaaccgttcaacacatctctaggaagttctaaactttcccaaatcttcctgtcttcttctaagccctccaaacttttccagcctctgcctgttacccagttccaatgttgtttgcacatttttgggtatctttacagcagcgccccactctctgcactaccagttttctgtattagtcattctcatgctgctatgaagaaatacccgagacttggtaatttataaagaaaagaggtataattaagtcacagttccacagggctggagaggcctcaggaaacatacaatcatattggaaggggaagtaaacacattcttcttcacatggcagcaggaaggagaagtgctgagcaaaaagggaaaaaccccttataaaaccatgatatcttgtgagaacaaattcactatcacaagaacagcatgagagtaatcgcccccatgattaaattacctcgcactggatccctcccacaacacatggggattatgggaattacaattcaagatgatatatgggtggggacacagccaaaccttatcaaagttataaaacaaaatttctcaaaacctgctaaaacatgtgaaagctaatcagatgtaacctagatatacttgcacgattttgcttgaaaaggtcaaaagacaaaagaatgtatgtgaatgtatcagtatttgctgtcattgcacttagaaatgtgtgtctgggtttctttttagaaagcaaaatggtttcatttcagcataaatatgcattctttttacccgtgtaattataggcaaggaataaaacaccacattgaaccatgtatgtacatttatgtctatgcatgtgtattcttaaaatattatttcagaggaataatccacagaaatatttattaaacatcagttgaataagatgcttattaatatttattaaatattaataattttaattattaattaaaaattaattaaaattaacaataaatattaataatgtttaatatttattaaacatcagttgaatactatagatttagttttgcaccatttttgaaaaggctttgatttaattgcccacagtaattctttataatctataaatgaaattctttataatctatcaattaaaagcatttataatctataaatgaaaagcaattattattctgtttggtcattgtgtatttgccttattgagagcctatagaaaaaattttagtaattaaaaattaaatatatatgcatatatttacatttataaaactatataaatctattttgtgtttacaaaattatataaatctgttttatatttataaatatataaatctgttatatgtttataaatctataaatctgttatatttaatctctattatatttatatattcaaggagatgtatataaatatacatttatatttcagacctattggaaagaagagtcctgtgtatatttgttttctagagctgccgtaacaaattacctcaaacatggtggcttaaaaataacagaaatgtattctttcatagttctggaggttagaaggtgcttcctctgagggctgtacttcctctgagggctctagggaaggaacttcccttgcctcttccagtattctgagggctctcagaaatccttggttctggttggtttgtagctgctttcttcctatctctgcctccttctttgcatgaccttcttctttgtgtgcttctctgtctccgtgtctgaatttcactttcttttttttttcttttttttaaaattatactttaagttttagggtacatgtgcacaacgtacaggtttgttacatatgtatacatgtgccatgttggtgtgctgcacccattaactcgtcatttaacattaggtatatctcctaatgctatccctaccccctcccctaaccccacaacaggccctggtgtgtgatgttccccttcctgtgtccatgtgttctcattgttcaattcccacctatgagtgagaacatgcggtgtttggttttttgtccttgcgatagtttgctgaggatgatggtttccagcttcatccatgtccctacaaaggatatgaattcatcatttttatggctgcatagtattccatggtgtatatgtgccacattttcttcatccagtctatcattgttggacatttgggttggttccaagtctttgctattgtgaatagtgccgtgataaacatacatgtgcatgtgtctttatagcagcatgttttgtaatcctttgggtatatacccagtaatgggatggctgggtcaaatggtatttctagttctagatccctgaagaatcgccacactgacctccacaacccttgaactagtttacagtcgcaccaacagtgtaaaagtgttccttatagagacactagtgattggatttagggcctactctactccagtacgacctcatcttaactagttacatctgcaaaaactgatttacaaacaagctcacattctgaggttccaggtggacatgaattttgacagtggacagaactcttgaactggggacagcatctaaatgtgtacatgcggtgtagtcattatttacacatgactcaaaaaatctagttctactctccagtctagtctcttttcttgagttccaacaaaagagatggactcatgaagaattcagaccctctcatatcttatgtgcatctataaacaggaacttttgaagggactccagaaagacctatccaagaagtgtttgaaggattcctgtgaatcagctctagaatggaagacgagaagtaaaaagaaagaataggaaatggaaaaaaaaaactggcttaccaactttagtcctaggattctctttatcttgtgttcttaggagtacatatcagttcttcaaaaatagctggcacttgctttggcagcacgtatactaaaattggaagaattcaagaagattagcaggacccctgtgcaaaatatagctggataattgatttattagcataaatataggtaaaattctatcaactaccacagaagaaacagagaaagccagtgtctaaggggtagaatttgttgaatagagaaagaaaaaggcaattgtgaaattatatatatataacctcaaaattttgattattcaagtgtagcatggaggagaagcattttataggattatatgtgaaagcacttagtattggctaagaggtaaacaaggtcaaaaatgtatgccctaagcacctcctcccaactatgttttggttatttttagtaaaagagttttctacctgcttttcttcactaatcagaatatgcctcagaactgggtggcaaaaactgaactgtgggttttgaggaagcaaatgatatatacgaaatatatattataatggaaattagtaaaatgaattctacataatttagagctcctggcatcaagcaaattaacaattacttgaaggaagtaaggatgactagcctgtaaagaaaaattcttaaaggaatacttgatagttattcttaaatgcctgaagtctggcatgagttaaatggattaaacttgctctgtacttacaaaaagttgcataatcagttttcagcttgataaaatatgatggggtatatatattctcactgaaatcccctctaaagcataatggagatttttaaacaaaattaatgtgaagatactatctaagtaatatatttgtgtcataaaactttagagttggaataactgtataatttccattaattcttaaatattagattttggtaaatgtatgttatagatttacatgtgtaaaaactatccaaacttgttttaaatacctctactatcaccttcagttctatttaaggtcaacttaacagatttatgtaggtcccaagctattagagaaaatgacaaaataatttttagtttaactttccaaaacgcagatgcttattgtataaacaaaactctttccaaatgatttgaccagaattcataaagcagaaacatctgttgttcagactcatccaaactataccttattctgtattctgtatttataaaccacaaaagataatgctcactagttgaagtctatagactttcatgcattatttatgaagtcagtaaaaatttcaagtatttgcataataattgatgttagcaataagaatatgagtttataaatagtttccaagtgccaataaatgccagtagtgaagataaacagaaaaaggtgattttatcacacctgatttaatgctgtttttcttttatatttcaacagtcagtgcaatcttggcaataacaaagagagaaacaaattttatattgttaaaaataacatttagattatatttttgtatatgtgagaatgtgcagatattgagtataagaatactacatttttgagttaggtgaatttaggtatgtttttaataatttaactttgagagaattctgtatattcactaaagaaaacattcacattaaattgctaatctttatcagttaataaatctaactgataactttggaatacaccttttggcaaagctatgttatattttaattgtattgaataggtctgagaagcattttgtttacagagcatttgtaaaataaaaagtgattaaatatgtgggtaatctgtttgttttcttttgaatgtggagatgacagaagtaaatatcataggtgtcatgggatttttttttcaattgaagctagtaaattccctttgtgggtaacgctatataactgagtaaagttattctctgtaaatctcattcatatctttatatgttggtcatgattatttatatttgcctttagtaacttttgtaagagaagaggcagggttaatttaaggaagccatagaccagcctgctttagaaattttattatcctattaaaccaagaagccgtaagaagatatgtggggcaaaataaaaagttgagctaaatgacaaaccgtatttggaatataaataagttaaaaaaataaaaaaaggaagaaactataaataattacaaaaaaacactcttattttatgaaaccatgtcctgattccatttcattagttggtccaatcttcaatgccttttgcaactcacattacttgacaggaagccaagaaaatattttcagtagaaaaagtaatgtaaatgacgagttaatgggtgcagcacaccaacatggcacatgtatgcatatgtaacaaacctgcatgttgtgcacatgtaccctagaacttaaagtataatatatatatatatatatatatatatatttataaaaaaggaatagtcatctgccacttcaaacttgcttctaaatgtggaaatggttttcccgagaggttctctatttgagctatcaccacatctcgctatttgcaacacctattcaaactttgggaggatctaggcttttcaagaactctctatactgatgatacagtgcatagttttccttaagtcaacagcaagaggcgaaataagtaatttgcttttgtagcttctatgtatgtttgtctctcagtatccatgggggatggattccaggacctgccgccctacctcccatcccccaacagataccaaaatctccagatgctcaagtcctttaataaaatggcctagtatttgcatataacctacttatattctctcatatattttaaatccattttagattacttgtaatacttaatgcaatgtaaatgttgtataaatagttgttatgctgtcttgcttagggataaacaacaataaaaatgtttgtacatttttcttgttattagaatctttctcaaaacctacagttcagtttttgccacccagtttttaggcatatcctgattagtgaataaagtcaggtagaacactctcctttcatgcagccatccatttttccttatgaatatttcctatccaaagttgttaattgaactcatggatagagaaggttatatttaccagaagcaagcaagaaaactgtgtgtggcaatgtgggaatgtttctctagatttttctctcagtgtgtgtgttgtttttactttatttggtgaatactaggcaactctacaccacccctgcccctagtaatttatggatatcaagactgaaaggaaatgaaacaaatttattacttacatggtattattacctactaaagggcaaaataatccacaacaaaaagggctcaggttcagtgggaagtgaaacctaaggaagagtcagtggagttctggtatttaatggggttaagggttgggcccaagtgagtcccttaccctcagccccaatagttcaggatttaaatggtttgaacttccctgccgtagccaaggaatagagactctgagttttcttactgcttgcctagatatggggaaaaagaaaaaagtggaggaggaggccttcaaagtggttggcagttaacagtaccaatagagtgaaactttttatcacaatttgagagaaactttgagaagtaaaaataggagatgtagtctacagacccttaagaaattcacattgtgcccgaaagactaagcatccattcatctagaagttgaagaaaaatagaaactgggtttgattaaatgacactatgagtgctacatgtaagacattttctagcctttcagagaaggaagttaagagtacatgaaaagattattactgttcctgtttgcctttgaagattatagaggattacagtcagcatgcagagacaatattgttgtaacttacagctttaacaatgaattctattgctagaatttcctttttttaatgttttccataagagaattcctccagttctgattatggtttccaacaagagccttagaaccttatgtttccattagattcttcttaatgatgtacattaggaggagatggagggaatttcattattctattctaaaacataccccctcccaatttaaaaatggaacatttgaatactgatatatgtaaatgattcatgatattgtcagcctcagcttacttgggaaaataataaaatggtcagtcatctaaggaatgattaatggattctctagaacttagcttcttctcttccttcctctgattaccttcctttgggcatgtcacagctcctgatgaacatagacaatagataagacaattaatgacattaatgtttcaaaacactttattatttgtttaaaattacagtttgaagtcaagttggggaaccagatgccactttcacatggcaaaataataaatggtgtgttttaattatgtatgtggcccaattatcatgagtaataagcaaagcagtatttttaaaggttagagaagttctgtatatattagagtggagaaactttaacgttctaaaactgaataaaatcttttcttaagaagaaagattttgttttcagttaaatattataacatatgggatatctgtagaaaaaaaattgagtaatatactttctcaaggttttatttaaggatatttatttccacattaggtagttcacagataatagtggttttgttttcacagtctttcttgtcaaatcaaaattcatacagaaatacatgtgaaatattgattggttatccttttacaatttacttgataaaatctaagtagccaagaattcaagcctagaagactctgaccaatattatctttgtcttttatgctaagaaataatattccaaacctatttcttaggctattactaccatttgaccctttataagctgttatgtttcaatttactcaaataacataattgtccagtaagctttgattacctcagtaacagatctacaaaaggttaatgggccttaaaaaggaaagaaatcctgtcatgtgcaacaacacgtatgaacctgggagactttatgtcaagtgaaataagccaggcacttaaaaacaaacatgacataatctcacttatatgtagagtttaaataagtaaaactcatagaaacagagagttaattggtcatcatcagaagctagggcatgggggaaattgcggagatgttggtcaaaagacacaaaattccagttagccaggaggaataagttcaaaaaattgattgcacatcatggtgactacagtgaataacaatacatttatatttgaaaattgccaatggagtagatttcaagtattctcaccacacacacacaaaaatagtaactaggtgaagatgttgtagagacccaaattcaggctcatgtaccagatgctcagtcgaaaccaaacactgacacaccaacgcttagagatagataaaagtttattccacttggccaaagcgagaacggggcaagatctgtcagatatgtcttaacaataagagaaagcagagaggtttgtttgcagccagagagtaagagagggggagttttagggaaccaatggggaagtttgtgtttctttaatctctgataacatcctgagcaaccagacttctgggtctcaacagttagttgcaacaatcttataggcattctttccttctgcgaatgttttttgttaccttgaagttatcttctcctgcttgacaaagaaacagtacatcagcagtttgcaattgtattgtgagaacaagggatgttggcttttgtgcaagcaagcaagagcctaatccgacttttttaaatctcaggcactaaaaatgctgagatactaaaatctcaaggggcccaattacaaggtaatgcatatattaaatatgcatacattaaagagcttgatttagccattccacaatgtatgtatactttaagacatcatgtggtacatcttaaatatatacagtttatttgtcaattaaaaaataaataattcaaaaagaaaaagacattaatgggaagactcacaaagatgaaataacaggaaatgataaagaaataagaggaaaaaggtcaatacagtttcaaataatgaaacacaaaaaaccgaatcaacagtagtactttttgatatgatcttgaaagttagcaaaggaaaaaaattatatgaactgtctagttttataaatattgatctagagacacaacagaaagtagttcagaatatgtttgaatatgagagaatgtatttaaatatcagtttggaaactttatttggaaaatattaacatatagcaaatagttcaaccttcataacagaaaatttctctacaagaaaactatagagagaaagcagacaaaaattagtatttgaaccttttgaagtatcattgcaactctaatgttttgtgtactagtttgtttttggaaatgctgggcctaagaagaatcagaggagaaacatatgaaggctttttacttttaagccaggtgagaaaaaatctgccctttactttgtcatgggtcccaaaggggacaagaacttaaaaaaaatgagagacctgatcatcagagcatatacagtgttgtgaagaaagatgtagtaaaatatattatctaaaaaagcactgaagaaactgaaatgcaacctgctaatgaagataggtatggaaaagagatatgaattaagtccttttggaaaagaagatcacaataaactaatttctgtgaaaagactaaaaacacaaataaagtcaaataaaatacatcacagaatttaaataatagacaccaggtgcataggttttaagactttggtgaaggaaaaatataagaaaaaaattaagaatgagattctagaaatgtaagaaatatacagacattcagcaatatctagtggtttaatttcacagaaaaaaatagacatttattagaaactgtgtttataaggaaaccatagaatgagaagaatccttaaccctactcaactttaacaattatgatacattgaattagcttttgatggcagaagtaatgatgacatatttttttaaagtaacctagcctaaagtacgctcttaaccactatcatgtagacaattttttaaaagctcttgcgttgtgtacagtagcaagctcataagtggaaacttattgcacattcaggagcaaactggtgatatggaattggattctctttttttctgtttttattctaaacaaaattttacttctacctcctactaagaaagatgtgcttatattcatttcctgtatagtttggtatgtgaataaaatgtgataacaaatataaaataaaagatgggtaaatttttacatacactttcatagcatttatggagaaaaaaataaaagcaaaaaaattacaaacaaaacaattgagaagtgaaaagtcaagggctttgactcagaggagcagaacactggggtgagaatcctcatgacatatgaaaagatggaacccaggacaagcagtagacaattggcaattgagaaaaggagaatcatctccttggaaacagtagagaatgattctttccttgaacttaggagaaagaaatttatcttaattttgtcagattaagtaaggatttctgtggccatataaaaatgtgtaatgcaatataagaaagtgctttcctcacatgtagttaaagatggacgattgttgtgataaaaaaatatgcttagagctaatcttgctgccagagtttaggaaaataaatagaatggtcctattaaatgccaggcactagactaaaccaaggtgctcatgtcatcactggcaaatagtaagctcacagtcatctcaaataactgcaatattaatagatgtttcaggaaaaactataagtaatttagagcaatggataaatgtgtaatgatatgacaagcttctgtgctagtttatgagtgttttagcttagagttaggtcagtctgtcaggtactctcacagttgaaactgtatgaaattattcagatttcagaaaaaaatgtgtacagtgcgatgcaatttacagaataaaatctttctatttgaaggaatgtataatgggaatacctagaaagtggtctggaaagaatgataataaactgatgcaactctttatttggctactccaggtcagggagtatgaatcatccgtgagtgtgtctacaaagagaacaaagcgggtagtactgtggggtctcttgcatgtgccatgcacactatagtctatgtgaatgatgctcctccccggaatcatgtagtgtactatcttccctttggcaatgggatgcataatggttatgatgtgaagcaaactctttgtttatactctctatacattactttttgtttttacagcaagatttttttcagataccaattttataatgagtgagaatgataatgaggcacagaaataccaggtaaatattcccttacctcttgtttgttgcagagtgttcttgtgttacctagacattctgaattagttttaaaaagaatgaagattttttttctctcacaatgctattatttcaaggaggaagacatgaagactttgtatgtagattcaataagaagattttaaacatgtgtatgtaaacttggcagataagagcacttggatttagagaggctgacagcatatagcagaagtttagcatagcttagagctctgttacagaaattatgagctgggaaaagagacaatggtgagctgatggaagtcagagcagccaggttgattaattaggactctcaataaacactagaatgaaaataaagaagacagtaatccactagaacaaaatagaagccaaggagtcactacccacctataaacccaataacaatagatgacaaattttgatacaaatattagaagcaggagagaaattagcattttatgaaaaagaaagagcttgtagtcagtccgacagatggatgtttaattcttggatcctctatttacaggtgctagtgtatcttcctctctggatctgtttccatataagggatataataattattattttatacagatttttttttgtgttgttgatacatttgtgtagagttacatgaataatgtatctaagtgcctagtacattttctggcacatagatgtttattaaaggatgggcctctatatctaccaacatctaatatgaaaaaaaacttcccatttcccaggggcttccgaagatgagtatgaactcatcttagagttgaagaatatgtcagacaggaacaggtcagaaaaagatcccaatctatgtatttcatgtaaaaagatatttaatatagggactaagaaggagacttatctcatgattagatggtgtacataggcaaagaaaggaaaaaaaattgctgctattttcataaaggctggaaacacaataattatgggaaagttgctagcagtgatttcagatgcttgtcaaacttaaacaggaggtcaccagaaaaacactctaaacctcttctttatgccacccacatctcacgctcatgccactatttagcataatttcacctggagctctgttgtgctgagatcctagaaaatgtagtgtctgggtttctcccttgtcatttaaagcatacttcagaagttggaagacgagtggataacaggaaacctgttacaggatacaacttgattaatttagatacaataaacaatggcgtttcctaaccacaagttgggttttttactactgaaagccaacacactgggctttctcttttactacccactacagttacagttaaataataaatgttgtagtctttattactttaatttcttataagacatttaaacttcatgaagacagatctgtgcattttaatcatttttaagcataatttcagttaatcaaataaataaatatttcttttcttaaaatgaaacaatctgcacatatatgactccactctgaagaaaggcaactactaacataactataggaatttatgcataattatgtaaataattgccttcagagtggagttgtatatgtgcagattgtttcatttaaaaaaaacaaaatagtatttattataataaaaaagactgtatatatatatatatatatatatatatatatatatatatatatatagcctttaaggccttttttttttttaaaaaaaaaggagactgtccctccaaaagtggcacgtagtttctacccgttgtataaccaacactttatgaatttatggatttaatccacggtttatccccaagatttctgagatcccaagtccaatatagtcaaggctcaagatcaaagtacttacactttaccctcactacacccctggccttttataccccaccacataccacctcccagaagttgctgtaggaagaataatttacctacatacatgaccattaggattcagccttgaagcagacatgcaggaaaatataatattccatcttatggcaactttacttgttttaatatttttctgcaccctgagaaatagtcattttaatagattttcaattatacactaatatttatcagggattcattataaaatatgttattaattcccttgatggtgggagcagatagagaggaatatgtggtttcatctcttgaacctcctctctgctctcttatctcaagtttatttcattagccaattaaacttcttctgttactgtgtctctaggtcccccggcctttccctgtctctcaatcactgtggtttattattccttatccctctaataataaatgccagaagctatgtttcctcactaagacatatcctgggaagtcaataaatacacgttaagaagacaagatttctcaactttgttaagctacggatttctatcattaacaattctgatttagcaaacatttattgacacccaatccttctaacttagtttatctcaatgaattctgtggccacaatttggtgtgtgaataacttattgaacttgcaacaggtggtgaatcattaatggcaatgtcaagacttaaatgtcgccccgctggttaacccacagctgctctcacataccaagctagagttcaattagaaagttgcagatcagtaactccagaacactggccagagggtcagaagagctgactcatggacattctcattgtagataaaggattcacagggtttaatagtagttcttaagtcttttatttataaaacttagcagttccagcagtctcatgatttaggtaaatttgctgttgattggggtagaatagtagaagtatattaataaaaacacctttttaaaattacaaagtattctgtgcactgctgaagtgattcatcaatgagaaaatctgaattgctacacattaatattttttctagctctcacacctatatgagtctcagaaaggacagagtgaacagagatgagaatgcaaccctcttttagcaaatgatcaggcgattgtgtattgtgcaatgattaattgatattttaaaatgttttcaggaagactcaaacactttttgtgaattatgttcttaattttatagtcacagctactaaagcgagagggcttcttagtaacaaattatttttatagtcatcaaaggttaaaataagagagtaagatacctaaggccacatggagaataaatgtcatagctgaaaatttggcaatggttttgtgattctcatcattttgtgttttatcttgtcttttaatatagacttctctgaattattttacttccgacatagagtaatattagactaggcctttaattttacaaagtgtaatatttgtattgtgtaataaataggtagataaataaatatggaccaaaatattgagcagttatcataaatgtttacatacatagaaaattgttttttaatggacaacctatataaaataattttctaataaacatgtatggttcaagaagggcattttaaattaaatgttcaatgccattttaagaaattgattctctaaaagaatatccacaaaatttgataccgcattaaaaaatatgccaaataaatgtatctagaatcctctagaatttatttgttgattgatgaaatcataaggaaaagaattttcatatgtaatttattaaatgataaatgatgtcatttcatttacttggcaaatagcataataaagattttaggaggttttcctctagctggcaatttttgaggattaaaaaacttgacccagttttgaaactattttaccttctgcccaaaagccacctgcaaatagcttatttgcataagcattaaacacaagggctttcatgttccttttacttattactgggataacaaacctccgttcattaagcacagcatcgtttttgttgtgaatgaaaaacagccaactttctgccacatctggttgctaatctataagctttgaataaacagtagatagtcaattgccagcatccattctcttaaatcatgtgaagtttttttccccccagtcaaaattccatttactataatttcatttcatttttcagaacaaccaggactttaaaaagagatcaggttttatgttgcaaggtggaaaacatgtattagataatctaaggataaatctattcgtagttcatatactaaatctctcaatgtcctattgcccataaatgttcaaatagtcactacagacagaataatttcactgtagcaaaaactggcatttgcattgaaaagtcgtttctactcatttttgagaaactggtagcaaagttattaattttataaaaaatctagagtcaatctcagtgaataacttaatgggttttttgctgggcaaaaagatgagggcagtttaactgcaatagctaaaaaacatggcatttaaaacatttatttattgaaaaataaagaacagctacagcatccataaaattcaaagcccagcattaccatttttttccccactgcttccaaatgaacttcatcctccttactttaaaccttcagaacagttgcctataaatagaattattagtcagacatttgggagtatctttcagtgtggccacatgaaaatctaccagagcacacataagaaaactctttccgtaatggaacagacaactacgcctcattaaaatgcttcaccagataaactataataagactatttgttctcataatttgttacttttattaatgaagcttcccaatatgatgcccctcccctttttattagcagcaatatcaaattttgtccccagatttatgcatatttggtttcttttcttatctttcttaaactttaagtttatttagccacatgtcaactaacattttgctgaatccttatacatatttatgctatgtattattcacagctttaaaattcctattttcaaattgatattaactcttctaaactatttttctatatataatttatacatatatagaatggatacagaatttccttatgtctcagatttttgtttattccctattaaatgaccggtatccctaaattacagaagaatagttaagtctttgcaggatttaataaaaagtagccagacaagttctgtgactctacaaccttcattgacctcaattacctgtgctcttatgtaaagagaggactaggcattctaagaattatcatatagacagtgaattagctgcctaagtgagagtgctttcaattattttctcttttgtgaggagaactaaacttgctttagttctccttccaaataggaagagagctcaaaaagactgggggcaatttcaagaaggaaagaatgggatattcctcccctgctggcactcagcattgcacccatcctgcaatggaaccatacatgatgagacagttttgggaaagtttgataggtgtcctcaagagtttcaagatgaagctaaacatggcaagttgttacctgcttctggctttcaaaattctgaaggctacatgctcgttgaggcagcttttgatggcaagatggggaaagagaaaagatgccagattattcttcccactttaggtgaatgaatatgctatatataggccaagtgcatgccacagaagatgtaagaggcttcaggtatccgctggcaagtgttagcaagaagtgagcaggagaacaaattactcaggttaacaaataggtagcacagagttacaaagaacttacaaattcactccccgacagaagaagcatttgggtgcctgcctctcaatagaaataaagatgagattatttaaaaaaaaaaaaaaaaaaaaaaagcttttctcttttcttttaattcttcctgctatgattcttgttttccccattacaatcctaatggagccatagacaaaagaaggacatctggataaacaaccacaggtcttcctgttacatatcaattctgagctaggtgaggaacaggtagggaaaatgttttaatttggttgcaaaattgtagttttaatttacatgcaactagacctttttaaaacctgaaagtaagtcaaatttaccaaaaatagatttattgtctttcaattttattgaaagtgtgtttggaaattgctagatagctggagattggctggagttattctcaagtgatgggaaaaagagattccaacgagcatatttaaaggtagtgatgagagggaacaaaaaaagtatttcttcatttacaccaataagtataaccaataaatttgactgataaacctgttatagagaattataaaaataaaacaactaaatgtatcaaggtgattgattggattagtatattgcatattcaagcagtggctcatgtctgcagaaacctacttccccaaaaatctaatcaaactgtttatgtgcatccacatattagatttaattgtatgccagactaaaatcaggcctaactggacaatagaggcacttttgctaacaagataccatgagttgagacagtgtgaaccatcaaaaccaatgtaaaaactgattcctatttatcatgttatcattatacatatgtaagctctgtggttaaaatttgaaaagaggataatactaccaatactgctactactaatacttataacatttaatagcctaggatatggctgtacattgctatagactttataaacactgtacacttcatcacactaaatttattaatttttttcttcagtaacaaattaatcttagcttacagataatttgttcatcatcttggctgaatgttctacttgatgtttaatgatttgtcccattgttgttaattagtgtaatacctatatcctttgctttgtgtgtctagcaactctgcaggatatatgtagctttgctcattcactatcctggtgaaaaattggagagcttgcttcaaatgaagattatttgtttttgtaactgctggtaaagagtatacatttttacagctacaacaaaattcctttttagggctcccctcctcaatttagagtccgtgctaattagacaggtgtgacaagggaggctttattcagatttctcatgatttaaatcagggctttgtgagttttgacataattactctctggtttgtttttaataacggttctctatggatcaagtggcaacccaagtctagtgcaaaccagaggtgaggtagttatagcagagacagaggtgtgcattttggttaatatcttattaaactcatgctttgcattttccaccaatgttagattttgaatctcgattttgtgatgttacatatttagttataaaattatgtggtatgtgtaacaaagtttctagactttagtaggtacttaataaattcagtttttatgtttggggattaaaatattatgagctttctctttttaattgtagcatatttggtgtgtaggttaaggatgatcagaactaacaaaaggggtaaaaagcatatataaaaatcaattaaatgaacaaatttctgtgcttgaaaatttaatgaatcctttaagaatttccagagctataatggcccttggagtgaaacttctgaagtcatttctcattggtgtatatttcttaacttattaatatttcagagaactatactgctaagctctaggtttctctacatgttccttttttagatttttttattttgttcattaataacatattttatctgatgagtaaaccaaaacacattgcatattaaggtcactgacttatcttttgttataatatctaactttattataagccagggtaactttactttcttcaattaaattttcaaaaacacaaacaaaaaaaaacccattaaatgtggatgtgttctttgactttgcattctaattcacttttatgacttactttcttttccattgctgaacttctttccttcttccttccttcctttcttccttcctttctttctttctttttctttctttctttccttctttccttccttccctccttccctccttccctccttccttccttctttctttctttctttcttttctctctctctctctctctcctctcctctcctctcctctcctctcctcttcttttcttttcttttctttctttcatttttttaagatggagtctcgctctgttgcccaggctggagtgcagtggcacgatctcggctccctgcaagctctgcttcccgggttcacgccattctcctgcctcagcctcccgagtagctgggactacaggcgcccgccaccacgaccggctaattttttgtgtctttagtagaaatggggtttcaccgtgttagccaggatggtctcgatttcctgatctcgtgatccgcccttctcagcctcccaaagtgctgaaattacaggcgtgagccaccgcgcctgtcctgctgaacctatttctaatattgcctttccactgtgctgtgtatctattagctgcttctattttatctcaggttggaaaatcagataaataagcttggaagacttgtgtgacatttaatgctaatgagacagagtagaggtctaaaataaggaatcattttttctttccacagatatttgttcggcagctgcatttgcagtccgccctttgtctgcaatatagtccaggcaaaatacatcatgctcatggttaatcacaatattgagaaggccccagcatgttatgagacctagcataatctgggtcatgtggtgaagcttccacaaagaaggaatatttcagttgagatctaaacaatgaattcaacctaggtaaaagaaaaagaaaagtggagagagaaaattccaggctgtcagaatcatctgttcaacatctttgtgattaataaagagtcctcttaaaaggctggtgtgtctaggacatagaagaccaataaatgtatggtatgagatggactgggaagatagaagggaggaaatcacataactactcagggatttgtagtctatggtaaagattgtaattctgaaatcagtgataaatctgacagagttttaaaaagaggaagtaagataagtttaaaaaccacagagaagtaaataaatacatatactaaatctcactaaacccctttcctagtttcaatgctcttattgaagagattttcagtttttcacatcagttttgtcctactaaaaatagatgtgttgccaagagtgatatacctggtactccaagtcataccaattgattgcagttactagtgagaagaaaagtcttctattcttggtctaacaaagtaaaagatgtaagaaaatgtcataatttttgtgttaagggattctttttactaattcatcatccaattttgttctagagagtgaatttgtcacaaggctcattttggataagtaaagtggtctgatatacagtcatgccttgattgatgataggcatagtttctaagaaatgcattaggtgattttgtcattgtgtgaacatgattggctgtacttacttacacaaacctagatgttatagcctgctacacacctctgctatatggtatagcttatttctcctaggctacaagtctgcacagcatgttactgtactggaaattgtagccaactataacacaatggaaaatatttgattatctaaacatggaaaagttatgataaaaatactgtataaatagtaagcagtggtacaccaatgcaaggcacttacaattaatggagcttacaggaatggaagttactctgggtgagtcagtgaatgagaagtgactaaatgtgaaggcctaggacattactgtacattactgtagactttataaacactgtacacttcatcacaataaatttattaattttttcttcagtaattaatcttagcttactgtatctttacttaataaacttttatttaacttgttgactcttttgtaataacatttagcttaaggcacacattgtacacctgcacaaaaatattttctttctttatatccttgttctataagttttttattttgttaaatgtatactttttaacatttaaatttttttgttaaacacattttagcctagggctacacaagatgtggatctatatcgctgtcttccacgtccacgtctcgtcccaatgaaaggtgtttggggcaatagcacacatggagctgttgtctcctataataacaatgccttcttgtgcaatatctcctgaaagattggcctgaggctgttttacaagtaaatttttaaatatttttaaattttaatatttttgggtacataataggtgtatatatttatggggtatgtgagatgctttgatacgggcatgtaatatgtaaaaatcacctcatgaaaaattgagtctccatcccctcaagcatttatcctttgtgttacaaacagtccaatacacttttttagttatttttaaatttacaattaaattattgttgactatagtccctctgttgagctaccaaatactaggttttgttgcttctttcttactaatttttatatccattaaccacctccctccacccccaactacccttccaaggcttctactctctatctctgtgagttcagttgttttaagttttagatcccacaaataagtgagaacatgttatgcttgtcttactgtgcctggcttatttcacttagcataatgagctctagttccatccatgttgttgcaaatgacagaatctcattttttatggctgaatagtactccattgtatataagaaccacattttttaaatgtagttacctattgatggacactttgcctccaaatcttggcttttgtgaacagtgctggccaaacaagggagtgcagatatatctgatatactgattttctttcttttgtgtttatacctaaaatttgaatttctgggtcatgtggtggctctatttttagttttctgaggaacctctaaactgctctccatagtagttgtactaatttacattcccacccacagtgtaagaggattcccttttctccacatcctctccagcattcattagtgcctgttttttggataaaactattttaactggtgtaagatgatatctcattgttgttttgatttacatttctctggtggtcagtgatgtttagcacctcctcatgttcccgtttgctatttgtatgtcttcttttgagaaatgtctatttgatatttgccaattttaactgggttatcaattttcctatatagttgtttgagcttgttatatattctggttattaatactttgtcagatggttagtttgcaaatattttctatcattctgtggattgtcagttcaatttgttgattttttcctttgctgtgcagaagatttttaacttgatgtgatttcatgtttccatttttgctttggttttctgtgcttgtagggtattactcagggaacttttgctcagaccaatgtcctgcagagtttcttcaattttttgtagtagtttcatagtttgaagtcttagatttcagtctttaatccactttgatgtgattttcctatatggcagtagataggggtcaagtttcattcttctgcatatggatatccagttttcccagcgccatattttaaagagactatcttttccccaatgtatgtttttggcatcttcattgaaaataacttcactatagatgtgtggatttgtttctgggttctctattctgcttcattagtccatgtgtctgtttgtatgcccagaccatgctgctttgattattgtagcactgcagtgtaatttgaagccaggtaatgtgatttctccaggttttttttgtttgtttgtttctttttttgatagctttggttcttctgggtgttttatgattccacatacattttagaatttttttctatttttgtgagtaatgtcattggtattttgatatagattgtattgaatctgtgaattgctgtgggtactatggacattttaataatatttattcttccaacctatgaacatggaatatctttccattttattctttgtatgctttaaattctttcatcagtcttttgtagttttcattctagagatcttttgcttctttggctaattcttaggtatattattttatttgtggctattgtaaatgtgttgaattttttatttctaaaattttttatttttatattgattttgtatcctgcaactttcctgaatttgtttatcagttctaatagatttttgatagagtctgtaggtttttccaaatgtaaggttataacatctacaatcaaggataatttgacttatttctttccagttggggtgctctttgtttctttctcttgtctgattgctctgcctaggacattctgtactgtgttaaacaacagtaatgaaagtggccatccttgccatgatccagatataagaggaaaggctttcaggttttccccattcagtataatactagctgtgggtctgttatatatagcttttattgtgttgaggttagttccttctaaacacagtttgttgagacattttatcatgaaaggttgttgaacattatcaaatacttttacaacatcaatggaatttatcatacagtttttgcccttcattctgttgatatgctgtatcacactgattgatgtgcatatgttgagatttccttgcatacctgggataaatctcacttgtcatattcaataatctttttaatgtattgttgaatttggttagctagtattttgttgaagatttttgcaatgatatttatttcatcagaaattttggcctatagtttttttttatgtctttgtctgattttgatatcaggataatactggcctcatagaatgagttttgaagtattctgtcttgttttatttttcagaatagtttgagtagaattggtattagttctttaaatgtgtggtagaattcagcagtgaagctattgggtcctgggcttttctttaccgggatagtttttattacagctttaatcttgttacttgttattggttgttcagtttttttatttcttcttgcgtctattctggtagcttgtatgtgtctaggaacttatccatttcctctagattttccattttattggtatatagttgttcatagtagccagtagttatcctttgaatttctgtggtatgagttgtaatgtctcccttttcatctccacttttatttatttgggtcttctcctttttgctaagtgagctggttaaaagtttgtccattttgtttattttttcaacaaacaaactttttatttcattattcttttgtattgttttcttcattggaatttttttttctgctcttgtctttattatttattttcttctacaagtaattttgcgtttggtttgctcttgcttttccaggtttataagatgcatcttttgattatttattttgaaattttcttcttttttgatgtaggcacttattgctataaatttctctcagtactgcttttgttatatcataggttttggatctttttgaacttccttcttaactttttcactgaaacactggatggtcattcaagagcatatattttaaatttccaaaattaattttttattgatttctagttttattccattgtggttagataagatgcttgatatttcaatttttttgaatgttttaagacttgttttgtgatctaacacatgttctatccttgagaatgttccatgtgctgaagagaaaaatgtgtattttggccgggtgtggtggctcacgcctgtaatccaaacactttggtaggctgaggctggcggatcacctaaggtcaggagttcaagaccacctgaccaacatggtgaaacccggtctctactaaaaatacaaaaattagttgggcatggtggcacatgcctgtaatcccagctaagcagaaggttgaggcaggagaatcacttgaacccagaaggtggaggctgcagtgagccgagatcacacagttgcactccagcctgggtgagagagccaggctctgtctttaaaaaaaaaaaaaaaaaaaaaaaggagaagaaggaaaaagtgtattttgcagctattgaatgaaatgttctgtaaatatctattagatccttgttgtccatagtgcagattatgtctaatgtctctttcctgattttctgtcttagatctgtccaatgcagaaagtagggtgttgaagtctccaactattgttgtattggggtctatatctctctttatcgctaataatatttgcttggtatatctgggtgttccagtattgggtacacatatatttacaatcattttatcctcttgctgaattggcttcttttatcattatataattaccttctttttctcttcttacagtttttgtcgagaaatccattttgtcttatatgagtatagatactcctgctctttcgttggtttttattggcatagaatatatttttccgtgcctttactttcagtcgatgtgtgtctttataggagaaatgtttcttatagccaacagataatttgtctttttttttaaatccattcagccatagccattctgtgtcttatgattgaagcatttagtccatttacattacaagttatcattgataagtgtggacttactcttgccattttgctgtttgttttctgatgattttgtggtcttcacttccttcttcctttcttacaatagtggaggtgatattcttggcagtaggatttaatttctttcttttcctttttttgtgtatctgctgtaattttttcaatttgaggttaccacaatgcttgcaaatattatcttacaaaccattatttcagactgatgacaattttacactggttacataaacaaacaaacaccaaaaagaaacctaataaaaattctacacttgaaaatctccccccgctttttaacttattgctctttctcttgatgtcctattatactgtctatgttttgaaaagttattgtagttattattttggattgatttatcatttattctttctacttaagtcaagagtaatttataaatcaccattacagtgctacactgttcagtgtttttctgtgtgcttagtattaccagtgaggtttgtatcctcagataatttattcttgctcactaacaaccttttctttgataggtctggtattgatgaagttcctcagcttttgtttatctgtgaaggtctttatttctctttcatgctcaaaggatatatttactggatacactattgtagggtaaaagttttttattttttattttttccttcagcactttatatgtgtcatgccaccctctcctggctgtaaggtttccactgaaaatctgctgccagatatactgaagctccattgtatgttatgtgtttgcttgtttgttctcttgctgcttttgggatattttctttatccttgacctttgggagtatgattatcgaatgcctcaatgcccgttggctctgagatgaatacttgttttctgggacgcacttgtaaggaagcacggaagagaggtctgtgcataccgacatgcttacctacaatgcagatgcaactaagtaaaagctgccagatttaccacgtgaaggtacaagttgcctggttgaatttaaatttcagataaatcatgaataatgtgtagtttatgtaattcctaaatatttcatgggacatactcatactaaacaatgtaaattcaactgggcatggtttactttatttgacaactttgaactgagtcttcagccagtcctactgggcatctttcagagttgtcccaaattgaggcaaagcagttgcatctttgtatcactacattagccagctatgagtcaatggatgctctccgaaaggagacaccgctttgggcaggttagttcattttagtttgtcttagggcaatatttcgtgaaaggtacagatgtgaatggtcagctgctgatatcccctatgagtgtgggattgatgtgttcccatgaagatgggatctggatgatgaaccacagtgtctagtacaataatttctcttatatcggcttcaagagtaacatttagttaatgtttctatatcctagtttttaattttgttgtttttgttgttttgttatgactttgttttcttaacaattgtctacttcagtgtttcttatgctgaggaattgtagctactcatactacagagtaatactgagcaattgtagctacacatgacgattgcaatttcaaggaaagggaatttatgctgaaatatttgaataactttccctctttagtttttactaggtcaaaaaaattgatataaatgtgtacctttacacagttggtctactgaaatttttggtgaaactaaaacacattaatacctttttattgtaaaagaaaaaattaaatagatttatgtacagagacatctattacaaaaaatattttaaatgaccctacactgtatttgcataaaatacttaatttgtcatttccttagaaatgagaggataggggccaggcatggtggctcacgcctgtaatcccagcactttgggaggctgaggtgggcggatcacctgaggtcaggagttcaatacaagcgtgaccaacaaggagaaaccccgtctctactaaaaatacaaagttagccggatgtgatggtgcatgcctgtaatcccagctatgcaagaagctgaggcaggagaatcaattgaacccaggaggcggaggttgcagtgagccgagatcatgccattgtactccagcctgggcaacaagagcgaaacccagtctcaaaaaaaaaaaaaaaaaaaaaaaaaaccagaaaaagagaaagaaatgagaggaaaagtctgaagaaataaggagaaataagataaataagatagcttacttgagaaagaaacacaaacaaacttgatagctgtggagtatactagataatccataatgtgaacactcaggtttgaggagattctatatagcagaaaaggcctatcttcacaaaaatggtaatttgatagaatatctaaccttatcttgatatggttattaacgttaaaacatggaacttttaaaagaccttctattttgtcaaacatttacttaagcaaagcatgttgcacagtgcctggcacttttaaatactcaacaaatattgcttttgctattctttttttttttatactcatgggaaaactattttaaataatccataattgcttactatgtattttcaagttaaagtatttaaaagtagatagattttgataactgaagataaaataatagccctaaaacaggaaaagtgaatgtaaagttgctatcttccagggctagagaggtatgatgtaagacagtaggggccgtgtaaaagtggagactgtgtattcaactttaagatattcaaattcaatttaaaaaaaaaatctaattttcaggtagctagacttgagtcgagacaaacagcagatctgaaagacaggccatgagagacgtgtgcaaatgttatagtgtaaaacaggggtcccaacccccaggccacaaactggtaccgttccgtggcctgttaggaactgggccacacagcaggatgggagaggtggatgagtgagcattactcctaagctctgcctcctgtcagatcactggcagcatttgattatcatagaagcaccagctctactgtgaactgtgcatgcaagtgatctaggttgcacgctccttatgagagtgtaatgcttgatgatctgagtggtggaacagtttcatcccgaaaccttccccccaaccctgtccatgaaaatattatattccgcaaaatgaatccctggtaccaaagaggttggggaccactggtataaacaaaattaaagcagcattaaattcgaagatgtcttagatgttattttcttgcaagagacagaatcttacttaaatttccttagtaaaacaggagcttaactgagaggatacaagaatatcttgggctcatagtaaataggaaatcattagatagctgtttgttttatgtctagttctaaagctgcatggtttctagtccccattcacctgtttatcatcttctctgatagagattaatgtggaaggctcttattatttgttgcctttaacttaagtttatccatggctttggactgctgtgactattctggtccaatgctattagacttctcagttgaaatgtctataattaacatactagaatacttcattttctaaatcaaaattttgaaaaaaagcctcatgtattatatgcttatccttgagttaagtatccattcctatgttactgagctgtaaccagaaagaaaggtcatgtgtcacaaataggacttggtttaaactctctgctttatcacaatgccagactgatatttagagcctctatatgctgaaaaccttatgacattccttcattatgcaattcaaaatgaaattattttgaatctataaaaaaatacatgctgaagctaaacagccaattctagtttacaaagttcaggataagaccattgtcttagtccattttatgttacttatagcagtatatccaaagctaagtaatttatacagaactgaatttattttctacagctaaggaggcttggaaatccaaggtcgatggggcatatcttttgagagccttcttgcttgtggggactctcagaagagtcccaaggtagcacagggtatcatatggcgagagggctgagaatgctaacatgctagctcaggtctatcttccccttcttatatatccaccagtttccttcccaagataacccattaatccactcacgaatggattaatccactcatgagggaggaactttcatgatccaatcccctctttaaaaagtccacttctcaatattatcctattttggattaaatttcaacataagttttggagggagcattcaaaccatagcagccatgaaagttgaacctttctaattctatgcatggatgtttacatctggtatcctaaatgctgaagcacattttcaacctacctgttgaaaaagcacattttcttttcttttttttttttttttattatactttaagttctagggtacatgtgcacaacgtgccggtttgttacatatatatacatgtgccatgttggtgtgcttcacccattaactcatcatttacattaggtatatctcctaatgctatccctcccccctccccccaccgcttgacgggccccagtgtgtgatgttccccttcctgtgtccaagtgttctcattgttcaattcccacctatgagtgagaacatgtggtgtttggtttttagtccttgtgatagtttgctcagaatgatggttaccagcttcatccatgtccctacaaaggacatgaactcatcattttttatggctgcatagtattccatggtgtatatatgccacagtttcttaatccattctatcattgatggacatgtgggttggttccaagtctttgctattgtgaataatgccacagtgaacatatgtgtgcatgtgtctttatagcagcatgttttataatcctttgggtgtatacccagtaatgggacagctgggtcaaatggtatttctagttctagatccctgaggaatggccacactgtcttccacaatggttgaactagtttacagtcccaccaacagtgtaaaagtgttcctatttctccatatcctctccagcacctgttgtttcctgactttttaatgatcgccattctaactggtatgcgaaggtatctcattgtggttttgagttgcatttctctgatggccagtgatgatagcattttttcatgtgtctgttgactgcataaatgtcttcttttgagaagtgtctgttcatatccttcacccactttttgatgggtttgtttttttcttgtaaatttgtttgagttcttcgtagattctggatattagccctttgtcagataagtagattgcaaacttttctcccattctgtaggttgcctgttcactctgatggtagtttcttttgctgtgcagaagctctgtagtttaattagatcccatttgtcaattttggcttttgttgccattgcttttggtgctttagacatgaagtccttgcccatgcctatgtcctgaatggtattgcctaggttttcttctagggtttttatgattttaggtctaacatttaagtctttaatccatcttgaattaatttttgtataaggtgtaaggaagggatccagtttcagctttctacatacggctagagcacattttcaacccagcatgagtcaatcatttgtttgagctaaatctcattctgtctctcaaacttttttcccaaattcatgtcatccctctgctaacaaacaaagagaacaaaggtttgtagatgtttcctctcccaaaagtagggtgtgaataactgctttaggcagaggtgatcaaagtatgaccttattgagcactttttttggcttcggattagggtttcaacaagttcagacttcctgtggctgcctcaccatgtctaaagaaattgtgaatgatccatctccttactgtgattccctacccacccactccaatccaactcttctttctatctcttttcaaaatatttctctaagacttttcttagacaaatatgtcttccctctcacctaactccctttcgttagtaagttatgtgtatgtcagattcttaatccattcaaaaggaatgatggtaaagaataaaagaataatagtaagtattaaactgtgccatcttgcccttctctctccctgagaatcttttgctaatttagtaaccagggaaattattgcaatatctcctagtgatctgctggcagggggagcatctggtttgggtaagtcaatccctgactgtaaatatggcctggtgaataactaaatatcaataaatttcaacctgctgcaggttgctgaagttttatagaaacttagaagagcaaaaagccaccataaatttgaggagtaaccttaggcttagagaaaaaactggctgtatctagctgtgaaacaaaacacataatacttatacagtgaaacaggacttcaaaagagatattaggcaaatgagatttatgttccatatttttgtggttaattattccatgttgctgcttaatacgttttctattttttaagaaatacaattcaaaatgaaagttttgattatattataggctattagcacatgctcagaattttcagaactggagttctctgctgccctaactgacaatgacaaaatcaagtgtagaaacttaagcttatgttgatttcataatgctggtcaaattcaatcaaaattagtaatgtaatctttgagtggttactttatatttgtgattctcaagccgggacaattttacttttcagggaatatttgtcaatgtctggaagcctttgcaattgtcaaaacttggagaggaggaggtacactactggccagagacactgctaaacatcctatggccccctctgcattaaataattgtctgacccaaaatgtcgtagtgccgatgttgagaagctgtgctctacattcttcttgctcctttattaaatcattactatgtgtgaagtgactgtcacataactagtagtaaacaatattttattgaccacttatcatgtgtcatgctctattctaggaactacatacattcactcaatttatcctcactatactacaaaatagggtaggctataattccattttacagatgaggaaattgaagcatagaggaggtaacatccacaatcacatagcctgtaaaagataggtcttgatttatagtcagataatttggttttagaatcccatcctctgtggtaaaggaaatcaagtgctgcttattatttcccttgactttctcctatgctcttgcaactctaagaaaatgacctcggcaaatctcaatctatccaataattcataattctgggagctccacagaaaataaaagttatttatttatttattgctgtatgcattgttctgccacaggtataatcaactttgtctgcaaagttaaaatttttaaaattaaaggattaacaatgccctccctaaatatatatatatatatttttatatatatatatatagtgtatatatatatatagtgtatatatatatatagtgtgtgtgtgtatatatatatatagtgtgtgtatatatatatatatagtgtgtgtgtatatatatatatatatatatacacacactacacatgtacctatataaatgtaggccctaacacaaacctatatagtgtgtatatagtgtgtatatagtgtgtatatataacacaaaaatatatatagtgtgtgtgtgtgtgtgtatatatatatatatatatatatgtatatatacactacacatgtacatatataaatgtaggccctaacacaaaccattgaagtttcacaggtcaaaaatttaggcaggtatgtagtttgtaggcatcttatacgaattagttaacatactacttcttttatttttattataatataaactatattcattttataatatacataaataaaaatcaaatgctaaatataataaagtttattttatatagtccagctcactaatgtacactaatggttcaatgataatattaaacttcattttattttattacatttagatgcaaactccagccaggattcacatattgatttcatgttctagtaaaacctacaaataaaaaaactacagagtcagagattatttcttaatgtatttcatatactctcatccaatttaagtcatttcatgacattttagctttttttgtcatagtgatctcgtgttttaatggaaaatagtatgggacaattttgttttgttttagatgtaatattgaaacgtaaaacttcactaataattgctgcaaatacaatacaatacaataagagaaagtactattatttattgaggcaaaacataatattaagtaactgaaaatggtagaaagctatagggtatgataataatgcaacatgcgaagcgaaaagcttttttcgtggtattccaggttgagggagacattcaaatgcctattaaagcctatctctaccaatgatcacatttatatggttctgtactggcatgtttcctgaagtctactcatgccccactggtggtaaaagaattaaatatttaaaaatatttatgcatatcatatttattagaaaaaaatactgatttccatttatgttgagaatgtcagcaaatccaatcaactattctcagtatttccttttttcttcatctgttgctataatcagagtcccagccaacatcatctcttgcttataaatgtgcaattatttcccactatctcccctttgctttcatttctgctactttatgttctattctccccagagtaatcaaagggatctcttaagaacttgtcaaatcatgtcactcctctccttaaaacaactcatgccacccattcatttagaccacacccaaacatcctagtttgacctgctccatgaatcgtattcagatctcatcatttatatctgtactcccaattcacttttcttgggtgaaataatctttttgttgttgttgttcctcaatcatcatgagctccgtcttgcttaaggacatttatactagctctttttctggaaacatctttttcccaaatattctggctaattctgctggaggtttcagcttaaatgacatatctttggcatttctcatgaagtaaaatacaagctccacaagacaaggctgcaggggaagttaggaaggaactatttttccggtttttcattctttgaaataaagcattatgggcaacatattaacaatttaaatataaaagtaataccatacatcttcatttcacattttttctgcaattattttatatatacctaccatctaccactttctatttgctaaaaatttctcaacatttccatgtaagcaacatgcatattaactgagttgatttttctgtgtgaaattctattttataatccagagtggttcacttgcaccttttatttccttaaagtcctaagataaacagttgcaaagagacagactctttgaagctcctaaacatacttctgctctctacatcctaatagcccagggagagcttttctgcattttctctattcaggttccttttgttcttcctaagctttgtagtaaaaatctgcactcatgttctgccatctgcttttagtatattttaaattcaccctccaattgccattttactgattattcccagaaggataaagccatttttagtaaaattctgctttaaggggaattgatagttggggagaaataactgcacattgttgaagagtatttattagagcacacttctattgtatttgagcagagaaatgcattactaactggaatgtcttgagtcaagaatttagcaagtttttggaaaagactttcatgaggtggaacagaaatccacattaagttcttgaacacacaagattgagttgagcaaatcaatcagagtttgacaaattaaagcaatgaatctagttaagataatgaaataaattaatcccatttgcctcatataagggcttgaaagcagaaataaatgcaaatgaaggaattagaggtagagctacacaaaattgctggctctataatggagaaaagccaagaagaattttagataaatttgtttgttggacaaaatactgcttatgaaagaattggagttggatttgagttgttgatatataggtgtgaatgtgtgtgtgtgtgtgtatgtatatatgtatatgtatatgtggattctagagatctagaacttaaattgttttgacagaggatatagatttttgccaaatgtttatttaatggcattctaacaatatattataagtgtatgagaaagcgcttctcccatatattcccttgggagattatcagttgtattgaccttttctaatttaatagataaaataactactataataaaatttttattgatgtacttacagattaaacagttttaatattggtttttatgtgtttgtaaattatctctcatagctattgccactcctcaactttttaaatgtttattaatttgtaaaaattctctacggacatcaacccttgaagtgaatgttgcaaatatttcccaatgcatattattgtcttttagctttgtttagaataaatttttatatttttacctataagacttacaaatatttgttgcatcaaacttatttatgatttatatgttggtcatttttcaataggccttctcacccccaaattattattattttaataatagtctttaaaaaatcaaataatatatgtattagctattaagtacagttagattttttgactaatataataaaaaagttacaaaatgataaataataaagttatgggtgattgtacaatgttatgccaattttccataatgttctaatactgtaatttgtcttctgtcataccgaatgtaattttacttacactacaaattttagataagagtagattagagtgaatgaaggctggatgaacagtgatactatacctaaacataggttctgtgcattttaaggataattgcagacatttgaatactggcaaatctttgttatatttaaataaaattaatattaatatctataattttagcttatattacttttgtcttttatttttaaattatgtatacacatatgtacataatatgactacaaacagtcaaaataatataaccaattcccatatacacaccatttagtacaaaggatgaaacatcagctgtaccattcaagtactctgtgcaccctgtcttaattgattttaccttctttcccctcaaaatattatcctgattttccctaacctgttatcttaaacagttcttgaaaaagctgactgtggctgggcacagtggcaattgtggctgggcacagtggctgggcacctgcaattccagctactcagaatgctaaaccagatcttttcgggccagtagtttgaagctgtaacgcactttattgcacctttgaatagctactgcattttagcctgggcaaaataataagaccctctctacaaaatgaaataaataaacaaatagcatgtgtacctgtgaaccataaccactctatttatggagaaaataacacgaggtaaaatattgaaatgtaatacagtcatagcattgtgaatgatcaaatatttttaatttaaatctggaatttatattgtacttgttacttagaaatgaattagtagcaattatcaggaattaagatatcaaaaagctatccaaagtttgttaatatttgtgataatattatttcaaaagacaaataatgttaatatacattctcccattctatatttgattaataatcgggtgaaataattttattacatcaagcattttttcctgttttgctagtgctatgaaatagtaaacattgttaaatatctctatatcattgaaaagaaaattattattattctgtcacagcagaaacagcagaatttgcaattcagcacccaagactatgtgaaagggtcagataattatttcttttaatctcttaaataacttcttttctcttggttttctattctatcactccccatttcgtcatttatgctagactaagatctcagacctcttctgtgagagaaaagtcccagtatttaaaaaaaattccaatttggataaatgcaaatcagtatacaaattcctaaagtagatcgacgtaagtgtaaactgaaatgtaattctttaatagcagcattggcgaataacactaaaaaattttggttgctggatgaggtagctcacatctgtaatcccagcaccttgggagactaaggtgcgtggatcacttgagcccaggaattccagaccagcctgggaaacatggtgaaaccccatctctacaaaaacatattaatgggagaaaatttttgcagtctcccatctgccaaaggcttaacatgcagaagtcacaaggagcttaaacaaatttacaagaaaaaaacaaccccatcaaaaagtgggcaaaggatatgaacagacacttctcaaaagatgacatctacatggccaacaaacatgaaaaaatgctcaacatcagggatcattagagaagtgcaaatcaagaccacagtgagataccatctcatgccagtcagaatagcgactattaaaaagtcagaaacaataggtgcctgtgagactgtagagaaataggcacacttttacactgctgctaggaatgtaaattagttcagccattgtggaagacagtatggtgattcatcaaggatctagaaccagaaataccatttgacccaacaatatcattactaggtatatacccaaaggaatataaatcattctactataaagacaaatgcacatgtatgtttattgcagcactatttacaatagcaaagtcatggaacaaacccaaatgtctatcagtgatagactggctaatgaaaatgtggtacatatacaccaaggaatactacacagccataaaaaagaatgagatcatgtcctttgcagggacatggatgaagctcgaagatatcatgcccaacaaactaacacaggaacagaaaaccaaacactgcatgttctcactcataagtgggggttgaacaatgagaacacgtggacacagggatgggaacaacacacatcagggccttttggggggtggggagctaggagaggcaacttaaaggacgggtcaataggtgcagcaaaccaccatggcacacgtatacttctgtaacaaacctgcacgttttgcacatgtatcccagaacttaaagtaaaaattttaaaaattttatgtgtatatatatatttagcttggcatggtggcatgtgcctgtagtcccagctactctggaggctgaggtgggagaatcacctgcgccagggaggtcaatgctgtagtgagctgtgatcacactactgcactccagcctgggcatccaagtgagaacctgtctttaaaaaataaaaaagtcgattttttaaaaaatattatacctattcacctccttaaattcactttatattttcagttgtcattggaaataccatttggatcaaatgatttgtatgggaaaatcacatgtagataaattgtcttttacccaatcgagatcatacaacatttcccattttatttctcattttgtcatttttgtttatgtcaataaagtcacctttctaccatttctaatattttcattgtttgtctgtcacactaaatttacctttatatcatccctagtggccaatataatatgtggtatatagattgtaataatacattttataatctttgaatttttttgattatgttcaactattttcttttcacatatatcacatctgtgaatattatttaaaataattttgcataaatacttaactattttctaaattactttcaaataatcccattgctaaaatttgagaatctcctgccttcttgacaacatggaatatttattttcttctttctacctttttttcttctcttgttacttactttagtacttctctctttttattacctccttctctgtctgatttttttaaactattgactatttttaaaaatttcttcaatttttcttggaacatccatattttttaattgatcttgaaacttttgtttcatagtaatactaacctttgtaattagtgtgacaaaaatgtattgcacagtttgaaccccttttgtggataaagaccttatcaataattaagctgtgacaataggaaaaaaacaaacatattaccacaatttaaacatataccacaatgtactttcttatcatattttgaattttttcataaatactttagaggtatagattttaaatatttctatgtgaaatatgaaacattttaaacatttctatgtgaaatggtatttctggttgaatatttttcctttatgtaacttgatatcacatttcacgttttaccacatcaattgatgcaaatacttaccaattttttttctaatacgttcctggttttatgttgttcatttaaatgaaataaaattctatttttaatctgcttttaaaataagaactctagtatgattttaattctttttcttcaagtgccagcctaaatcttatatcatggtattaaagaacattcagacaacctggctctactacttactattgctgttgctttcagcaagtgacataaactctctgggcttcgttttctcatgtgttatataatgctgataatggcatgtatctaaaattataaatttaaaatttttaacttgtaagtctttgtaagattgtaaagagacttaaatcagttaatattttcatatagcctgacgtatagtaaaaagttgacaactgtgttttaaataaagtatcaagtattcactgactgaaaattctaactttatcaaaaatttaatttcaaaataaatgtaatatattcttccatatttgtatacctacttctgttctgtagcccaatattatgtttgtcattcattataggagaactctgtcttaataactttctttttatagagttacctggtgattattcacatttattccgtcatgtaaacatgccaggtccaaaaccctccaaaaatgtttgattggaattatgttaattttgtagattaatgttaagtttgtagattcgagtaaatgaacacgtttgtaatattcaatcttctcattcaagataatgatatgtctttcatttgattcaagtcttcagtttttggccttctaggacatgttattgtttcttcttatatctcctatgagtacatggtttcaaattagttcatgtcactattataaataggatcattcttcaattttcttttgtagtgttttatttgtgtaaatttaaggggtacaagtgttgttttgtcatatgtatatattgtgtagtagtgagaggctgagagattgctttatgggtacaacgtacactatttgggtaatgatttgggtgatgattaccaaatgtccagtgtaatcatcacccaaatagtgtacattgtacccattaagcagtctctcatccagtaccctcctcccaccctcccattcttctaagtctccaatgtctattattgcaattgtaggccattatcgtatgtgaaataactcagaaacagaaagtctaataccgcatgttctcacttataagtgggagctgaataatgtatacagacagacatagactatggaataatttctcatttttttaaatgatgaaatataagaaagttaaacattttttaatatttattggtcagctggctgaattatgaaacttacattgattcccaaaaaggcttttttaaaaagctgattacttcaatttctgaaatagaaaatctcttcatgtagaaatatgatcaatagatctcttactttttatcatatttatacttgtttcatttgttcacctagagaatgagctagcactaaggttttgaaatagtagtgtacataaaatcaccttggtagactgttgattatatagtttcctgaatattgttgtcagaggtggagatgcaggaagtgaccccaggaatctgaaattttaaacagcaactcagatgacctttgatcaagtggttcctggacttcactttgagaaatagtgccttcagattcacaaaccaacaatcacaaagagctgtaatagatagccaaccatgtattattatcattaaattggaaggcccttcgttacttgtctattaaaaaattttgctattcgttgagagagagagagatgctatattgtatacagaccattcatttatttaacaaacaactagaatacaatactatgggccaggaaatttgctagactttaagtttcctgctaaacatatgttcatgctcccttctttcgtggaatacaaagttcagtaagcaagtaggtaggccatggccaggtctgcctttcttagtctctcctgtgtgcatcaacaggctgtgtagccttgcacacatgcaatatgatagcacaagtgttgcctggtccttatcatctagcttgtacataaacaatgtaatggccaggcgtggtggctcatgcctttaatcccagctactcaggaggctgaggcaggagaatcccttgaaccagggaagcggagattgcagtgagccggggtcacgccactgccctccaccctggctacagagcgagactctgtcgcaaaaaaagaaacaacagcaacaaaaacaatgcaacaaggtaatgttggtagcttggaaactggatggtagatccaagtgaagttgcttgttgtaagtagccagtaacagtcattaatgctagaatttcagagtgctgtgtttgaggacaatagaagttagaacctggaaggatctcacccttaataggcataataactactatcacaactaacttcggtgtatgtcctctgaggaattgagagaacagagatgtcttggtcatccaaattccccaacttgaaattgactgaaatactttgcggagtattaatctttaggcattttagagaaaactacaatacctgtaagatcaacttcttttgtgaaacatctcttgcaaaagctattttaaagatgtaatattcaagcaaacatacaaaggtggaagttcctttagtaacttctgttttacttaacatatatataattttaaatatatattaaaatataaatatatatttaagaagatgtatatttttaaataagatatttattttttaattttatcagatgttttcccttacatttgtttttcagtttgtttactgacctccatctattgtcagttcctccatctattgtcagttcctcaggctcttttgcccatcacatgccttcaatctataatgcacatttctctacttaccatcctagaatttgccttctttaatcatttagcatgtgcacaggtcaccctaagtagtgaataaactacggacatagccccaaaaagctaaatattcaaatttctatactccccagttgcctttaactgaagtagaagtaagaaggagtaaaagagaataaattaaataatctagtcaaagtaatgaggatatgctgatgataaggccatcgtgccctcagtattagtctctctgacaagttgtatcaattcaactaagcttttaatgtgagtgctgtgtgacaggcattttcttgtttactggagacatagcccctgtaattgaggaattcactgtctagtcttatatcaaaagtactgatatccagaaataaacaatatagaaatacactgatcattatggtagcagcaaccagcacttattacgtgtttactattttctagtcacactgcaaaaagacatatctgtagcttatcatttaatcctttaaaataaatattattcccagtttataaaccaggcactgtgggacagagagactaagtaatcttctcaggatcacattgctagtgactgatagaattgtgattcaaaccccacattctgagtctagatcgtaaggaattaacatttttctgaacaagggcttacagttatactggtcttttaattttattttaaaaagtcagtgagactacagttgtcattttttaaattctttcaatttttaattatgtaactacaaagattctgcacaaattttgggaagtggcctttaaatccagccaaaataaagactctagtgcaacaatttagaggtgcagtgggcctatatataactggaatataagcatgcctgtagttaaatgttctattcttaatgtcccaccacccacccaagcatcatgggtcagcctagatcatacctgttatggtagcggcaggtgctttttacttgaataactcccttttcataatgcatgtctgtgtgctgcacatgcacacacacaaacacacatacagagacacatacttaaactctatatatcaattctttgcaaattctaccagtaatattgtagagcagtattattccagctattcctataattgaaacctgcagagtcagctattgagcagcaaatcagggccccttattcaacaatgccagctcggtcagagtccttatcttctctcttttgctcacagtgggtctatcatttttgaaagtaactgttgccttggaacttctaatagaatcctcactaaaatttacattttagcctaacttgcaggagctttccttaaaggtttgaaaataaatataatcatcttattgtatcttcaggaggcctcctgtttccattttcctcagaaaatgtgtacattgtgagtttcatcaaaacgtgaatgagattatttgcaagtagacagcaacaggactccatgtaatttattccaaaagaagagtgtttctttgcaattatttacctaaatactagctattcaaaattttatatagtatctacaagaattattaaacccatcagttgctgttagaatattcccaactaagtattttctttaaacacaattgcctttgaaccccagcttccagagctttccagtcaagcaaagtctaaaagaaataaattaaaagccatggctgaattcaaaaccatgatctttctgcagcctgacttgttctttaggaaaggtaaattggaagctgctacatgcttttaagcaatcaaaaggacgatgagcctgaatttttccccttaggcttgtgtgcatatgaataagaactagatatgcaagcagaaaacttcttcttcaaatccatcccttcccaaattctcagaggcagcaaatattgtggccttattatcaacccagccctgttttcctgattgttttaatactgacattttgtctagattctattttaattgatgtgttatacagaagaattacagttgtgaggttctcacaaggtatagacaaaaccaggtgtgagatggtgtcttaattgcttttctgttgctgtaacagaatactgtggactgggtaattaataaagaaaaaaaatatttcttatggttctggaggcttggaagtccaagagtatggcatcggcatctggtgagggttttattgctgtatcatacatggtgagagggcagcacatagtgagagggcaagagcacccaagtcagctcacatctttcttttcttctaaagccaccagtctcaacatgggggactaactctaaagaccttatctaatcttgattacctcctccaaaggccccacctccaaatatcatcaacatatgagtttgggcatttagtttccaatacacaaaatttggggggtacatgcaagtcataacagatgagaagatggttttgctaagactgtaagaaaacagctgaatatactgtaaatagttatagcagtgaataccactatagtattttgggtaagaggttgataatgtacacagtaaagaccagctacctgtagcttttttttaatatcatatgtccctggggaaagaatcttctagttcctcatcttcaacaggatgtttttatgtgaagtctgcaatatcagttagggatattagttacaaaaaacaatataccctagcttcttcaagctgaagggacttattaagtggcataaatagttcacatatgattgaaagggtggaagaaatagattctgttttgacctgccaggaatgagatgcaaaaccacaacataactgatctgctatagtatatttggccattttcacactgctgacaaagacatacctgagactggacgatttacaaaagaaagaagtttaatgggctcacaggtccacctggctggggaggccttacaatcatggcaaaacgcaaaatacatgtctcacatggtggcagacaaggcaatgagagccaggtgaaaggggtttccccttataaaaccatcagagctcatgagacttattcactaccatgagaatactgtgggagaaactgcccccatgattcaattatctcccactgggtccctctcacaacatgagggaattatgggagctacaatttgagatgagattttagtggggacatagccaagccatatcacctaggaaatgctgcctttcccatgatccagatgcctggttccagaaagctgatgccaacattgccaactacagaaccacagctaacaccagaaccacagcacttccaccccgatttgtaactgcaaaaagtgtaacacctgtccccttcatagtacattctgaacaatgtcttatataaaaaataatcttgtcagagtaaccccaatcatacatagaatcatagctgcaattgaatcctttaagtataattttagcttctcagttatgcggttcagaaacatgtgcaaaggaggtagttggaataagttttgtgtaagctgatccacagcatctgctacacttgtcacatgctgtcacatcatgatttgtctcatacataatgatagaaataatgtaagaatattgtaaaacatgttaatagattttcttttcaaatcactttggactgataaatattataggcaaattattaaaattaaatttacaaccttggttttacacccaattatagtagttcatattttacatatatggaataattcttatagtttgtaatgagactatacatttatccccatatatttacatattatgtgagcccatttcaaagatagtacttttaagagaggaaattatatgttgtgggataacattgtcaccttcaaaacatcattaacacttctgcaaaatatagttctatatagagagaaagcaagcatgcatcaattttttttttttaaaaaaacagctaattatgttcctaaatatagtgaagaaaactcctagggttaccttagaggaagtaacttttctattttctttgcttccttttccttttttttttttttttttgacagagtctcattctgtcacccaggctggagttcagggacatgatctccactcactgcaacctccacctcccgggttcaagtgattctcatgcctcagccaccctagtagctgggattacgagagtgagccaccaccccgactaatttgtatatttttagtagagacgaggtattgccatattggccaggctggtctggaactcctgacctcaagtgatccacccgccttatcctcccaaagtgctgggattataggtgggagccaccacgcccagccatcccttttccttttttagcaagaggaattagaagctgtttaagggtcaggaaaagcaaaaaatagtgaagcacgttctcctggatcacttgattcccttgtggacacaagtgaatccttgtactcttagttttctgggtggaaaataaatcacctttagatgtctgcttgaattaagtgagaaattacaaggaaccaatatttcagcaaaaacatgtgacaaatgctttttagcttaagagttttaaaatttcagtcatatacagaataaattgaatgccataacaaactatcctggagccattatccagattaaaaaatgataatattagactattttttcaactattcctccaccaatttggaagtgaccttccatatgattattatatttatggatatttgaggttagatttacctacattgaaatcaatgaaatataccaacgttaactatacagctttgaaaagtatatacacacatgtaactgccactctgacaaggtataaaacatttaaatactctaaagagttcccaggtactcttttccaatcaattttctccatccttttccccaagcaaccactgatttgttttctatcactatagattcattttgcctatttaagaaatttttatcagtggatattgagcacttcatgtaattattacttattcatgcacattccttcaggaagtttctttcaagtgttttgtccactttaaaatttgtccttatgttattgagttgtcatagagttttgtgtatttggcatacaagtgtttgttagacacaagttctgcaaatatttttcttccagtttataattaatgtagaggtatcttttgaagaataaaagttttaaatttttaagaaactctaatatattaaagttgtcttttatggttgtttcttactgtgttgtttcatagcaggttatgaagataatcccctgttttcttctaaatactttgtagtttggccttttactcttacgtttgctccttctttgattaatttcgtgtttgttaggaggtaggggttaaggttaacttttgtttttcatatggatacccagttgtcctagcatcatgtgttacaaaggtttttcctgatccatcaaattcctgtgaagtgttagtggaaaggctactgcggttctgttttttgcctttgttccaaaaattgccaaattatgactcctgggctgtttttatgtggctcacaatctaataacaattttggcatctttaaagtattgtcaaaataagaggtagaaaaagaggcagaagaggagaaaggaggaggaagaggggcaaaaagtgacagacacctcatatgtgtcccacaaggcctgaaatatttaatatctggcccttaaggataaagttgactaattcctacctattctagtccatttatttatttatttattcatttatttatttatttctgtggctttttagtacatcttaaaatcagatagataaagccttccaactttgatcttcctttttctgcaactaattcatttatttaactgtggtatacattaatgcatagctcacgaatactgaaattcacaggtacacagacaatacacataaaaaacaaaaagacataatgtgtattgttaatactataagcccacacacaatacacacattcatatttagtacgcagatctgttccatacaataactgtttggatgtctgcctttaattcaatgttctataaggctccatctctaaccaatgtagataaactttgaaaagactgatttgggttgggccagaaaaaatacaaagaagcagaccaatatggtagaaataagaacattcttgtacattttttaaaaattgtgaaacaatacactaatactttttcttttttaaaagaattaaaaccttacagattaaaaaaaaaacacctcaacttctagccttcatgtattgtttggaagtaaccattattacattttgtatatattcttatacatctctcttttttacagttacataaatatatttgtaccactacaaatattgcatgtaatttttagtttttttttttaatttaacttttattttatgttcaggagtacatgtccatgtttgttatgtaggtaaacttgtgtcatgggggttggttgtacagattatttcatcactcagacattaagcctagtacctactagttattcttcctgatcctcaccctcctcccaccctccacccttcaataggcctcagtgtgttttgttcccctctatgtgtccacatgttatcatcattaatatcccacttataagtgagaacatacagtatttggttttctgttcctgcatttgtttgccaaggataactacctccagctctatccatgttcgtgcaaaagacatgatctcatcctttatatggctgcatagtattccatgtggtacacatggaatgtaccgcattccaagtttggtttatgtaccacattttctttatccattcaaccattgatgggcatttaagttgattccatgtctttgctactgtgaatagtgacacaatgaacatttacatgcatgtatctttgtgatagagcaatttttattccctcaggtataaactcagtaatgggattgcagggtcggatggtatttctgttctcaggtccgtgaggaatcaccacactctcttccacagtggttggactaatttccactcccaccagcagtgtataagcattgctttttttctgcaacctcactggcatctgctattttttgacttttttaattgtaataatagccattttgactggtgcgagatggtatcttattgtggttttgacttggatttctctaatgattagggatgttgagatttttttccatacgcttgttgctcatatgtatgttttgttttgaaaagtgtctattcatgtcctttgcccactttttaatggtttttttccttaaaaatttgcttaaattccttttagttgctgaatattagacctttgtcaaatgcatagtttgtaagaattttctcccattctgtaggtttgtctgttcactctgttgatggtttcttttgttgtacagaacctgtttagcttaattagatcccgtttgtcaaattctacttttgttgcagttgcttttggcatcttggtcatgccatctttgcctgttcctgtgtccagagaaatgggtttttatagtttttggttttacatttaagtctttaatgcatcttgagttcatttttgtatatggtataaggaaggggtctagttttaatcttctgcatatggcttgtcagttctccctacacatttactaaatagggagtcctttccccattgattgtttttgtcagctttgtcaaagatcagatagttggaggcatgtgaccttgtttctgggttctctgttctattccattggtctatgtgcatgtttttgtaccagtaccatgctgttttggttactgtagccctgtagtataatttgaagttgggtagccagatgcttccagctctgtattttttgcttaggaatgccttggctattcaggtccttttttggggcctgaatattaatattaaaatagaatattttatcattaataaatatgaatatttataatatgaatattaaaatagccttttctagttctgtgaagaatgtcattggtagtttaatagaaataacattgaatctatgaattactttggatattataggtattttagcaaaaataatactttctattcactagcatggaatgttttccatttgtttgtatcatctctgatttctttaagtagtgttttgtagttctttggtagagatctttcaccttcctgtttaattatatttctaggtgtgtgtgtgtttgtgtgtgtgtttgtgtgtgtgtgtgtgagtgtgtggcagttatgaatgggattgatttcctgatttggatccttgaatgttattggtgtccaggagtgctagtgatttttgtacgttgattttgtatcctgagacttgctgaagttgtttatcaatttaaggatcttatgggcctagattttgagggtttctgaatataagttcatgtcttgtgctagcaggggtagtttgacttcctctcttcctatttggatgcccctttttctttcccttgcctgagtgctctggccagaacttccaatactatgttgaataggagtggtgatagggggtatctttgtcctgtgccggttttcaagggaaatactccagcttttgccaattcagtataatgttggctgtgagtttttcatatatggctcttattagttcaaggtctattccttcaatacctaacttttttgagagtttttgacatgaatgtgtgttgaattttatcgaaagcctttcctgcatctattgatgtaatcatgtggttgctgctttaccttgtacttttgtgttatggagatggcttatttccttaagccttatgaaccaacatctacaagattccaatttttcttctgtggcttcctcacctctctcagccttcatagctatgtagagagctaggtccttgctctggattttgttttggcttaagaaaatattgtgtcttgtttgatcttctattcagatcactcaaactttctacttatcaccaataaggttttttggctttcttatcatttgtgcattcactagaatagcacttttagtttcccttaagaagtttttctttgaattcatagcttggctaactgttggatgcacgatgtctagcgttcagcctatcttggttacaacatgccttcctcattaagctcaataatttctagtttttgatttaaggtgagagatgtgcaactctttcacttgaacccttagaagccattgtagggttattaattggtctaattttaatattgttgtgtcttaaggaatacagaggcctgaagagatggagaaagatgggagaatggccagtaggtggagcaatcagaacacacaaaacatttcatgaattaagttcaatgtaatgtgggaatggtttgcggcatcccaaaataattataatagtaattaatagtaaaaaccactgattacagataatcataacagatataacaatgaaaaaatttgaaatattgcatgaattaccaaactgtgacacacagacatgatgtgagcacatggaaaaaatggctaataaatttgctatttatttgaaggactgccacaaatcttcaaacttttaaaaaaatgccgtatttatggagttcaataaactaataaagaaagcaataaaaggtggcctatctgtatttaatattttatacataaacgatcatgctgtttctaaataggagcatagttcttctttgttgttaatatatgtcattgatccttgctttatttcagtggctaggaattccaactaccatgatgaatagaaattataagattgtataatcttgccttcttcttcccgtcagctttaatttagttctgttttctttaatgtaaatattttgcttatcagattgaggaagttactttctattcctaatttgcttaatattttttatcttgaacacgtttacttttgatacatgaattttctgtgttgtttgagttatgtttttttccctcactctgttaataagattttatgtattttatacattaaaccaaccatgcattcttggtaaaaccaacttggtcataatgcattattttatagattgctggatttgatttattttctaaataaattcattaagtatttttgtatctgtgttaatgaggatattcatgtgtactttttattctttgatgtatttttgtcaggtttgttatcagggttatgctagcatcaaaaaccaaaatagtatgtgtttcctattattttttgtaatagtttgtttaagatgtgttcttctttatatgctggtagaattaagcagtaaagtcataaattatgggcatatactttgtaatttgaattgtatatgttttagacttaattcttcaatttattcaaaattgatgaaatttttattgacattacatgaggagattttagcatccttaagctactgagttttacaatccattaatatagattatacctttgtttagatttctgtaatttctttcattcatgtttcacttaattttttgcttttttccttgttcagagtcattgaatataatcttcggatatttgacgggtatttggtgtttcttgatcctattaagaatgagtatccattttagcatttcaggtttctctttgctcttagaataaggagttatttctaatgaggttacctctaccagcatttatagatttacagttataattgaaacattgaaaatatacttaacctaaaatgtcaattttttttttgaatctacaacagcataactttgcttgccctaaatctctcattttttttccaaaagtcatatacagtttttctgtgtaggtgatattgaagtcatcaatattctgtaatgctatgacaataacaaagaaaagcctttacagaaagtgaccatctatagctaaagttgtttttagacaaagccaggttttagcatagtgtagaggtgaaaggaatctacaagagccaggcactatctctgaagagcaaagacttttaaataattttctttctgtttttcacaaatgttactaaaatctttttaatttcttaattatgaatggtttcgaaaatacatgtcctgcatttaaaattactgaatacttttaagctccaaattctcaacaatgacagtttcctgtctatagctatgttccctttactacaaactagatgaacaatacctataaaaatcaagtaaggaattcaatttactgttttttatgtaaaacataatcattctctctctttctctctcctctccctctggcttttttctcttttcgtctatctttcattgtttaattttggtgatattttgctggtagatatctggaagaaatctggacacagtctgcatgttttcctctcgtctttgtcatggaaatgatactttgataatgaattaataattttcgattaactgtcactgtgcaagaatgacaaattgtatcaggctcctattgtcttttccagggcactgaaagagtacatattattcagaatattaatttcttatgcatattcatagcccaatacaaatatatattgactcaaaatttaatttaataatgacagatgacttttataaccatcttttaaaatatatatgacatagtatcatgatggaaacatgcattttataactttcaattgatgataagttagtaatgaaataattagggctagtagagtgaaaaataacaaagatagtagaagtagctttatccgtttattttctgggggtaaagaaatattttatccaccttcatgattttgattttaaactatttgttgaaagagccccacatttcttatcaacttagtccattttatgttcaattggagaatcactggcttttattggacattacacatgtattcctttctctagataattttgctaatgtgctaatccaacaaatactttatctcctactctgaaatacattagacacagaggacttctaagtttggctagaaatctacttcaatttttttccgcttggatatccttttgtaggcatcccagctgccttagaacctgggtgtcaacaaccttgctctctctctgccttattcatctctgtttcttcaacttactaaatactgattttcatctcctccaggtttgaccctggaaaaagcattagaggtaaaaagaaaagaaagggtgcattgctgtactctctaggtctgattttggcaactcctgagattgtgaaccacgtaggcagattctttggagacctccaaatttggatagctgtttctggcaattcctgggatggctggagaatttgtcttctggtcactaacttttgctgttcccgcggatgtggctgcacagcccagcgtcttactgctgaggtctcctcattcctcatggtgattctcttgggctgggcttgagatcatctccttcttgtctactctcttgcatggcccacatttgctggtgggaaatactcacttgagactcatctctagttggaatacagttatttcctaaccgcagaccattaatctgcaaaagttcttcatttagactttcaccctttaaaattgtcaagtgaaagtcagacacccttcaactaatttctctaaattctctaacttctgtaaatttagttcttttcagagaaacccacctgatgttcttgtcatcaagcttatggagaaatgcaagaagtctgatgactctttgttgataacttgcaattatcacactgtaatattgctttcctcccaaatcctcagtgtccaagctacctgagcctcccatctttaatcattatattatttatatttatattatatttaatcatataaatgttacacactgaacttcagtggcttcttttccatgtcctacaaaagttgtctgcaactctcttcactgagagtaggtagcatagttttggctgaaacagtttctttttaaatgttctgttacatgtatgtgattatgtattcaaaatggtttctaaaaagaaaatgctttccttctaagagagagttgttgagaaaatcagaaaggaacacatatatgccaagtggacatgacagaataatttgcagtataaaataaatcacttttaagaaagccagagacagtttactgtggcagaacatactgtttggtgtaaaattctatagtttagaaaatatgtttgatgtcggccatttacattatttgaactttaaggtttgtatacataccactaaaaattgtccattcattttagcagtgtctagtttaattctatcctatgcttagttcataaggcaacccggatacttggttgtctgcaaggctattgattatttctaggctaccagaatatttggggttttttttctgatttaaaacaacaaataagcaaataatccagcagcaaataaaataacctaggttctaatatcagttttttttgtttttccaggttgcacaagaataagatactatgttggggggcatttttgaagggttaaatttcacttacaaactttccttggtctaaaattgaaggtaagatcacataagtggtcttgaccttttctaaaattttcctgctgtgatagattttatcatggttcattttgtaaccaaactctaatttattagctagtattgttaggacaattttgttatataaaaaattgctagagatggaaattttagtcattgtttctgagcacctttggtggtaatttttgatctataaagtttatttgagattcagaagtgtgaacctatttttttcacaaattttgatttaagtaacataacaacatcattaggataatatagatcacttaaaggcttattttcttccatagtgtttttttaattaagactaatttttttttaaacaagcaagattttgaaattttaggaatacattaaaattaatttttattactttttatgtaataaaatcttaaagacaggcaaaaataaagcaagttacatggaaataagtctgatagtcatatagttactttaaaaaccttaccatctgatctctgcatgggataagacttaaaaggtattttgagtaagcaatgaataagataattgaagtaataacaaaaactcatatttgtgaccaactgggatagtgaaccaaattgatttactaaaatctatctcagcaatagatctttgaacaggtcaccatgaaacctgcccctattttttaagaacttaggggaatttgtacattgactttgaaacagaatatcttaattttaaaaggtctagaatccttgtaataatgaataaaacatttgtctggcagaagtatcttttggctaatatgtaagaatttttattttaagaatatcagcatatctagtgcatctagaaaaaactctatcaccacaaaagttgttattatgattatttatacctttgccatttagtgcctggtttgatgcacacaatgttgttggaaacatatattcatattttatgtttgtgattatttatccatttttataatataaaattaagttccaatatgaatcccattgccaaaatagaacttgactaattaaggttctcttgaagaaaaattataccagatagagttaaacaggcaagactttattcaaggctattgcaatagtggatagaaattgaactcagttcttttgaaacacaatgcaagaaaattttagtggaaaagcattggaggaagtgaagggaaggttgttccctgagtttggaccacatttaattgtttaattgttgcttatggaatttaggctcctattatccatacaaactgggagactgggaaaatatctttctggataacaatatttcaaagggatgtctccaagttttttaagacatccctgggttataaaactcacaagtggctgggagactatttacatctcaaagagtcataggaagaatttacaatggaaaattttctgaagtaaacactctaagaaaataaaggtcaggacatgcagtcaggaagaaaagtgtttaaagtttcgtcaagatgagggcaatattaaagccatcttgctcggtttgactttattgcaattcagaaacaatggttgagaaattcatagttcgacacaatattgcagaataaaattactttaaagtatataagaaaaatattgagggaaaataagatagtacacagtcctcctccttcaaattttgtttgaacattttccactgtcggaatatttggaaaaaaatcagaataaaggcttatcatatccatacttgaattgtcaaattctctgttttgaaatcatagtttgaacttttgttattatgcctaagtatttcctgatgctgcattttagaaggatatgtctgtgtttgacatgaaatatatttcaaaatatgctatttttctactttatgttattgcattaacttccagaattaaaaagtggcccttttccttcatatatcatgtcaacttctaacacagagactgatttttaaggattataattaaagtgtatcaaaagaagagtgttggaaagagaatgaaatgtgagttctctgtcaagacacttgctctgtcagccagaaaatactaaatagctatttggaagaggaataatatttttttcctcaattctgataaagtattagttggaatggacccatggaccaaaagagagattaacaagagaaaagccagagaagtttattgacgtgtatttcatatatacatggaagacagcaagggaatgagtagccgccaaggaggtgagtttgaatttcagcttatataacgcattgttcaacaaagaacagtaaagttttagggaagcgacatgacaaaggaaaaggattttgaatttctaaagacagcaacttgaggcaaggcaaagaaaaggcagataaaggctaagtaaagcttgttaatgtagattcctctggtgccatctccaggcccataacagtctaaagttctcttcagtggataacatttgtcctccccggtttagaggggaagggggatattttttgtctttgtaaatgtatatcgtccttttaggtaaatagaggcagagagcttttcttcatctgcttcttaattgccttcagctcaacaaaccttatgccaaaccatcctaaattggggtggcatattctgatctcccataggtaaattggttcagcaagagccttttcttcaattattcctcactccactcccatgcacagtttcatattatatctacaataatacattgaacatttatactctaaaatgtattagatatatttatgggacttaataagtcacattctcagatacagcatgattaaatgcattgaaaaatgtggtactcatgtattattacaagatagaaaaaacattcttataaggcagtcagtatattgtgtataactacctttgtgtgtgtaggtgtgtgtgtgtgtttgtgtgtgtgcatgtttgtgtgtgtataaacttaatgtcatcagtaggttcttggaaactgtgactttaatcaaaacgatgcataacaaaatccattttttgcgtattataattatatctaaatgactatgttattcaaggacctattgtatgtcatttcacttaaggtcatattttccaagaacttaacaatatttagtgggttcttaatgtgggtgtgtgtgtgtgtgtgtgtaatacatgcacatagagatagacaggaataatagtcactaagttgaaagcatctttttttttttttattttatgttgcgggaagtcagggaccccaaacggagggacctgctgaagccatggcagaagaacgtagattgtgaagatttcatggacatttattagttccccaaattaatacttttataatttcttatgcctgtctttactgcagtctctaaacataaattgtaaagatttcatggacacttatcacttccccaatgaatacccttgtgatttcctatgcctgtctttactttaatctcttaatcctgtcagctgaggaggatgtaattacagcctcaggaccctgtaataattgcattaactgcacaaattgtacagcatgtgtgtttgagcaatatgaaatgtgggcacctcgaaaaaagaacaggataacagcaattgttcggggaataagagagataaccttaaactctgaccaccggtgagctgggcagaacagagccatatttctcttctttcaaaagcaaatgggagaaatatcactgaattctttttctcagcatgaaacattcctgggaaagagaatacccacctggaggtataggcttataaacagcgcccccaggtgcgcctgcctcttagggttgaggctgcagggatgaaatagaccccagtcttccatagcgctcccaggcttattaggaagaggaaattcctgcctaataaattttggtcagaccagttgatctcaaaaccctgtctcctgataagatgttatcaatgacaatggtgcccgaaacttcattagcaattttaatttcacctcggtcctgcggtcctgtgatcttgccctgcctccacttgccttgtgatattctattaccttgtaaagtacttgatgtctgtgacccacacctattcgcacactccctccccttttgaaactccctaataaaaacttgctggtttttgtggcttgtggggcatcacggaacgtaccgacatgtgatgtctcccctggacgcccaggtttaaaatttttctcttttgtactctgtccctttacttctcaagctggcagatgcttaggaaaaacagaaaagaacctacatgaatatcggggcaggttccccgataattttatttacgtgtatcttctaaggagtctacatataatgcaacatattctaatgctatataataagaatgtaaaaatgaatagattcatgtaatttatggcaaaaaatatctatctcatcatcagccttaagagtttctacacaggctaaaattaagaaaaaataattatatgttttcaattttctttataacatggtcatattttcattttctttcttcatctctctttctttccttcaccttcctttttctttcttcttttcttcgtcttttctttttcccttctctccttccttcaccatcctaaaacatgcattaagccatgtttcagccatggagtaccacgtgatatgaggtttataaaagcatactttagagcacttctgcccatcaaaattagtcaacctagaaatggaaatgacatgtgcattattagctatagggttgtatataatgagaaacttaacaattgtgccattgtgttatttgtgtcttttttccctaaaaagtgaatgggctctttatactgaaaatatgaggcaagatagatgaagattgggcacttgtttggatcaggaatggtggatagaatattgttccaagttcttgttaagataaaatacagattatatttttaaaatatcatggaaacctttcagttttatttgaaaaggttgtgaatggaaactttttgtgatgtaaatgaagcttaaataagcttgaataatgagttgatatattttcccatatctcttcctcttaacgtttgcctcccattccaatacttgtgttctatattccatttagttcagtttttactgttcactatttttcatggcaactatcatattctgagtctatccctctgcaaatgatatggtaagtgctaaaaatgtaatggtatctcctgttgatagatctgtattttaccaaaaaccttcttgagaaagaaaactttgccacaagtgcagtagttcagatgataatcatttcaatctctgtaacagttggagatatgattgtgttgccccattgaacaactgtgtaagctgactaccattagctagaaaggtacttgacttcataccaccactgtgtttagaacagagtttgttgacagcttgtatgtagtaaggctgattttattaatatgtagattttttaagcatagagattaaaacaggcttgcaaagtgcttgaatctaaattcagatggaaattagccaaacatcttaaatcattaattaaaatgttatcaaaactttaaaattttaatcacatatcagtgattaaaagttatgatgtacttcccttagccatactctgactagaggagcagctttctcatgttgcagcaatgcaattttttttttttttttttttgagcctgagtcttgctctgtcgcccagactggagttcagtggcataatcacggctcactacaacctccacttccagggttcaagcgatttttctgcctcagactctcgagtatctgagactacaggaacgcaccaccatgcccagctaatttttgtatttttagtagagacagggtttcactatgttggccaggctggtctcaaactcctgaccttaagtgatcctcccacctcagcctcccaaagtgctgggattacaagcatgagccagcgtgcctggccacagatttttttttggagcaaaatatagaattatgtaacgttataaatactatcaatatgatctaaggacagaagtataatctttcattactcacaataaaagctaataaattaatacatttctttttttttttttttttttttttttgagacagcctcactctgtcacccaagccaggctggagtgcagtggcacaatctagcctgactgcaacatagtcctcctgggttcaagtgatttttctgcctcagcctcccaagtagctgggatcacaggcgcccaccaccatgcctaccaaatttttttgtattttaagtacagatgggtttcgccatgttgaccagactgaccttgaactcctggcctcaggagatccacctgcctcagcctcccaaagtgttgtgattacaggtgtaagccgccatgcccggccaaattagtacttttttttaaattaaactagctttcaaatgtgtatgcaattcttatagtggaaagagagagattgaaacaaagtacctgtactatagagcaaattatataactaaaagttgattttatacagacacataaaggaaactacaactaaacaatgtccagtaccacagtgttattatgcctcacactatatggcacttgctttcctaagccaatcacttaagctttaactcataaatttcctctcaatttctcccgaatctatatcccattgttgattgagattctcttgacaagaccaattcagaagacaatgccttgaggaggtaatgtgcagatacatctgtttgccttttacatccactcttcaccttctcagagatgcatggattgcatcagaaggctcctgagccatctgacattcagttggcttccacaaatgggcaaagaaaggagaatatgaagggaaagaggtaaataatagccaggtatgtgttgcataggttctctccaagctggctgccttcttttctaaacatggctcatgttatatgacatttccccattagattatgttgttttttttttttcctgatgaaatttttcttctgtattccttgtttgtcagtgtatgacattacctcttatagttcccctataccctactcacacctctcttaagctttcctttactaaaaacacattggtttatctaaatttgagggtgacattttcttgctggtacaccaagtattatagtaattggtgcttgacttgtctctaagaaaaaaaaaataactcaaaatgagattcttggattggagtgtgcatattaaggatccatgcataaactcctttcgtggaggtgggagattcacatagcatgtggctaatttttgccaggtgtggcatcacaattactcaaatgacacctgtggtggcatgggatgagtgcaggtatagagtattggatgatcaagtggctgcagcaattactcactgtagcaatagttgtaattattattacatttggtttctcatgacaaccaagtgtatattctctatatacttgagaatgtatatagggaaaatgtaaactaacaggtataaaatgcaataagagcacatggggaaacagaaggtcatcagggcagctttgaaggagcccatctttttatgattataagtgttgcagagatgcaacatacttggaactctcaacccttttgatcctcttaacctatagaaaaggcactgaaaattggcactggggaagaaaagggacattgagacatgagatgggaaaatgataatggtgaaaacattgaatatctcaatttcatgaactttctggctagtgaacatagaccctctcactttctctagtcctcttctgcctaatagccttacagtaactatatttggacagtttcctcaagagctaatgtcaattcttttcatgacccacttataccatctctcattgattctagggccataagaaatgttagcttttagtcaagacaggaatataagatcttttttaaaacaagatagcctatactacaaaacaggtataggttggctgggcacggtggctcacgcctgtaatcccagcactttgggagtccgaggtgggtggaccacgaggtcaggagatagagatcatcctggctaacatggtgaaaccctgtctctactaaaaacatacaaaaaaattagccgggcgtggtggtgggcagctgtagtcccagctcctcaggaggctgaggcagaagaatggcgtgaaccccagaggcagaggttgcagggagccgagatcgcaccactgcactccagcctgggcgacagaacgagactgtctcaaaacaaaacaaaacaaaacaaaacaaaaggtataggtcattgtcactattggcagggagctagaaatcatgcatgggagtgaattctaaagacgttagacaatggacaacaaaatacaaaacttgctgaagctgaattcttttgcatgaatgcattcaccctgaattcagggtgtgatgttttggctaccacaatgaaaagtggcgttaatagtctgctagattggctaactgaaaccaagtctcaataatagcttatagttaatgaagtcaaaatgtctgaacttttacagcacattataaaacaaggttctcaaatttcaacaagcatcagaatgatatggatggctattttattttattttattttaagacggagtctcactctgtcgcccaggctggagtgcaatggcacgatctgcaacctctgcctcctgggctccagagattttcttcccttagcctcccaagtagctgggattacaggcgcccaccaccatgcctggttaattttttttttttttttttgtatttttattagagatggtgtttcaccatgtttgccaggctggttttgaactcctgacttcaagtgatccacccgcctcggcctcccaaagtgctgggattacaggcgtgagccaccattcccagcctcatggatggctatttaaacacagattgctgaaatgggatctctgagtttctaatgcaatagtttgggatggagccgcaaatacggatttcgaacaagttctcgtgtgaagatgatacttatgtcaggggaccacactttagaaacattgtgataaagcctgctttcataaagtgagacacacagacaagcagcatcaactagacggctctaccctcctactctatatctactaaatcataagttataattctaacaagatctctaggtgattcatgggcacattaaaattgagaagccctattttagaggagtttaaaagttcagagtgatggaaatgtgcaatgaatttatcttcatgtgtaatctgataaaccagcctttatctatacacttctaagataaccagaggacatgcacttcagcaagatttaacaagtatattggtaaaagggcatctggcttccttgaagagccctacagtttttttttgttttgttttgtttttttttcctctgtagattagggatgtcagtgagggacgctgtaacagaatgggcttcctggtctcaatagggataaataaatgaccctgtgtgtaaagtgctcatagtgacctaaatgggattaatatgtgggctcaagaagatagcattactaaggctaatctggttacttctgttgctgatactcaatgtgccagtaatagaacccaaatctgaatccctattatggtatcattcctcagggaaccagctcactgaccagtggcattaaacccacttttatcatggaggagggtccttatatggataaatatgattcagtatggatttgtgttgtctgtagaccttctacctgaaacaacattcatgtgctcagagaacgtctttccaatgcttttgatcattatctggtggacatacaacctcatttccaacaaggtgatttattttattttaaggtgaaggatcatagcaaagagctcacaccacagcttaatccaataatgttactacaatgcctaccattcagaagcagctagcagaagaagatggtgggatagaattcttaattctcagataacggctagtagaagatgaacttctatgaggtttggtcattctcttacagtatgtggcgtatgctttaaattagaggtcacgaaggcatgccctctcctgaatagctatgcaggagatggcatgacataacagagcctgggcaacttgaagtgaagatgaaagtgatctctcttcctatcttacttaatgatcttcgtgaataattttggctttcttgtctgtgaccttcagctgggtgacatttgggttctaggaccagaagttgaacgctttgacaacgaaactcaactattgttctgactaattggaagctcagattgtcctctggccatttttggacccttcatgctgatgaacgtttgaacagagaaaagactttccatacttgtgggggataattgatcctaatgccttgtagcaaatacgataaggacaagtgaagcaagaggaacagatgtaaacatatctgagtgtacagttcagtggtattaagtatattcatacagttgtgcagccattaccactatccatttccagaactgtattcatcttgtaaaactaaaactctataccattaatcaataactccccattactccctccccaagtccttggtaacaacctactttgtcaatgattttgactactttaagtaccccatataagtgtgttaccaaaacaccagggatttggtctaggtcctgctgtttgccacacaaactcaatcactgagacgatgaatattgccaaggaagaaggctttaatcaggtgatactgccgaggagatgggagctgtctcaaatttatctccctcactgactaaaactaggggtttatatagcagggaagaaatgcaataatgtgcaagaaacaggaattacagaggggcaaggaagcaagcataatgaatgagggatcctgcatctcattgtctggatgtggtgatatggtgagttttttgatactttgagaggcctgaagatcatttggtaaatttcaaactttcagatcagaagagtacacatctatgtttattaaaaaatatatggaagtattgggtcagtttcaagtataatcatgccatatttgttttttcatgagtggcttatttaacttagcataccagcctcactgttgatccatgttgtagcatgtgtcagaatttccttctttttcaaggctgaataatattccttttgtgtatatactacattttgtttattgatttatccatggatggatgcttaatttgcttccaagttttagctattgtgaatgatgctgccaggaacatgggtatgtaagtacctcttccagagactgctttcaagtcttttgagtatatactcagaagtaaaatggctgaatcacgtggtaatactgtttttaatttttgaggaaacatttgttttccacaatttccatatgattttattttaaactttcaatttattaataaaaattgtatatatttcttttgtaaaacatgatatttgatatgtgtatgcattgtagaatggttaaatcaagccaactaacatatgtattacctcacttcttgtacagacaacacttaaaatctactctcttagcaattttcaagtgtacaatatattgttattaactatagttactgggatgtaaaattaatctcttgaacttgtttcttttgtgtaactgaaattttgggctgcaccaccttactttccaaccaacattgtagtgtttcaatttctccacatcctcgccaacacttgctattttttaggttttttgtctagtagccatcctaatgaatgtgaggtggtttattattgtagctttcatttttatttccccaatgattagtgatgttcaccatctttctgtgtgtttattgattatttgtatatcttctttgaaaaactattgattcaagttctttacacacttttcaatcagatcatttgtttttcgttggatttcagaagttctttatatattctgcataacaatgaatgtttatagtgggaaaaagttatgttgagaaagtagataatcactttcaggtggttctctgattaatatttgaataatattatgtataaataataaaacatattcaagtatctgattattattatatgaagttaaacaatcttcctctttcttaaatacactgcatatagaaaaccctaaagcaagcttgtccaacctatgatccgcaggccacatgcagcctaggacaactttgaatgtggcccaacaaaaatttataaactttctgaaaacagcataagattattttttgggatttttttttttttgtaactcatcagctatcagctgtcgctagtgttagtgtattacctgtgtggcccaaaacaattcttctttcactgtggcctagggaagccaaaatattggacatccctgccctaaagagtctacacacacacacacacacacacacacacacacacacacacacaactaataactaaattcagcaaagtagtaggatacaaaaccaatgcacaaaaatcagttgtacttgtatacctaacaagtaataagctaaaaaagacattaagagaatagttcagtttacaatagcatcaaaaagaataaaacacaaaggaatcaatttaaccaaggaggtgaaacatttatgcaatgattattagaaaatatttttgaaagtaaagtacttcgtcaggctttgaaatagcttcttcaatgtgtaaaatgattttcatcatcttacagaccaaatgaataaaatgacctttagaaaatacctgaaagaatcttatttaatttagttagtttatttgattttttaaaaagggcaagtacttgtgctattgaaaaggaatatgacttagaaagtttacttcatttgcagttagagagtactttaaattaaatttgtttggctggattaacctctcaaatgataagcctatcagaaaactttgaatatttgagtactctttagttaattacatttttgctgctttaattatcaaacttaagcttatttgtttttctacgataggcactgccatagaaaaaaatgacagaatttagtcttaatacttgcccacttttacatgaaaaaagcaaactgcttgagcacgtatggttattaaatatgtcctccaattaattgtttccagaagcaaattacctatagaaacaaaacatttttctgtaacatagttctaattcacatttagtattgtcataacatccatctgttttattattttcaataacatattaaataattttgccttattgtttacagaattgttaatctgaatgattttataggtgagaaaacagatttaactgtagggttatgacaactcagaattctcctagaggtactaaaaaaccacattttctattgtacaaatttatctatggaataaaaggttttaaatatcttatattaaaaattaaatctgaaatcagaggagaaatggaggaggattatgatgtgacctttctctctgcctggaatatacacttggatttggatcaaccagaaactcaaaaaatgaaataaatggagttgttgaaatatgttcattgattcactactaccagttaattccacatccatttcttaaacatattgtcttatataattgtttgttgtcctacagtcaattaggtgtttttgtttattttttgaatatgtgggttgtcttttcatggaatattgcttgagttttaactaatattaaatatgtgtaaatgacacagataaaatcaaaatcgtatttgaccataaatataacgtaaatattttcattcctgctataaccgtaggaagactgaaaaactaagggaaaaaactttaatttgttctgtgattaaagttctattaactcataagcttaacaaacttacttcccctatccaaagtactatatatgcaatctttaataattaaactactgtgatgttgataaatttaatacaaactcttcaaacatctagaagggtaggcaagcatacccaagaggatttttttcttaagacacttaatcaattctttcaatctaataaatcacacttacaaatttactgaatcgaatcatttaaaactttgaaatagtgtttaaaatcgcagtcaaaaagtttatattttaaatcacatatctaacaacaacaacaactttctacagttgcattttcactaaaaaaaggaatttcacaagttgaaatgaagttttagttaaaaaaaaaaaaggggggggatcttcagcttggtagagatttaattgtttggttagggaatggaagaaaaacccaaaatttgaggtttataattgattctaatggagacacaggttaagaggttgagctttttcatcaagcagggcttttttggcttttatcttttcaaatcaatctttcacatacattttaaaaccatatttttggctggatgcagtagctcacgcctgtaatcccagcacgttgggaggccgaggcggatggatcacctgaagtcagaagtttaagaccagcctggccaacatggcggaaccccatctccactaaaaaaaaaaaaaaaaaaaaaaaaaaaattaactgtttgtggtggcaggtgcctgtaatcccagctattatggaggctgagtcacgagaatcgcttgagcccaggaaacagaggttgcagtgagccgagattgcgccactgcactccagcctgggcaacagagcaagactctctcaaaaataaaataaaataaaataaccaatatttgtttctttgatttcaacccctgggacatatttttctaatgaacagaactgcctgattagattctatactcttctttttttttttggttgaggagagtggggtatgaagattgttttttacccactttaatcattatgttgaaacacacacacacacacacacacacacacacacacaaaaacacacatacacggcatggtatgcttgtacttttaattttaactgcagcaatttgatggcctgaaaataataaaatattgcaatattctgagggtataaacctttcccatttacaccagtctgataattaaatatggtaattccctgaacgtctttctattttatctcttagtccagttaatacagtcagcaaatgctaataagtactaataagcatttttgatcttagtagtatgactttttttgcttattatcttgttcatttttgcttttgccagcaagaaatggccttttatttcatgaaaagttatcaacggttactgtgaataaactgttgccttctttttgttttatattttacatatgcatacatagtcttttttttttcttgctggtatttaagtatgttctgtgcttctcttatttcagttgtacagaaagtacattttacatttaaaatcattttgttgataatgttcccaatttaatgaaaaataatatataactcctttatatgctcaaatctatataaattgctagtagctgtaggatgaaaaatgttattcattgggtagttgcgtgcctccacttacattcatttttattgttttctcatagaactctatattgctgattgtaaaaatcttgggaacttgcttaagctcacagttagttaatagtgtgcggccaagattctgaacatagatcttttgacattaaatcctgtgtaaattacctgttattgtataacaatatcattaaaattaggtaatttaaaacaacacacatttattatttgatagtttctttgagtcaggagtccagacacagcatagccaggtactctgcttaaggtttcacaagagtataatcaaggaattgtcagggctaccatttcatctgaaacatggttagggaagcatttgcttccaagttcaatcaggttgttatgtattccttatggactcagaacacaacacagtttgtgttctcatgttatacagacacatagacacatgtatacaacatagaatctcatgttatgtaaccacataatcatatacatgggaaatagaaacatagacttttctttggggtagaagcatgtcacaggttttttggaccatacttaatgcccactatcctcttgtatgggtggcaagctctaatgtcacaattaaaaagaaagggctagctatgtgagaagatcttaagaaaaaatggaaaatctattgaagaacatttattctgtacaaatagagtctatattagcagttacatgaactcctgtaatttaatatgttaatctctcttgagaatcaggaagtacataaaaagaagctgcaaagttatttttctgaattaataggctaataaagaggctaaatgaaagaggaagttttccatttttataaaaaacgtccctagaggtaaatggccctcaatacctacttcttaaaggatgaagcacaaatcccagtatttaaggctgtaaaagattgaccagccaagaaatgtgttgaaaatgtcaataaatatttaactgtgctaatatttttaacacgattgtgattgttttgatttttattattctaaatacaagagaacaagtctttttcaggaacatacatatagtattatagtagaaatgccttttctcttatagtactgattttgtagggagaaaaatcgagggtaaatgcggttatccactttcacatagttggtaagtggtggattatggattggattctaagcctatccattccagggccagctctcttaacttctattatatgagtatcaaactaaatttaattccattttctgaactgccaccatttttattatgatgaaaggaaaatttcatgtaaggtgaatcccatcttgggtattacctattctgcaagacaggcctactcaggattattcctgttgatccctttattataattaaatatgtctcgttaccactattaaacattgcttgttctagctgacattaatagagccatccagttttcttatttagtgttgtgtcgtgcctcccatctttttatttttaacttatctgtaatatttaaaatgaagtcaaagaagagaatacatttaaacatcaaatgaaacacattaagcaaaaggtttattggcaaaaagggaagcttgcaaagtaacgaaggaggaaagagagcacattatcccaatacacccagagtattctggtgtttagctgcttgccaatattgtctagaacactagcttttcagatcttgaaaacttaggatgtgtggaaagatacagtcaccactgctgggatagggagagacaggagtttctggcttaatgctaactatagcttgggtgtcacgtattcttctaaggagaggggtatgggcacagttgttcaggcaattcagagtgaacacttaggttaatttttaaaaaatatgtatattgctccttgtatcatgtctgcctaagctttgctctcttctctctctctcccctaaattttggcttaaagcaagcttgtatatgaaaatttgagaggcttttttttttctttttggcaatacaaatggacaattctaaaggggaaagcaggcaagcaaacaaaactctttcaacacaccagcagtagaaagattttttgttgagtttcaatcattgaactcaggagtgagctgagagcaagaaaactatagatcttttccatgaaagttagaatctttaaataaaatataaatccagatacagtgtttttgtttcactactttaatattagttactattaaaactttatctggttataaactatttgctttgtaaagatagttcaatggctccttcccttagtgtatctgctcgcagcttggagcatatatatatatatatatatatatatatatatatatatatatggagcatatatatatggagcatatatatatggagcatatatatatatatatatatatatatacatgcatacacacaatcagaagatttgcagttgctactcttaaacactattgagtcaaggtattaatgttaatgttagttgacctgcctattgtacataagttttcttgatgagaaaataaattccctttcaatttctcaattatatattgaaatacagatcaaatatcttttcatggtgagttgtgtgaagtatttgtaaattagtatgtactggggccttgaatatatatacattcttgaacatatttataggcaataaaatgccatcaatatctgatctatactttggagtgtattgtatgtaggttgtgtatttgccatttcagtcaaaaataaaaatactcattccactcaatattcatgtaattatgtcctagtatgtgaaaaagtgcaaaaaatgtgccatttacaaaagtatgtgtatgtgagacaacatttgtgtttaaacattattctggcttgttacaaaagattcatggttctttccagcatttcttaggcggataaagactggtagtagtagtatgataaagaaatattatagataattatagttattattaaattactgagaaaatattttaaagagccttccacttttcttgtaattatgcaacggtataacatttaggccaatttcatgccttaagaaaatgcaacagatacttttttcgttatatttttcaagccagattcgtatttatggattctctgtatattcttgagtgctgtcctaaggcgatgtgttctctcgatagttgccatttattctagtgtttttttggaggctacattttacttgcatagccacatctcttctatatctataagtttaataaaatggatcggttgaaaatgattgctctaagccatggtacattattatttggcaaagagatcattgctgcgtgagggaaaaatggtatttgagttgcatcagtgctgtttgcattcgacatgtaaaatgcatgggatctttaacacagtagaaagggttagagacataatcttttcaagttttattcaaaaactgtctacaattcagcttgctgaaaaaaaataataagaaagcaatcactgaaatgttacactggcctagtgcgttgttctagtagagtaacccagacatgtcttaaagaagaatggcttctattccatttctgcacactagttttgtctttcatgtcaagatgtatgttttatgtatttgctctaagataaaaagaagcagttctcaccatgggaggctcagctactttttaaaaatctatttcctcttcctttcttagtttcacaatatctttttttcacatcagaggtctaacagaattaattgagacatcagactctgctattacaggcatttccttttgttcaggataaaattcagtgataactcctgtgagaagtgatagatggggggaaacagatttatgttgttagagggaaacacaaaatggatgatggaactcaccatgtctgtatctctgccttccaccaaaaatattatttataaataatataatgcagatactttggccttttggtaaagaatattttctgtcttatgctagatatacagttgagtattttcagctttaaaactgattgtgagccagccgcggtttaagagcatgatctttgctaaagaattcatatgagtagaatatgttttcaagtacctttctttggtttgcaggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatgttagtgattttttttctttgcccctgtaatataagtttattataatttaaatgtctatgtgtgtgtttatatgatattgaattatttacataatttgagtttatttcctgagtatagcaacaacagtttctttaactcatttaaagaagaatgagaaaggaagggaacatctgtgtcctggagaaccgttagacttcccctttaatatcctggaagcttgtcaatttctgaacaagaagaaaatatagtgcttagaaaaaagaggtggtacccttggcaaagtaggacaagcatggctataactcatttctgtccaacaatggcaacatgtaagtgtgtcactcagctgccggcttgaagatgtagtttggtgggtgcactcacaggagcctgcttttacaactagtaagcattggttgaagggcaaaactgtggaaatgtcttacatagttgcaaaaaagaaaaaaaaaatgagaaaaagtttcatggtaatatgccagtcaagtagttctcagatagcataaatttttttttattaagaatatctatattgggcttggcacagcagtagctcatacctgtaatcccagcactttgggaggcccagtggggagaactgcttgagcccaggagtttgagtccagcctggcaaatagagtaagactctgtcttgacaaaaaatttgaaaaactaggcaggcatggtaacacgtgcctgtagtcccactaatctgcagactgtggtgggaggatcccttgagcttggggttggggagtggaggctgcagtgaactatgatcacaccaatgcactccagccaggacagcagagcgagacactacctcaaaaaaaaattgctaaattaccaacgtagttggatgtttcatttctggaaaaattaaaaaaaaattaataggtataagtagctctctaaagtaactttgtactcacttatttgcatctcagtctttcttgagtacagaggggcagagggtagtggattataatcagtaattgcactgggccctgggaaaactcagagagtaactctaaacatgcttacccacaagttcccagcttatgaaatccaaatgtcagatactcagcttagtgaacctgaatcatttcacatcattgctcagggtttatgatccactttacaataggttatggagtggttgatactttatactatttcatgtctaaaatttggagtctttaataaatctcaatttgcctcttattttactacagtttactatgtgctttattacttatgaattctttgaattcttgtgaattatgttttcctgctgccacagtgcttttaggggttcattcatcaaagcataagggcttttattctgaatatccttaacctagtgcccatctgttttatgtgtcctatagaccattactgctagacaaatagtgaggtaaatctgggcttttagtccaaatctaatcactactggaaattacagtctcatttaattgtaaaataatatatgcttatggtaaacatatcagaaaataagaagcatatatatgaagataattttatcagttagggaaaataacatttaatgtttattctgccacattttatttcaagcatttatgtgtgttgatatgtatatttataatacttattaatttaaattggattatgctgttcattttgctgtcggcctactttttacataaaatttataatacatgtaaaattataatgcaaacaaatgtatatttatataattatttttattagctgcatgattggttattgcatgaataaataagagatttttaaaaaatgaatctcctattttggaagtcaagtttgtttgcagtttttaagaattacaaaaatgctgcagtgaaaatttttgtacatgcatctttctacaattgtttagttgttttatagagataaattcatttaccatcattatattactggactagggagttttatccattttactaaatggtcctctcgatatattgtccctatatgcttccataccaatattgctaaataattgtaatgtctgaaataaaataataatattatgtaaatatttgaaataatcttagtttacttggagaggtgttgtatgtttttactttattgttttaacattatttacattgatatagaataagatattttttcttctgtatgcttctctatgatcctagttaatattttctacaaagatatagtagagaattcattttaaaaaaagtgagtgcacactttttatatagattgtatttgaaaatatgctctccagtattaatgaaatatatattaatactatgatattcatatatgtaaatatatatacctttatttacactgttttaaattttatttaatgtaaaatgttttttcccaaaagctaaatatagataaaatatacattattattaaataactatattattatgataaataccaaaatatttgtagtttcttttaaaatatagggcatttacctaaaatgtaattcttttgattgttgcccaaagttttttggttgttcttttatgaatataatgaatcaaaataaaaaatatgggctgggtgtgatggctcatgcctgtaatcccagcactttgggaggccaaggccagttaatcacttgaggtcaggagttcaagaccagcctggccaacacggtgaaaacccgtctgtactaaagtccaaaacttatccaggcattgtggcaggtaccctgtaatcccagctactgtagaggctgaggcagaagaatcacttgatcccaggaggcggaggttgcagtgaaccaagatcacaccactgcactccagcctgtgtgacagagtgtgactccgtctcaaaaagaaaaaaaattatatatatatatatattccgtttcaaaaatatatttttatttatatattatatatatatattccatttcaaaaatatatttttatttatatattatatatatatattccatttcaaatatatatatatatgctctgaatatcaaaatagaaccaacaatttgagtttgatcctactaacaatggcgaaagctttgtattataatcactagcctataattaactttaacccttcttagtggtaaattgctcttgaaattatttttatagaaaattttccactgaatttttgttatgaaattatgcttttctaagaatattctgattttaatcaaagttatttggcttataaggaagacacaacaatgccttcaaatgatttccagctgatgggagagaatattaacaataccaatagcatagatataaaaaataatttacttttatggaaattgtatgtttaccagggagagaggaaaactacttggtcttggaccatatggtctctagtttctgcctttctctgtgcatattctctatttttctctctgcagagcagattcctttatacacttataattttactccacttccttgtttttcatttgactttaagtgttttctgtgttcatgccatgccagttcttcataaacttttgatgcagtggccattaaagaaggcttaaagtcactgtgttttgttttgttttaaaatttctgagagaaataacaattaaatactcactggtttgaatctatagccagggagcaaggagtagggccacatggtagatccatatccaattataccatctttttagcaacagttagagaaaaatttattttccagagaaagtgatgcaaatcatgttttctacattttctcattgaggcaataaactgtctcttaatggggacgtttgaataattatggctgtaatagaattaaaagcaaacaatatagacagaaacatttttaacagtgtgttaaaaataagctgataaacatgatcttcatgaaaatttccgaggaagaatataaagaataaaaatacccaacgctcagatatttgtatttaattagaaagcatttacatgagattgtatgactatgaactgttttataattttaaaacttggtttataagattttcccttatggtcatcatttatttttatgtcttatttttatttttttgttcactaaagttacataaattttcagcacccaaaaattaaaaaaagaaaggaagagttacaaaattaaaagtcacaaaagagaaacaaccagaatgtgatatttggggtgaacatgaagagtctcagtaataaaggcacatcacataaaaattttgaaatgctaaatgattgtctcacatggccaaaatgctctcatcactattgggcatgtgataataatggtcatgacaatatcaataattaaaataataacagaaagaaaagtatgactctggtacagtcctataatacttatctcaaaatcctgggcaaaattttaaaagcttttgaaacgagagaaattatgttcataacaacatcaaatatcttagcttcttttctttcagactctaacttggtagctgcaaaaggggcttgactcccctgcccaggccagtgtccattcaactgctaagtttagtagttttatctccaccttgtatcttgcatctccatcagtcaacataactttagtataagacctcttagtcatcactcatataaactaattgttgtctaccacctgtcttgattcaacctattctacaaccagagtgctgaaacagagactgtgcccacagataccttttcattgcaaactgttttctatctgtctcttgagttttgctagattcaagatgcaccctgtctatataattttctttttatttagaaatgtatgaactacaaactaagaaaactaatgtaattattgtcccatgaccatatccaattttttcttaccataccttccctgatgttcttttgaacataaactttgaaatcactgttatccagtgctatcagttgaattttatgtgctactaagagatatcttaaatgctgcttctgtataaattattttctaataacactggtatgcaattccttgttctaaaatccatattatttaatagtatttttgactgactttatttatgatcacctcatatcagttttataaaagttgctattagtatccaaggactaagtcatattaatcctaacccacattaaacttttcatataacaaatacctaccattaaatagactgaatgtccttaataattcactgtgaaaaatctatagatgtatctacatgtcacatatgcataattgtatttacaaattgatattttctttttaggtaatatcttcagtaaatatgctactattcattgtgaaaatttaatttgtgaaggacactgacaactctggccagccatttcctttaagtttgcttttttatgtaaaagtcgtttctaaaacacacagtgtcttatttcctttcactgtcttccacattacttgtgaaataggaatgattatgttataaaggtggtaagtccatagacagaaatatcatgacaaaaaaaattcactcctgagaattagacaaactttgcctatactttatgaaaaataaattcctacagatttgccaaaaatgcattccctgccccccaaatcattgacttccaaatcatttggtttctagaaaaaaaatatattggattgaagatttgtgctataatctaaactgctaatatcaacaaatcccctataaaaactttaattttcatgttgaatcctaaatgattgagaaattcataacaaaaatttctattttatatttttttctttttcagagttacaaaatttttacatttttgtgggaaaattttttctcttcatactctcaaacccactttttaatgatagtatcctttaattgttgatatatatcattcctgatacacatatcataacctatacacaggtacactaatacacaaatgtgcaagtatacgttcagagtattgtgttaagcactcatttttaaattgaaagaatagcttgcatgtttaggtatatatgaatggtaatagttttaaatagttatatgaacacaatttctacctagcttttttttcttctttgtttgatgaataaagcaattaaagaaaattagaaaaggtcaaattaccatggcttatttttgccaccagttatgaaagataaagcaaaatttccctaatgcattcttaagcatcttagagtccctaaactctcactaatggacttattagaactgtacttttatgtatgaccttcttatacagcagaattgaatctatgccaatacaaaattacattgtgtgttatatattagccacagggaatttttgccttcggtgtgatccattatggttataatttattgccctctaagttctagccatgccactaacagttgcatagggagctaaagttgagagtgataactgttccaggtgacctggttagatctaatttatgggtacttagcaggactaagtgaggcctcagtacacagtgcatttgatcctctatttgataagattttgaccttttggtcccagtggtaccactccaagtagaattagaagttgagatagaatgtttttataggtctctcttgcaataattggaagataaataactttaaaagtgcataattcacctcattgtcttccaagaggtgtgccaaggacaaacagtacacatatttattttgtttttaatttacaattaaaatatgctggacatgccttaaaaggtctattacacacttgaaagctggtagtaaaaatggaggtcatctaattcaaattctttccaggaaacttctaagagctagtctttttcaatggtcttttatcctcaaactggcatatttcagtgatgggtcttgttttatagaatagtctgttctattccatgtcactttttcctcctgatttttctttattttatacaaagacaaatgtgaaaaaaagaaattgaagcatcacaaatattttagctcataatggcagaggaaaagtatttggaagtgcgaaggcataaatttatttctaacataaactatactcttctactgataagaatctctgctctatttgttattttttaaaaacttttatgggtatatagtaggtgcatatgagttacatgagatactttgatagaggcacataattatttggtgcaaatttggattaagagaagccctctacttatggtgaaaacatgctttgaaatatttttcaactatttttcttatttctgctctctgaaactacagtaagtcaactaatggatgtttccatgacaaccatttagatatttgacaaatcatatgttgttaaatttaaaatcctcccattttatacattctcaaaagtgttcaaatttctcttctatgcacctgtaaaatggtacctgttataatctacctatatattattatctgatattattaattaatgtacagtatgcattagtgttccagtagcccatttacagtgctgtcatgtaaaatcagcttttagctatcaaaatttcacaattacatttttacattaatgtttgtagctgtctattacatttgggtgattttttttctattacaaattggaggataaaatttattattgcaaaaatttaccattttgtaacccattattatgacttattaagatgactttgaaccatgtcttttgtcattaaatgtatttatacatccttccaaggtttgtaacattcacagattttatacacatgattttaatgccttcatttatatcagtgattaaaggagaaatagagtagatataaaaacacagagctatgtgtgatttcactagagacctcttttcgtatgtcaatgatgcctcaatttattctttctaggtagcatcattcagacagctacaaattcaagtcaactttctttttctttgttggccataaaaatatcttgaaactaaataatgatttccttcagcttagatatagtttctgtagcatttttctcatttacaaatgtgtcgtgcattatagattttattttttcactattttggatatttattttttaataaataaaataggatatgtatgtaatcccttaggtgtttaacatatgcctagtatagtctaatcacatgcagtatttacaattctcattggtgtaactattagccttaattttatagatgaataaacgaagcatagagatactttgtactttttcctggatcatacagttagtaggttatggaactggaagccatgcagtttgactccagatcatctgtcttaggcatagggctggttactggaaagagggatactatcatgactaaaataacacacaggttgtattgagcttccagtctagtgaaggcagacaaaccaaaacaagtacataaaatatacaacgagccaaattttcggtgagaaatgcaataaagaaaaataaattggaagaaatttgaaaggagatgtcaggttggagacaaggtttttaagatggaggggtcaggataggacactgcaaaaatgacatatttagagataaagttgcataagctcaaaaggggttaaaaatcacaaagaaatactttgtagtggtcaatactctgactctagagtcaaatatttgtaggtgtgcattccagctctgcaaactgttagccatggcacttgaggaagtatatctttgacctttcccgttcaaggaatttattataaaaattattagataagtaagcatatgcttatgtatactatgtattgaagtattttttataatgacaaaatataatagcctggagtagttcattttaaattattacttggatacattatgctataggcttacaatgaagtataatattgctgtcacataacataacttcatagtattatacaaaaaatgctatagtaaatctatatttataaacatgggctgatattcactgtgtgtctgtgtgtctataatatgtacatatttagagagtgaaaaagattagcaaaataagcatttaaatgtgtagaatgagtaagtttagttggctggcttttggattttctcttttggtaatcagtatttttaatttgatcagcaatgaacatataatattccagcaaaaatataaataaacataaaagttaaacaatctctcttctccaggaatttattaattaacactttcttcaaattaaaagtttatattattgcttctttaatctttggaggggcaaacttcgtttaatcccatcaattctaagcattaattttgtgggtgcgctcattagccatccactaactgtgagcataatgctacctgaattccacacgctgagatacaaaattaaacaataaattaattatgattgtcttctcttgtccttaaaatgatcattttctttgagattattataatttaaaaataaacaagaatagaaaaatgtactgaatgaacgagtgctttgacagtgatgagaagctttgtttttaattagtattttaaaagatgcaatttctacattgcagccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgaggtcagtttctatttactctctctctgtcctttctgttgatatatgtatctaactatatacaataaatgtttataaatgattcctttaaaattatgagcttaactgtttagaaatatcaagaaaacattaaaaaaatagtactcagaagaagtatgtgacttccgatgttattttaggaattcatttaactatgggaaaaataatgtatttataataatagatattttatttttcatcatctttgaaaatttattgcctagatccatctacatgcttacttaggcataacacgagttattattattatcctaaggcatttatctaatacaaatacattgcctttgtatttctgaggtggtcatactaattaaatactggaagaaaatgtctgcggttctataaatgtaaagttattttctggattttaaaatcaagttctgaaatatccaaaaattaactacaaatcacaaccgaattcttatagaaaaatgctgatcaaattagaaaaattatatttaaaaagtagtattgtaactttttaaggacatgcttgtttgttgttttgctttgttttattttctcttttggctaaagtgcataagtgaagaaccacttttatttttttttaaaccgtggttactgtattaattatttttagttaattaagctacaaaatatttctagagtacctctaatgtgacctattatgtgtatgttagacacatgaaaaaatgaatgacattaatgtgatagtacatattttaccagaccatcttttcatttcaagatttttttttaatcttaaaaatttgcatgcctgctttacaggagaataactgtaatttgtgaattaaacagatcatttgggcctttaacctctagattctttttgaagttactaaaaatattttttagttatttcaacattcttgtgttcatgaaagtttgaagaaattatgttccttgtaatctgagactttctaaattatataacttaaaaacaaaatacaaactcctatttaaatttaacaagacgaattactggtcgataaatgcttcacctctttgagtcacttttgtttaatgagtttctactgtaatgacagatactaattaatttccaagtaactagttttaattatatataaatgatcttattttgaaatacaccctttgagttacatttgctttgttcggttgagtgctaactttatttttggtataaagtgataggtgaattatcttaggcaacaaatctacttacagaatctatatatatatatgtatatatatacacacatatatacacatatatatatatgttagttctgggatacatgtgcagaatgtgcaggtttgttacataggtatacacgtgccatggtggtttgctgcacccatcaacccatcatctacattaggtatttctcctaatgctatccctctcctaccccctcactcccccaacaggccccggtgtgtgatgttttcctccctgtgtccaggtgttctcattgttcaactcccacttatgagtgaggacatgtggtgtttggttttctgttcttgttagtttgctgagaatgacggtttccagcctcatccatgtcactaactgcccctggatccctcttcatagttcatccttctttcagaaatttataatgttcaatttgaagttcaaagcatcctatgtgatttgactgtttccacttccctctctaatcttttcagtgtcttgttaaacagtaacttctcaaatatcattttaatcatgcaactctacttttcaaaagttttgcaatttctcattattgtcgggtgtcaaaaggtcacttcttctggcagaccttcaagcttttccataatctgaccatttgtcaatgtattctgaacattctcaaattctccctgataatgccttatcctgttcagattaactctctcacatctcataaatatctccctttcttagcctttgctcacactgttcattttgcctagaataagatcctccctaccatgcaagtctcaaaattttgttcatctcttttacttgatttatttttatgaaataatcaatatttacatgtattgatcttcaatttcttcaaaccctaaactcctaaacatcagagtgataaaatttataggaaaggtaaagatttgatcttaaacattattttgagaagctatattactgtgcaaagctgtcaatacattgttgaactggtaagtttctcacaatgcatttccttttagataactgaggtcatcctatcccattgacactatggtcatatcttctatggtttgataatatcaaatgtgtgtacttgatggtcatatttttcacctttgattttgcccatactctttatatttactttcttgaaaaaaaaaacagtgcatttaaagcttgaaatagcatcaaaaaaaaaatagaaatttagctattattctcatttttcatttgaatagttcttccatagtactagtacttagtttagtccaatgaattataaattatgaattatctattggtttagttgacatgaattttatctattatgaattatgtattaggaagatacattaaaattagatacatacatactatatatgtgtatgtgtataaatagatatccctatcttgcccatctacaatgctgtgtttgtaataaaattaaatgaaatgagttttattctgtgcaagattgcaaggtatttttcatactatttgtccttttagtataagacatgaagtttatgcaattaagaaagatctaaatgtttttccaaaaaaatcgttcacagtttaatagattgttaatgtcaaaatatttcacacttcattaaaatacaaaagacaggtataataaagtcattatcacagatttataaaagaagcttccaaaattaaagtcctgattagtcactctttttattcaccatgagaaaactgagaactggagcagtagtataaattgatggttacaaaattgaccacgaagttgggaataaaactcaagtccttaggtcaatcatcccctcactacttatcaataaacattctagtattctaaattataactactttcatgtaccttattttacaaataaatatgatttacatttatggtattatatcataatcacaatcagcacttttataaatgcattaaatgctaccctcttacgctcttcgtaaacatgttcttctattagtttgtcaagaattcaccaaaacattattaattcctctatctacatgttgaacacgggttataacaaggtttcaaatgtctttctcatgagcaagacataagacattgaagtagttttctctctttaagtgaagactcaattagctttaaacaattgtatcattaagtaaatagtttgcctggtttcaagaaaaaattacacagttgctgatcattcttatgcaagttttggagacaaatctttctcgacagtgatggcaggtttttgaggttcatctcaccccccaaaatttattttgatgtaagtaaacaagagcaagtcaaggcagacataatgttttcttggtcatgtgaagaatttatctcaagttaatatagagcttatatatgtctggtttttaatgatcttttcattgagagaaaatttttcagtcaatatttatttatttttaccatcctgaggcagacaggaaggaactataaaaacctctaaagcatgggttacctatagtatattaaaataaattaaaatgtattgtttatggagctatatctatattatgagcactgtggtaagctctttttatgcacattatcttatttagtcctcacagtagctttacaaggaaggaatatccctgttttagaaattagaaaattgatgtttgggaggtcatataatttgaattaaagcctcccaaagatatctgtacacttacctggcaaaaatagctttgcagatgcgattaaggttatggaagttaatagggagattatcctggattactctggtaggcccaatctcagtgtgagcccttaaaaggaaagaattttctctggctagagtcagagagaggcaagggaagaggaactggataagatgaggcataaggggagatcaaagacaatctaagacttagaaggacttagccactattgctggttttgaacaccagtggagctataatatagcctgaaaatgcaagaatactcttgaaggaaccccagtcgacagctaccaacataaaaataaataaatacagccaataatctgaatgagcttggaagtgaattcattttcagagtctacagaaatgcagtgctacagacattttgattttagcttggtgagagctatctctgacttctgactgaccaaactgtgtgagagtaaattatattaatttaagccacaaaatttatgataatttttatgacagcaatagaaaactaatgcaaaagttatctcagtaactgtcaaaataagtaaagaaaaaaaagcaaggaaacataagatttgaacattgaaatcagcgaaattgacctgatgtattttaaaatgatgtatccaacaactatgaagtttattcttttcaggcacatggatggaacatataaaataatttaccaaatgctgggttttcacggatgtatcaacatgtcccccacatggctaaaattatacagaatgtgttttctaatcatcaaacaattgagcttaaaatcaataaatacaaactagaaatgctccttatagttggaaaatggcattaaattaaatacttacaaatggcattattatatatagaactacccaacagtatttacagaaaaaaaaaattacagttaaaaagtgagttcagcaagtttactgcagacaaggtcaattttttttttttttttcagagttttgctcttttttgcccaggctggagtgcaatggcacgatcttggctcagcacaacctctgcctccagggttcaagcgattctcctgcctcagcctcccgagtagctggaattacaggcatgcgccaccacacccagctaattttgtatttttagtagagatgggttttctccatgttggtcaggctggtctcgaactcctgacctcaggtgatccgcctgcctcagcctcccaaagtgctgagattacaggcatgagccactgtgaccgtccaatattttttaaaagaaataaattttatacatcagcaacaaataaaaaatgaaatttttaaaagtaatccatccatggattataatacctaccaaaatggagttttaattatatttatttattttaagttcaattacactttgaattgaaagaaaatatactctcatgttttggtagagatatggataatcacaactttcatacattgttggtagataagtaaattggcacaattacattagttattttgtagtgtcaacaaaaactgaacaggcagacaccctatgactcagcaattctactctgttgaatatacccacaataaattagagcatgtgtatatcaaaaatcatgttgagaaagattcttcaaagattttccatagtagctaaatctgctgacaatacaaatatacagtgatgctggtgctggattaccatttgttagtttcatttgtctttcttaaaaacatttcatttaatttgttctgtacttcagatttctcacctgaaaacgaaaatggtagtattagaatttttgcctcacaaggttcaatgaagacacataataaattttaaaatagaaagaaaaaagccccacaacttttccatgtatgataaatgacctgcatattttatgactcttgtaacagactatctgaagctggttatctttataccacttatctgcaacaatactgcatatgtatttgctttttgttatgatatctacccctttaaaattgaatctgcattaaagctggcactttgtttttcattgagtagaacagtgcctggcacattacagaagtactataagtaggtttatcattaaattaggaatggcacagttatcatacagaaaaatatcctataacatatatatttctacgctgatgttcctgagatagaaagcaagagtttgctttgagttaaatttatgaagaagctcatatagagtaaattttttaaagaaacgagtataacctttccagattattataataaattacatagattaaaacaagaataatgacaagaacaacaaaaaacactttttaaaacttgataaatatgaactatatgaattacggtctatttataaaacattagagagaaattatgtatttattcattatatgactgtcatgccacttgagatttttttaccctacttttcatgtcccggaaatactaaactcattgattaagcaacattaatatgattcccctttgaccaaatgtaccttttcttttcgttgaaaggtttttctagacgcacggctctataaggatcaacgcaaagggtcccaagtgcttcacagtcagcttaatgaatttgtgtttaatcaagttctgtttctttcagtattaataacatgaaattttaaaggatgcttcataaatttacatttaaaatgccattcacaatttaggaaggtgagtattagcagtttaaataaccttgagtttctgaaagaatcaagttttttggtaaatattgacataacaagtatatagaaaattatgtcctgcttaccaggttaaatgtcttcaaactttagatttataataattttaatgtttatttttcttactccttttgtcattaggcatactcattaggaactaatttcatactagaccaattttaaatttgttcttatccaaatttgttcataataagaatactgcatagatatgtttaccacatttctgatatcatacctcctgactttgaatgaaataaaggtattttacaataataagtgaattataataattaccattgagttaccatttattaattgcattgtgtgccaagcaaattctaagtgttttccatgaaataacttacttagtacttatagatagctgcccacagactcaaactttgtgtgttcattgttttcattttacagatgagaaagtgtagaaatagggaagcattaatgaatttgctcaagatctcactgctgataagtagccaatctaagtcagtaaccaaaacattctcactccaaaactgagcacttgctcaccatattgtatacatacattaggcaagagactgatagggcttgagtacatagagaaaattccatgcgattttgaaaattcatatttatttcccgagtcttaaaatctgaaagtgtagagtgtaagaccattaatatgaataaatattaatactaatttcagaaaagttgcacttgattcagtttagtaaaataatcatgttcaaggttcagtgttatgagaaaagggaataatctattgagtcacacagcataggtttcagttttaggatgaccacttcctacctgtataataatggaaaattaattaatttctaatggacttagttttctcaattaaaaaaaactataatacttttagggtagttattaaaggttaaaggatacagagaatgtaacatgagacctatggtgctgggtgcatgcaatgaatagataacactcattgaatggtaggaacgatgatgacaatgagctttctaattatatccagcagtttctgctttcatccaatcatgattcctaaaatattattctaaaagtaaaatacacctattttcaccatgaagcatttctttttgaggaaatattttattaaactttacagttgacccttggacaacacgaattttaactgtgagggtccacttgtacatgcagtttttcaactaagcatagatggaaatacaatattcatggatgtgaaacctctgtgggttttacagggtcaattagggacctgagtatgtgcagattttggtatatacatgaatcctagaactaataatctggctatggcaagggacaactgtatttttgtttttaccaccttcttttatggaataactgtatgtcatgtcaattctaattatatttctagttatatttttgaaataagaaaaataaatggttaacatagtggtataaccaaacaaaatgaagaatgctaaatcccatataacagcaagactaataaacatacttttaaacttcattctattcacagatgggcactttccctatgataaatttgtcaattcaaatcaacacaagttctgatttttattctattcaaactttgtaagagtagcaaccagaaaatgccctttaattgatcatgaggggacactgtaaaagaccttacttacaaaataatagctataggatgaagaatagaatgataggatgatgatgatgatgtaggatcaaaattcaatggctgaaaaagcagatgtgattatatggttataaaaagttataattgactgaatatataacctttaataacttttctatagaatcccacaaatttatgaaaaaactctaaaaggtaatgaaatgggacccatgaagatgaacaccctgcccaactacatgcataatagttagctcaccatagaggtaatttttaccaaaatgccagggctttggtctaggtcctgccgctcaccacacagaaagccaatcactgaggcaacaaacattgccagaaaagaaggatttaatcaggtgcttcagccaaaaagatgggagattagcctcaaattcatttctttggctgactaaaattgccggtttatatagcagggaagaaaagtaatcatatgtgggaaaatgggaattagggaggggaaatgaaggtcaataggaagcaggtggttggttagacaatcaagacaggtaagcggtctggcatctcattttcctgatgtggcgatctggcaaactccagttccttgatactacctgggaggtctaatggttggtttcctgggaaaggaactcagacagggcaaatgtaacttttgcaagtttcagaactgggagcatcagtttctaggtttattcagacgaaaacataaacatcagttctgtgggatgattagaccagtttcagtatttcttcttacctggtattacatgctgatttaattagtaattgcatattaatttattttaaatattattatgcttgtttctcctaacatgacataatcatatctttcatcaatacctactgcatcaattagctcttaattttaaacaatgagtttttaaatattttagcttttctttgaaattttaaaggaatgactaaaaacatttttaatgattttatcaattagcagacacacaaaaaaccaaacttcagccaaatgaaagcacagaaaaacatgaaaatctatctcttcctctctgtttactctgtttcattctataagtatatcttattaaatttgttgacaaataattggttcaatgtgcattatatttataaaaattaaatgtaatagaagtaaagctatattacatttaaacattatttttcttatattaaatgatatattcaagtcttgagctttgttataatgaaaatggtaatggaaatggtctatttacaactatattttacattatttatttaaataatatgagaacaatttagacctaagtgatattttaatagaagtgtacagttctcatatgtcccatatacagttccctgattgttaacttcttaaattaatatagtacattttttgtaacaactaataaaccaacattggtacattattaattcaaattcatagcttattcagatggttttagtttttgtttttttttagttttttaaaggtttatttaagctttaaaaagttagagcactatgtacatatatagagaaccaaatttattcatttttaattccctgtgttttgttttttgtttttattatactttaagttttagggtacatgtgcacaatgtgcaggttagttacatatgtacacatgtgccatgctggtgtgctgcacccattaactcgtcatttagcattaggtatatctcctaatgctatccctccccctccccccaccccacaacagtccccagagtgtgatgttccccttcctgtgtccatgtgttctcattgttcaattcccacctatgaatgagaatatgcggtgtttggttttttgttcttgcaatagtttactgagaatgatgatttccagtttcatccatgtccctacaaaggacatgaactcatcattttttatggctgcatagtattccatggtgtatatgtgccacattttcttaatccagtctatcactgttggacatttgggttggttccaagtctttgctattgtgaatagtgctgcagtaaacatacatgtgcatgtgtctttacagcagcatgatttctagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcatttgttgttccctgacttttaatgattgccattctaacttgtgtgagatggtatctcattgtggttttgagttgcatttctctgatagccagtgatggtgagcattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcgaaaactttctcccattttgtaggttgcctgttcactctgatggtagtttcttttgctgtgcagaagctctttagtttaattagatcccatttgtcaattttagcttttgttgccattgcttttggtgttttagacatgaagtccttgcccacgcctatgtcctgaatggtaatgcctaggttttcttctagggttttttatcgtttaaggtctaatgtttaagtctttaatccatcttgaattaatttttgtataaggtgtaaggaagggatccagtttcagctttctccatatggctagccagttttcccagcaccatttattaaatagggaatcctttccccatttcttgtttttgtcaggtttgtcaaagatcagatagttgtagatatgtggtgttatttctgagggctctgttctgttccattgatctatatctctgttttggtaccagtaccatgctgttttggttactgtagccttgtagtatactttgaagtcaggtagcgtgatgcctccagctttgtggttttggcttaggattgacttggcgatgcaggctcttttttggtgtcatatgaactttaaagtagttttttccaattctgtgaagaaagtcattcatagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcagttgtgaatgggagatcactcatgatttggctctctatttgtctgttattggtgtataagaatgcttgtgatttttgtacattgattttgtatcctgagactttgctgaatttgcttatcagcttaaggagattttgggctgagacagtggggttttcagatatacagtcatgtcatcatctgcaaacagggacaatttgacttcctcttttcctaattgaataccctttatttccttctcctgcctaactgccctggccagaacttccaacactatgttgaataggagtggtgagagagggcatccctgtcttgtgcccattttcaaagggaatgcttccagtttttgcccattcagtatgatattggctgtgggtttgtcattgatagctcttattattttgagataagtcccatcaatacctaatttattgagattttttagcatgaagggttgttgaattttgtcaaaggccttttctgcatctattgagataatcatgtggtgtttgtctttggttctgtttatatgggggattacatttattgatttgtgtatattgaaccagccttgcatcccggggatgaatcccacttgatcatggtggataagctttttacctaatgtcctgtttgattccaggtccccatacagaataacaattacttttatttaccatgtttcttcagtctcctctaaactgtgatagtttttgctttttttttgtttttgatgaccttgacagtattgagactcactggtcagacaatatttctttcctcttactaattgataaatagtcacatagaggtagatttttgtgtgtatgataaatatacagcatatattatatgtatatataagtatgtcatacattaagtgtatatataccatgtaattatatataatgtatactatatgtcatatataaatacataactattttatactaatgaaaattaagttgaaaatatgaaacttcttcagcccttactactttattgtgtatttcctaaaaccaagtttagttttcaatttttttagtctcaattttagcatttccacaatacttccttgactttcatgaccttaatatttttcaggaccagaggagtgtataaaatgtctctaaattttaattcacctgatattttctcatgattcgtagactttgtgcatgaatgtttcaaaaatgatactgtttttatcatagcatgtaacacaaaagacacacaatgtatctgtttcattattggtagtgatggcttttatcactttgacaaaacagtgtcttccagctttcccttctgtatttaccagtaattttgtacttaatacttaataagtattaaagctatattgtggggaactaggttaagactgtaactatcctgtttctcattgaacttttacccaccatttttattagtgattgttgaaatattattttttgaaatataattgaggaaagtgtaaattactgtggttggctatatttcttcttctctttgctccttgagcgcttattgaatgcttttcaatggtttaggcatgttctagcaatagagatttgattactaatgtaaaggtttgcacactgaaatcatggtgaatttggaaatttattaaataatttgcttgctgagaaccaatttttttctgacagtaataattatttgaagaagagtttcctaaaatgcaggtactggctaatttgattttatgtctccttttgtaaaataacccaaaatatttttcttagggcccaaaataatttatctttaatacataatctaaattatatggtttcagattgtctgtgaatcttgggttctgttatgtgccacattttgttttcctgtttatttctcattttttcagaagttcattaatagtgaattctaacatttctcaaataacatattgcacagtgtttaagaatgaatacttttaaacaagacactgtgccatatattatttgagatattttataattaagttgaatttatttctccttctgtaaaataacccaaaacatttttcttaggggcccaaaataaattatctttaatgagatacataatctaaattatatcatttcagattattcaccaagtattagaataataacatcaggcagaagctttctaagcctataattttgtaaccataaaataagtatgataacaaaataaataatgatataaacttgtattgaggattaaaggaggtgatacttttaaaatacttagtgcaggttttagccattttttttttttttttttttttttttgcaatcctcctgttttggaaatacgctttggaaatagtgacagatttgaaaaccaagagtttctccacacatgaaagtgtagagatacacttataaacaggcagtaattagtggaacattattgagacttcagctttgtggtgaaattaacattacctctgaatctatctaatttgagtttttgctttccaaatccatttctcatagttttatgctattcttttacatttcattgtggttatatcatctccttccatttaatacatatattttgaacatctgtttttatcagaattattctggtaaatctaaaagcacagacagtattcatgagaagcataacactgacattccttatagagttgaatatccttttttacatattttgtgtgttttgtttacaatttctaggtataattaagtgattttttaatatgaaataaattatggtttagaaacatggatcatggagttcaaaactcgatatcttcaacttttcaaggaataaaaatcactgggccttcaggagcatccccatttatggaatttctttgaatatgcagtactggcacttaatctaaagttaaagaaagaagtaagactaatctctagttcctcttacttgtccccatttttctcttccataggatgggcacattctctctgagaatcaggaaacagttaaaaaagagaaagagataaggagattaaaggaagtgaaagaagcacatattaatacatttctttttactttaagcatgtacgtgggaatcaattttttagctgttttacaacattcaagtattcaaatattcaacaacttctaagctcatatgggccgggcacagtggcttttgcttgtaatcccagcactttggaaggccgaggcaggcggatcacctgaggtcgggagtttgagactagcctgtccaacatggagaaaccacgtctctactaaaaacacaaaattagccaggcgtggtggcgcatgcctgtaatcccagctacttgggaggctgaggcaggagaattgcttgaacccaggaggtggaggttgcggtgagccgagattgtgccattgcactccagcctggccaacaagagcgaaactcgtcatctcaaaaataaataaatagataaataaataaataagctcatatgtatattcaacttaagcttaattgctcctcagtttttagtaaagatagagttatttatcattctctgtaacagtaataattctttttttattttaaatacacttatctacatgaatttgtctattatttattcagagaaagtaacccttaatattaatcatctagtctttgtgataaaaaatggaatcaagatttttaatgaaatcaagatttttaacacaggtatgaaaaccatattatgttaaagggaatctgaaaaacattaatgaaacagaataaaatagatggaccaaggacaaacaaaaaaaacattaagttgagcaaaagaagccagataggaaagggtacacactctattgaagtccaagaacaggcaaaactaagcaattttgattgaagtcaaaagcagctgcatctgacaagatagtctgtacagggatattaggaaattttacagtgtgataaaaatattatattttttgtgtaggtgttcattacatgggttcatgaaattgtcaaaactcaacatactgaatatttaagatctctgcattttgtttaatataaattgtaccttcataagttaatgttaactagacaaaaagggctatacctcttttcttatgttttctttaatgttaataaatcattacaagataacttgcactgtatttgaattcaagaatatgtattttttttatcagttctggaaagttttaagatggacttcaaacggatgtttgatttggaaaaatggttgaataaaacaaatgttatatttactagttaaagtaagaccaatataatggtcacagaaacaatgatttggcaaacgatattttctcaataaataatcgtagattcagagacattgtaatttcataattgtcagaaaatgttgaatttttcaataatattccactgatgactgcctgtttacaaaatcaactctggatttcatgtgtggagaatctttggtttaaaatttctaaatttaccatttctaaagcatatttccaaggcagggattaattgcaagaatgaatctataacattattttatctggggagaaagttaaaggatgaatcatagttctcattgttgattaaacgtggaagattccttcagtttcactagtaatgataatttgtacagaatgttgccttatcttgattgggttttctaggagattaattgacatgaagtggctgcctaatactataaatcagatcaatgatattaacaattggaaaataaatgtgtagtgttttaacataggctgatatgtaatcttgcatcactaaaggtaatgcttcttttttgttaatgtctattagtagaaatagagcacctgccaccccggtagcatttctttcatcaaatcatcattatatgataagtaactgtagtgattaattctgtttcagcttatctaaaattcagtatccttcagatattctccatttttcctgggtaggagaaaacaaaaaacttggattcttgaggaagcatgggaaaaagtaaaatctcatcaatcgtattttaaatttttcctctagggtggctctttttgggggcaagtttccaaattgaataatatccttttgtaccaattgtcttccagttgaagaggtattatttaagttgtgtctattacataaaaatatatgttttctcttcttaggactctcatatggtttctgtttaatcattaaagccattagaatctatcagaaggcattggtgtggaatacatgtgtaaactattttaggtattcagaaatcattttttagtattttattttttactaaactttttgtttctgtgttgatatgacacatgagactccagaaaatatgaaacagaaaatcattgttatctaccaacacaatgatattgatgccagtggaattttctaatcaccaaatatatatgtacaacacaatattatgatttgtggaggactttctaccacatatccttctcaatattttattccaagtgaacagcataccatcggtttcgtgaatataaggttattctacttgcatgtgcttgctgtattgggtcctattatggttatagtttattcatggacagtctgtagaaaattttcttgtaggaaaactggcaagagcatgggaagaactagacttcacagtgaaatctacatatttttcttcatggaagcaaaaaaaggtgggcagggttttttgacagtgagctgccagaagctctggccatcctgttgcaattgaacagcataatgaatgggtggaaatcacctctaaaagtgaggttgtccgaggaaccaggaacaggcaggtagaggatgaggatgtggatacagtattccagtatagaggccttgtagaggatttagtatattaaaatatgaagaaattgtgaaaagtttcagtctcatctgcataaataatatatataaataagaataattaattgagtttctactgatgaaccagtttctacaattgatgctatgaaatatttttttaaaaagaaaaaaattatggtctgtctttaaagagcttttggatgcaaataggctgtcaagagggaccttttaaatttatttcagttcactactaacactctgtttttgcatacatttcaatgctacctgcccatttaggtgtgggctttctgccatgtcttttgtttggtttttgtaatgataataaggtagttgtgattttgagatatagcattaaagagttatctatgaaacataaggtaggtctctttgttcacagttttataatagcacaaaaaagatctgaatataatatacatataaccacctactatctatctatctttttttttttttaaattgagacagagtcttgttctcgccccaggctggagtgcagtgccacgatctcagctcactgcaacctcagtctcctgggttcaagggattctcctgcctcagcctcctgagtagctgggactacaggtgtgcaccaccatgcctggttaatttttgtatttttagtagagacaggatttcaccatgctggccaggctggactccaactcctgacctcaagtaatccatctagttcagcctcccaaattgttgggattacaggcgttagccaccgtgtccaggcctattatctatctatctatctctactctcaaactcttaaactctcagacttgaagcagcaatcctcctgcctcagcctcccaaagtgctgggattacaggtgtgagccatggcatctggccaggatctactattttttaaaaaacattttttctgcttctactttcttctgcttttttgcatctggcataggcctcttcattagagcctttttagacttttcagacctcccatgtttgcccatataacttatcttcttttttctcggctatttctctcatattagcctcaaccctatctcatatgtgaacaggtctaccatttgaacaaatcatgaaatttgagcagatcatgagaaaaatgtatgactgatccattttgtgttgcattttacatatgaatggctatttgtacatgcttgcacaatctagtagtagaaatacacaggagtgatctgtgctaagacatttgccttaaatgtggaactatggaggagagcaaacctcaccttgggacaattcctgagcctgcccatcctcccctgtcagccagtaaataccatatttgtgaaattagggagaaatttttactgaaattgtcaagaaagacagccatgaatgaaagaacatgctgaaatctattgctattacactaatgcttttcatttaattttcaaggaatctaaaattttgtctaaaaaagaccttaaaattatatttagggatgattcataacctttatataatatcattatagaaaaaaggttttctctattcctacggctaatacaattgtttctcttttattttctattcaaagatataaattaatgaaatttattatagaatcatatttctacttgcaatttttcagaaataataaaagtatatatggccacacaaatatgattagggaaatttacctgtggcacacaaaatgagctcatattctgaaatgagaacatttgaaattgaattactctttggattaagcttaaaattgaaaccataagcaaatgcatattcaatttttttcctgtggtctattatcaatctttggtaggcttcatcagcaagtatattttttgaaagtcaatcaaagaaatacaatgtagagtttattttaaaggactacatattaaacattataacaatgtagagtttattttaaaggactacatattaaacattatacttacaaatgtgatttctgcatggaaaaagccatgtcagtgatgaagaaaaatattacttgatggtaatatattaagacatcatgctacttttatgtggccttttcatcatttcaaaaaaacattgtagagctagagaaaaacattgatcttttcaatagtttgcatattgaatttagaaatatgccttcaactttacaaatattacattgtaaggactaaaatctttcaaaccatctattccaacaaatttctgtcatataaatatttattccagaaatttaatcttgattaagagtggcaaacgtgaagttctccctggatgtcctatatcttccccgcaagaccaattttatctccctaagttgtagggctttgggatcctgctcttcaaaataaatctggtccaatagtatacattaccccagtaagcagattgaaaggcatgggcaccccctttatttcctcaaaatttccacagacgatactgtttaattttttaaaatttgtttgttttattttgattttttgttttgcttttatatctacctccatgacatagtattttttggcaacaaaatttttaagtttattagatatatggaaacaaatcaatgtcatccaatcataaaatttcacagtttgaaaattatggataaacctggaagacattatgttaagtgaaacaagccaagcacagatattcagatactacatgatcccacttgtatgtggaatctaaagtagttgaagtaattgcagcagacagtataagagtggttactaggggctgggatatggattgagagatgttggtcaaaggatacaaaatttaaatttcttgaactaataaattcaataaatctattgtacaacatggtaactatagttaataactatctatttttgaaaatagattttttaagtgctctcaccacaaaaaagtatataatagatatgttaattagcttggtttagccatcacacaaggtatacatattttaaaacaacatgttgtacacaacaaatatacaaaattctatatgttgatttaaaaataagttggtaataaaaatatcaaagtacagctacataagaatgggtgaatatttataaaagataaggatgtcttttgcaacaggaattccattaaaaaagaaaaatattgaacgtcagcttggaagcaatttagctgactaacatttctactaaatctatccccagtggtccctcgatgtcctcataggtactacttaaacgatctcgtctcacttcattctcagctctccaaagtttgccttcaatgctgcctgctaggaaactgggccttataaatcctgaacttccttgtacttatggtttatttttaagtcataattatattcttttcctaaatcagagattgcaaactagtgtagttgttgaggcaatgggcatattttattttacctatttatattttaatgtttaaaaatctgttgtcagccgggcgcggtggctcaagcctgtaatcccagcactttgggaggctgaggtgggcagatcatgaggtcaggagatcgagaccatccttgctaacgcggtgaaaccccatctctactaaaaatacaaaaaattagccgggcgtggtggtgggcgcctgtggtcccagctacttgggaggctgaggcaggagaatggcgtgaacccgggaggcagagcttgcagtaagccgagaccgtgccactgcactccagcctgggtgacagagtgagactccatctcaaaaataaataaataaataataaaaatctgttgtcaatcttagcatcaagatattttatatacaattaaaatattagaagacttggtagcatgggctccatattccaagatggcaagaatttgctgggattgagtagcagctactagtagcagctaccctctctgagtagcatcagagagggcatgttctatctattttccaccgtctcatcatgcttgcttcactcatttacattacctgagggatccttgtaaaatgtgaattttcagtttctgaaagtaaaactgaataaggcaacttttttgttgcctcttaagctatttttaccatcaaggaatcctagtcaaaaattaagagaacaaatccctgagcaaacattaaaagcgtccagtctgtagaggcacagagcttatgtttattgatgaagtgcatttagttcctctaacaatgcaatgattataggaacaaagtgcaaaatgcaagcacaagaaaaggggaatcatcttctgatgtggcgtgtgtaatgctatttgaggggtggtatgggagaagctgatatctaattaagttgaaatttaactaatgagtagtatttcagctaaaacctaaaaactgggaggggaaaatttaaaaaaattactctggttataagagcacattgcgcaaaaacctacaggtaaaaaaaaataacggtgattctcttgtgggcataagtaagaattaagactagcaatttaggtcacacatcaaatcatggttttgtatgccacacatattaagttctgatgttttaatccaaaatgaaaagatgttgctatctctccagctgctgtgacctgatcatgttctactcaaccaatatcagaaggactcaagaaactcccagtattttcctctaatatacagactattcattgtctccaatttctctttctcaaacttgccacttgcatataatcatcagcctggatttcattgctcactcgtaaatcgtttattttaaactaactttttcttacagtttaaattctagcctgtgggtaacattgcatcaagggttttgaggagaaacaacagatgcagtttctccacaggagctaacatactaatggctataaattggtccaaatgtgtttaacacggaatcagcgtcttctgcttcttcgcccatagcaagaatcacaaagttggacatttcagacattttaagaactcctgtgtaaggctcaaaactgttcttttgaaacacttcagtttgtggttgtgggctgccaactggtatcttcctttaggtaataaagagctgatttttatgctgtaacatttctggtgtgcagttgataaaatgaaaattgatatttaaaatcttttttcctttcagctcactccagttggtaccacaatattcacaggattttcaggagacaatggagctacagatatagatgatggaccaaatggacagatagagtatgttattcagtataatccagatgatccggtatgtaaatacctatttgcaatgtaattttcttaaaaggaataaaattaatgattttttcagctgatagttattgtattattcagtaacttccagaaccagattagtaatgatactattatttaaaaatgtctcaaaattgaattatttgtaatatttatgctttattgctagaagctaatttttgatggtatttttagataaggtttaaaatatattcataggtataatatgcctcatttactaaatttctgttatgtttgtggtctccaaagcattctaaataaatcactggagatgagataacaagtgtcaaacatgaattttatgcaactcataaattaataccaatattgttgctatacctcaagaacacacaccaagtattgctggagttgataagcctttaaacttctagccgtccaccagttaaaccaaagatagagaagaagacaagacaaagccactagctatagtctgttttattttgttgtttttcttcctttttttccattagacaagatgatttctttttttttttttttttttttttttttttttttgagacggagtctcgctctgttgcccaggctggagtgcagtggcgtgatcttggctcactggaagctcaatttttttgtatatttagtagagatggggtttcactgtgttagccaggatggtctcaatctcctgacctcgtgatccgcctgcctcggcctcccaaatagacaagaagatttctatgttgttttttaaggccatgaatcatttcctctaatgacatattattcaaaaaaacagacaaagtaagattttttttaactgaagctagagctggaagccttgcctcacatctccccactttctttgaggcagctcctcaaaatcccacgggccccccaaagcaattataaatgcactacttaaataagctttcaaattgaatgcatctcttttatgtttaataaatattagaaatataaacaatggtgaagttaacattttgcccttatttttaccattgtatgttgtagataaactttagacagacaagcaaaaacaaacaaacaaaaaactctattgggatagtagagtctgagaactcacagtaagatctacatcacaaatttattgcattatgttaagtaaattgtggatgcattttctcattttatcctcacaaatcagttaaaagtagtattatctctgttgcatagcaaagaaaactcgtaagtgaagtgatttgggtcatattagaaaactacttctgaactgtaaaatccagtttcagtatactcttcctctattgtgttctcacaaaaaaaacttgtactggctgtgttaaaattttaataaatttggaaaataagtatatatatataatatatatatatacattttattagcagggtgaaggtcagattttagagtcttgttttttttttttttttttttttgctttgtttctctaaaagaggacttttttttaggcagagacaataaaaccaagagttggggatatgatgagaatgtgacagagaaggacagtatgaagggttacataagaaatgaagtgggaagtagcaaagaaacagcaaagaaaagggcagcagaaatgctttttcttaaatgtagaaacagctgactgaacattcgattttgaaaccatttattttgtttgctctttaggtatttttttaaagaattaattgtacgtgtgcgccatgtttctagctcaaattttatgaaggttactttctaatctttactccccaaggtgtaaaaataaaacctcccagcaagtatcaaatgactagtccatgttttttagggagatatttattgcatgcataaaaatattcaatgtttagatatagtttgagagcaaaaatatattactttaaactatctttctgcttaaaatgtagacagttaataaggcttaaattcttttttaactgtgcaataattctgtctcaatgcctccccattccagggaagtgtaggtttgctgtacaatataatatgtaactcttactccctacagagtggataaaccaatcaaccacatgcattttcaaaattacaaatgaaaaaagaaaaataaataatatatgttttagcaagctaaaatgctcttaattctgtggaaaaaatagtaagacatcatgacacttaacttaggatgtattgaaggaaaaaaggattaaccaaggtacaatcttagggagagaatccacttttagacttcatataaaattagtgtaaacctcagtaccagtttcttctcttgtaagacctgtgagaaaatacatgataaattttatgttctgctactactaaatctctagtaattctgcttacattaatagcaccatagtgtggcacttttactagtcaaaataataacatttcaataaagcaaaatattgtaaattcttcaccataactattttatttaatatatgaataaaattggaataattaaattgagcctttctgttttgttgcaaatctttttttttatgtttcaacttatttttatttttattttttattttttattattttactttaagttctagggtacatgtgcacaacgtgcgggtttgttacatatgtatacatgtgccatgttggtgtgctgcacctgttaactcgtcatttacattaggtatatctcctaatgctgtccctctcccctcccacctccccccgcaaatctacaaagaacttaagcaactctttttattgcaattcaaatggtgttctaaaacaaagaagcaacaagtttgggaataaatagttgctgaactgattgatccaatttaaagtgaaagtgttacagtagtgtgcattttcacacttctataaagaataactaagactgggtaatttataataaaataattttaaatgactcacagttccaaatggctgggaaggcctcaggaaacttacaatcacagcaaaagggaaagggggaggaaggaacatcttacatggcagcaggagagagagagtgaagggggaattatcactattaaaccatcagacctcatgagaatgccctcactctcacaaaaacagcagggggaaaactgccccatgatccagtcacctcccaccaggtcactccctagattcatggagattacaattcaacatgagattttagtcgggacacagagacaaaccatataattccaaccatggcctcttccaaatctcttgtccttttgacatttcagaaccaatcatgccttctcaatagttccctaaagtcttaaatcatttcagcattaactcaaaagtccaagttcaaagtttcatctgagacaagtcaattccctttaacccataagcctataaaatcaaaaacaagttgttacttccaagatacaatgagggtacagacattaggtatatacacccattctgtatgtgagaaattggcccaaataaaggcaccacaggccccatgcaagtccacaacacagcagggcagttattaaatcttaaagcttcgaaataatctcatttgactccatgtctcacatccagggcacattaatgcaaagggtaagcttccaaggccttgggcagctatgtccctgtggctctgcagggtactgcccctgcagctgccttctcaggctggcattgagtgcttgtggtttttccaagcacatgatgcaagctgtctgtggatctatcattctaggatctggaggagacagtgggactcttttcacagctccactaggcagtcccaagtggggactccaattccactttttccctctgcattatgctagtagatgttttccatgagggctccacccctgcagcagatatctgcctggacatgctggcattttcacacatcctctgaaaccaaggtggaggttcccaaagctcaactcttgtcttctatgtacctgcaggcccaacaccacatgtaagccaccaaggcatggggcttgcacctctgaagcaatggcctgaactgtacattttagccatggctggagctagagtggcagggacataggatgccatgtcctaaggctgcacagagcagtggggccctggtcccagctcagaaaaccatttttccctcctaggcctccaggcctgtgatttgagcggctgccatgaagatccctaaaatgccctggaggcatttttcccattgtcttggctattaatagttggttcctcgttacttatgcaaatttctgcacccagcttgaattttcccccagaaaatgggattttcttttctaccacatggtcaggctgcagattctttaaagttttattctctgcttcccttttaaacataagttccagtttcacataatgtcttcatatatgcctatgactgtatgctttcagaaaaagacaggtcacatcttgaatactttgctgcttagaaatttctcctgccagataccctaaatcatctttctcaagttccaagttccacagatctagggcaggggcaaaatgccaccagtctctttgctaaagcatagcaagagtgacttttgctccagttcccaataagttcctcacctccatctgagaccacctcagcctggacttcattgtccgtatcactatcagcattttggttgaaagcattcacaaagtctctaggaaggtccaaactttcccacatcttcctgttttcttctgagccctccaaactgttccaacctctgaccattacccagttccaaagttgcttctatattttcaggttatcatcttaacagtactccactatcccagtaccaatttcctgtattagtttgttatcacactgctataaagatactacctgagagtgtgtaatttacaaagaaaggaggtttaactgactcacagttctgaatggctagggacacctcaggaaacttacaatcatggcagaaggtgaaggagaagcatggtgtatcttacatgcagcaggaggcagaaagagcaaaaatggaagtgccacttttaaaccatcagatctcgtgagaactcactatcgggagaacagcatgggggaaactgcccccataaaccagtcaccacctaccagatccctccctcaatacatggggattacaatttgacattgtaatttgttttgggtggggacacagagccaaaccatatcaactagatggttaggcagatatgagcagggcaggagaggaccacccccaggaatgtcagctgatcgtcaggtgatggttaggtggcttttaaactttttctgtaaaagaataattgatcacagccagtgccagggaaatatagtctcccaatagatagaaaacacttgaagctggtgatcagcagcttcccaataagagcttagaagttgggcaagagggctgaagcatgcacgttaagaggcaaaatggcagaatttcactagtatatgacctttttctgggaatgttaaactggtaaggcaaaaatgcctcaagtaagcatgcaacaacttcagtaaacatactgcacatgaagaccctcccaagtgcaccagcaggcactgtgcatgtggacagcctgccccaaaagaaaaatcaagggaggagaatggcaaacccccaaaccatgccaatgtagaaaacccccaagtgaagggatgaacaaggcacttggatctttcaagtcacccacttagccgtcttccaagagtattttgcttgctttcattcctgctctaaaactttttaataagctctcactcttactctaaaactcacctcaatctctccctctgccttaaacttacttcttcccctaaatcacattctttcctctgaggttaggaccgagttgctgcagacccatatggattcactgctgttaacaaaagcacttgagctgtttaccaaaaatgtttggttcttcctctcttttgattcatactagaggtgtacttttcttgcctggagaaaagtatttgctttgactaatgaaatgtaaactcaaagaaccaatatacaagtaatcatattctctgcccctgctgttgtgatcagagaaaaacatgttgaggagaaacattcattagccaatgacaacaataaaaagagaccacttgctgatgcatattagatatgtagatatgaaaagtaaagaaaaaaatgaaagtttaagggtttgttcctgcagcattccctatcctttcatggctgatgtatttagaaaaaaataatttagtaaatatcttcttctaaaagtcctctagacaattgttaaataaaaatattatttaatgatacattaaaacatggtaagaaagaccttattcaggaccactgcaataggtatagaaatcattgcaatgaggtcttgcagttggagagagatattggactcaactaaaaataaagcatgggcaagtgggactttataaccaaggagcagggtcagggtcactggatggaaaattactaggaggaaacatcagagattaggggaattctggctaaaacacgctaatacgattgttgctgaagacaagtcagggtgatcagacatcacctaaggggtggtgcaggatgagaaacctgatgagttttcaagatagatcattcatcaaaggtagaggagttcttggtaaagtgatatagtatggttctttgttaaaaagtgattttatgaggaagtatacagatgagcctaggagaagattcagaagcctgatcaagtttggccaggcaaagaatctttgtcagtctgcactattgttcagaagaagaagcattcttctttcttttgtataagttcattttctcatttggtcaccttttgtttattaagtaccacttgaattatctgttggaacttggtagtagacaatatgtaaaaatatgtactggacaatatatgttgtcaggcctttaattaggggcatttaatttctatgcaatttctagtgtactcatcacagttattgtaaaatactgctgatttttttttttgtttaatgccttcatggtaatacaaagtaagagtgttcataatgcactgaactaattcagaggtgtctgtctaatcttttggcttccctgagccacactggaagaaaaagaattgtcttgggccacacacaaattacactaacgtgaatgacagctgatgagctgataataaaaaatcacaaataaatcttataatgttttaaggacatttacatgtttgtgttgggccacattcagagccaacctgggccccatgtagcctgtgggctatgggttagacaagcttgaattagtttgttttgaaaaaataaaagaagaactctgaaattgataagaatttgtcatcacatgatctgcagtaactttcatttttgagaatttgtcttatatggaaaaatctaaatataggtattctgatatattaaatctcattgttagcaagattgataagactatttagacaataattatcatgtctttttgatctttttttttattttaatgccagactggaggcatgtttattcagcattttaagtttgacctaaagtgataaggaggagactgatgacatgtcccttgtagcagtctccagtttactgaggaagcagcataacattgttattcactactgttactactcagaaaaaaaaaatgaagacacttaagcaatatgcataagcagcttctttctttgaggtattacagtggtgtttcagtgggtggtaacatcttttatcaagtcctcctgagtaaattgtccttcttttgtaatatgtttgactccccgtagctttgagataattcagaaaatgtaagccataattttcatttgtaatgtgtaagcatttgaatttcctgagtcaggaagttaaaaccacattttaaggacaaacgatttttaaaaaaatcaccatcctgaagtagttctgtgtgtgtgtatatatgtcaaagtccaaatttcagatgtcaataaaatatttaaggttaagctaaaacagtgattacttattcctaggtaggttactaaaaaatttactgtagtttaataatacttttcagggtacattatatcatgagatttccatgcctccataaattcataatattctcattttactggaaactcatgtataattaagactggtgtaaaggccttctttgtgtaaaacttcgaacctcagtcttttcacaccaaggctgtgacttttaagtttcaaaacccaaccaaacacaaatacagtttccttggaagttggatggaataagataagttgaactgcattgtaatcataatgcatcattaaatgtgaatgaatctgtttgtatttgtgtgagggagagtggtaaatttatattgtaagcaaatgttctctggaaaggaatttggacgaaagagactttatttcagtgaacagttttcaaaccatggatatacagcctgtggtttcaagctaagacacatttcagagaacaaagagagggttagggttttatagctatagttcccacccaggttcccaataagctgtcttcatccaaatgaaggatagatccttgcttaattctgattggtcaaaacagatgagtcatgactgttctatacactgattggttgattcaggtgagctctgattggttgatttccaagccccaaaccagaagtttctgtcagatgtttctttcaaagggctagtgctaaagggccagtgtagggatggcatagggggcaaaaggaagtagttccagctgtagtttatcttggcaccaagaacaggatctgtttttgctttattgttgtgttagtccgttttcacgctgttgataaagacatacctgagactgggtaatttataaagaaaaaggggtttaatggacccacagttccacgtggctggggaggccacccccatgatttaattatctctcaccgggtccctccctcaacacttggggattatgggagctacagttcaaggtgagatttgggtggggattcagccaaatcatattactctacacctggcacctcccaaatctcatgtcctcacattttaaaaccaatcatgccttaccaacagtccctcaaagttttaactcatttcatcattaactcaaaagctcacagtccaaagtctcatctgagacaaagcaagttccttacacccatgagcctgtaaaatcaaaagtaagttagttacttcctagataaaatgggggtacaggcattgggtatgaatatatatatatatacattccaaatgagagaaattggcaaaaacaaagggtctaaaggccctatacaagtctgaaatccagtggggcagtcaaatcttaaagctccaaaatgatcttctttgacaccatgtctcacatccaggtcatgctgatgcaagaagtgggttcccatggtcttgggcagctccacccctgttgctttgcagggtacagcctccctcctggctgctttcacagtttggccttgagtgtctgctgctttccaggcatgcagtgcaaactatcagtaaatctactttctgggttctggaggacagtggccctctactcacagcttcactaggcagtgcgccagtggcaactctttgtggggacttcaaccccacacttcctttccatgctgccctagcagaggttctccatgagggccctgccccttcagcaaacttttgtctggacatccaggcatttccatacatcctctgaaatctaggtggaggttcccaaacctcagttcttgacttctgcggacccataggctccacaccatgtgaaagctaccaaggcttggggcttgcaccttctgaagccgcagcctgagctatgtcttcactccttatagccatggctggagcagctgggacacggggcaccgagttcctaggctgcacacggaaaggggggtccaggacctggcccatgaaaccgcttttttctcctagggctcctggcctatgatgggaggggctgccacaaatgtctctgacacaccctggagacattttccccatgccttggtgattaacatttggttcctcattacttatgcaaatttctgcaactggcttgaatttctcctcagaaaatgggtgtttcttttctactgcattatcaggctgcaaattttctgaatttttatgctctgtctcacttttaaaactgaatgcttttaatggcactgaagtcacatcttgaatgttttgctacttagaaacttatgtcaccaaataacctaaatcatctccctcaaattcaaggttccacaaatctctacgtcagggacaaaatgccaccagtctctttgataaaacatagcaagggttacctttactccagtatcctcatctccatctgagatcactttaccctggatttcattgtccgtatcattatcagcattttggtcaaagccaatgaaaaagtctctaggaagttccaaacattcccaccttttcctgtccttctgagccctccaaactgttccaacctctgcctgccacccagttccaaagttgcctccacattttttgatatctttacagcaggaccccactctaccagtgccaatttactgtgttagtctgttttcacacttctgataaagacatacgtgagactgggtaatgtataaagaaaaagaggtttaatggactcagttccatgtgcctgggaggcctcacaatcttggtgggaggcaaaaggcatgtcttacatggaagcagactaagagagaatttaatcaagtgaaagtgatttccctttataaaagcatcagatctcatgagacttattcactaccacaaaaacagtatggggaaatgccatgattcaattatctcacaccagctccctcccacaacacgtgggaattatggaagctacaattcaagatgaaatttgcatgaggacacacccaaaccatatcaattgtagaaaggaagatcctgtgatgctttgacatctttctgagaacacagagtatgcgaccactttgtcactcaggcatggccacctggttttgttggttttgttttaacttacttcagttagtcatagggagtccattttgtctgtcagccagggacatgttttaacagtatgaaacagaaaaaatgattagagtgttgggactttctcttaggagcaaagttaatgttgcctgctcaaatcccagtccctcttgggtggacaaaaattgcatagccttacttagtcctccactttttactttaggaaattagattagaggagacacacaaacaatgacaataacatagaattttcagcagctgatggcacagtagcctgagcttaatcagagacaagcttaaggctgtctaaagattgataagggcaaagttgatgctgcttattggaactaaaacacagactcacagttatattcaatgtgaacaaatgggggaaacccaaagagagaagagagaggtacagaaaaagacacaaagataagggaagatacttcaaaaaaaagtgtcaaagaacaagagaatttacagagataaagagaaaatcgtaattatctacatttccgccacttctcaattacaggcccattgaggcacttttgtactaagtctctgtctttaggtcaccagaaaatatatatacacgtgtgtgtgtgtgtgtgtgtgtgtgtgtgtgttctttagaaattatcttcttttgaactgaatttctagtcatcacagctgaaaagagaatattacaaacaatgcttacaacataggtgtgaaaggctggagtctttccctctttcctaaaaatgatgaatgaccaaatctatcagctgagaagaaatagtgctaataaccccatattccatttctagagcatctttaactgtaggattcaacacctcctttcagagagctgccgttttatctaaactggtgcaaacccatattagtaaaggggattctggggggatggaatcatcttgggaaacacagagttgctagagcctcaacattccttctctctccattattgaatgtgaatgtgtgtggcgtggatgttacagctgtctcctaccctgcttcccatatctgtgatagtgataaattgcttaaactgccttatgcccttattttactaaatggagaattgtcccttatttgacagttgttgtcactgaactgtcagaaagtagtgagtggacctttcttaatggaggccaggtgtttggggcgtgtgggtattaaatcatttaaccataattggatttttctcattaatacagtgcaggtagtcagcacttaaattcttatcacccaaaaaagccaatgttagtttgtattttaaagagaatatccacgactatcagaaagggggcaatgtcctggctttagaaatgtaaggttgcttaagtaaatgggcattgctctgttcccaaacttttctgcctcattggtggaacaaatctctaagaatgaaagaagagaaaaataaatagcaaggacagagagtgcagtcactcttagacttacgtagtacagtggtttctcaaaagtaaaacctgaatcatctgcatcaggatcacctggtaggtttgttaaaaatgccgattcccaagaatttcgggaattttgggtaatagatgctaggaatctacagtcttaatgatacatgcctatgattcttgtgcattctaaactttaagaatgttctaagtattgttttgtttttttcatggctttatcatgtatttatttattaaaaaatctacttttttcccttgcttaatttagcttttttttttttaaactttttaggtaaacacttcagaaatatcattaaagcaagacttttacttagggttgatctaatccagtattctttttactagaggaaaaagaagactatcataaagataccaaagatatctatattttgcttctaattttcttgattattattctacattttagagacagaatgaatactcaataattgcttaattaataaattaaatttaatacagtggctttcaatatgcaacatttcagaagcaccattgatgataaagtatatcctattcttatattttatagaatacaagtgctaacaaaatgaaaatctaggccagggatggtggctcacatctttaatcccagaactttgggaggcaaggtgggcatacccttgaggtcaggagttcgagaccagactggccaacatgttaaaaccccatctctactaaaagtaaaaaataaaaattagccagatgtggtggcacatgcctgtagtcctatctactcagaggctgaggcaggagaatcgcttgaacccaggaggcagaggttgcagtgagctgagattgcaccactgcactcaagcctggatgacagagcaagactgcatccatctcaataaataaataaataaatacatacatataaaaagtaaaattaaaatctaagaatctataaaatctctaaaggatagatttaagatgataagaattcagtgcaattgaaagtgctctgaagatcaataaagtcactaataactattatttttaataattctacaaacgtccaatgaaaactgtcaacaacaaaaaaagtattgcaaagattcattaagttgcttagctagacatttaaggataggttatttctgcatcacagactgagacccttgaggaatctgtcaagcaaaacagaagatcccaaataagtgttttttggaaaaaataatgtgagatcacatcaaagacttaagtctaaattacatttaagaggtttcactgagtaaagtttgcaaagattagtacacagagaaataagtgatgggatatttaagcaagagaaaaataagagcaaatatcaggtgtgaagagccatggcctgtttggagaagagagaggcctacagtgtaaacacatagagacaggaataatcatgtatcaaagtgctttcagctgcagaaaatttactatatatatattatatatataatatagattatattatattatatataataatatataatatagattatattatattatatataataatatgtaatatagattatattatattatatataataatatataatatagattatatatatattatatatatgtaaaaaactaaattaaagatgatttaaccaaaaaggtaatttattatctatcataataagtttttcagagatggggtaatatcaagatttgctcagcaactcaaagacaacacagatccgggctctttttattttatactctgctatcactagcatgttagctatttctccgtaattaattttatcaatagtccccaaatggctgctgaagttctaaattttatatcctgacagaaacttctataacctgaaaagggatttttagcttctctctatctttgcaattaagagaaattttttcattactcaaaatggaatcacatgtacatttgcaaaatacttcctggtaaaagagaatggaattactgtttttaagctagactattcaagactcatctcatttagagacatagcctcctctgaggcacaatgtcaccagatatgtgagctaatttggggttctgagtccagagatgtggtagttttgtggtaagaccacagtatcttccatatttatgctagaaaccaatatatatttctatattattgagtcactaaaatgtaataacctcataacaacacattaggataagtttaacagtgtaaacagcaattattaactaaggttttgcccatattcaacttacatgtttagattcaatcattttcacactcctgtgtcataatgccagccccactcataggtataagcaaagttgaataggcaaaaaattagggaaaatgtcaaatgtctgtttttaattgtgttgttcattttcattttctgtatttatattttaaattgttacttttaaatgactgcatccaagaacgatttgcaaggcccattacatgaggagcacagaatgaatcatttaaaaatatatattaattctgcaaaatgtacagtgtgtgtgtctttatgcatccccgagagaaagagagatagagagacaaagaaagaaagaaaggagacagatcacagctctagacatggaaggctaaactacacacatttcattgattgagcctgagctgagagatttgaatcagctttttttttttcattgagtttaacttcttatgtgactcttaggaatacacttacactaagttgagggtgtgaacactctctctctcttcctctctctctctgtttctctctcacatacacagtttttttcttcttccacacttccccttccctttctcttctccttccccttgccttttcctctcatttttctttccctctctttccttccttttgcagcaatctaatgcagattcaaactaaatatttcacaaaaaaatcacaagcacaaatacacaaggcaactgaacaaccacaagacaatttcagtgaacaaaataacactgagttattgagcctactagaaacaattttatcattctttaaaatggcactaaaatacaaaagtgacataaggtcttcttaagaataagagatttatcttataaattatactcccttaaggtgtgaatacagttacactgagggctgcttataccagagcactagtgttgcccttatgacttccatgttaccaggaaaaaactcagtcctagacagggcagagaacttaactaatgagcagaagttgtggaacctaaaagaaaaaaatgatatataacctggatttttttttccacaataatgaactgattcaagttcacgcagtcatgctctgcataatgacattttggtcaatgatatatcacatagcaaatggtggtctcataaaattataatgttgtatttctactataccttttctatgtttagattacatttatagagaaaatactgaccattgtgttacaattgcctatagcattcagtacagtgacatgctgtacaggtttgtagcctaggagccataggctatatcacttgtcctagtatgtagtaggctgtaccattttaggtttgtgaatctacactctataatagtcacacaatgacaaaaatcacctaacaacacatttctcggaatgtacctcatcactaagtgactcgtaactgtatttttttttttgtatttaatgccagataatacttaaaaatacttaaaatacagaatggatatcaatgttgacaattgatactatgtagaaataacagatttcagtgtttgaatgctttggtgttaaagaacacagtgaaaagataatgtggtaacagggaagtttttcagatacctggactttgatttagaactattccaagactgttgatgaataatactagtaatatattaaaaactatgacaagaaacaaattttctggttattattaccaaaggactctggggaaacccattgatcaaaattaaatgtttggaagtatgataacaatattgactctgaagcttatagtcattctattttcagatgataagcatgtcatctctaacttccaagaggattaatccaaaatattgagttattaattcatcttacattcaaataatctgaagtctgtatctttaatatttgcagacatccaatgacacctttgaaattcccctaatgttgactggaaatatagtgttaaggaagaggctcaactatgaagataagactcgctactttgtcataatccaagctaatgtgagtattcaatttcttttaaatttcttctgtgaatttatgaagtaaaaaactcatccaaaatgtatcagatactcttggagagctctgtgccactcacttcttcatcagggcactcctgcccttggtgtttatatataatactcttatagatggagaaagggatagaataggttgtttttattcactgtattctttgacctctaaattattcatatgtattatccattatccaacctttttagactatactgaaatatttttcaaagtaggatcctgcaaattaacagcagcagaatcaccttgggtgtgtattaaatatacatatttctggaccctacctcagatgttctgaataaaaatctcagatgatggaagtggaatatctgcatttttaattagctcttcagggaattctaaggtacactaaaggcaaagaatcattgcctaattggtcgtgttcttcctcatggctatcatttattgagtaattgttcactagatatcagctaatattcccataactgaagtttatgctaatgtatgtagataacaataacaggacatccaaacatatgcttgtaaaacacagacatggtttatatacttataaaacatagatatccttacatgcttatataacatagacatgcttatatgcttataaaacatagacatttattatagttattattagtggaagtttaataaaatttctggaattatgcagctcaatgtttggtttgacagttcaattatatcaccagggacttaggttccttccatccttatacttccctcttctctggaatgtggttattttcccaatgccttatcagctgggaggtatttgtgtaccatggccataagcatcacaactgcatttcaagtctgaatgcaacaggcagaaagggtagcaaaactaggatttcttttacgtttattgattcttccttcttttatctgggaagatactctcttcagagttttctcccatccaacatctccttctagacttgtatcacctgtgtcagcataataggaacgaaggttgaggaagtccatatgtgtcaaagggatatgcggtattcacttctgaattatactatgtatagttcatatcctgagactgggcacactgatgacctgaaaacatttttcttttcttagcaagatgaatgggagtaccccttgagaaaaaagctagaaggggaggtcacataaaaagtcccatattaagtgacaagcttacgtttttgaaataaccgttaagaaatgaggcataaagatataaaaagtatggagaaatcttgaatgcatacttataagcaaaataaaccattaagaaaaggctacatactggatgattccaatatataacattctggtaaaggcaaagctggggaaatagtataaagatcagtggatgtcagggatatggtggtaaaggcaggtagaaagggattaatagaaggatcatgaaatatttttaggtcagtgaaaatactctggatgataccatgaagttggatagatatcattatacatttgtccattcccatagaatgtacaacaccaacggtgatctttaatgtaaaggatgaactttggtgattatcattgttcaatgtagattcatcaattgtaaccaatgtacaactttgattagggatgttgtaagtggggaggatgtgcacgtgtggagacatggtgtatataccttcctctcaatttttctataaacctaaaactgctctaaattaatagccttttcttttttaaagcagctatactctgaagccatcctgtgcctttaatgactcctaagcgttgtaatcttgctcatacagcagaacagatagatagcaggggatgctaaaaggaaaataacctcaattagctgttctgaagaagttaacatgaaaaaatgtgccacaaacttgtcattttcttgcctttcttagagatatatcacctgacacagaatgtgtatgtgtatagatagatacctagatagatatataattagggatatgtagatagaaatatgtagatagacatatagatctaatttttgaagctaagtttggaagcttttatttatatttcttcagattttaaaaatgatttattattttatatattataattatatattataagatgttatatgtattatgtgtgtgtctgtatgtgtgtatatattttaatgtcatgtaacatagagcagagtgaaaactgtagatatggggaaaagtaaaatgtattagggagggccactcagagtttttcaaaaacacagaaaattcttttttctatttaactgaagatgtgaagaaaaggtagaatgtcttttttatgaagtcagattgctgtggaaggtatttgtaagctagtttttttatcatgcaattaaaaagatataattttttaatagaaatgcaaggtaaaagattctgaattggtgtctagttttaaaatatttataaagacatctggaacaacttctatccaacatgatggactactcatcactgaggtagtgacaagtttttagcatttcagggataaagttataaaacagaagtacatatgtgaatcatcaaaaggaaggaatagcattaggaagaagtcgaatgaacatttgaatttaaatgcaataacagtttttgttataaacttaagtcatacagtacacaatgaaatgttaaatatagaaagttataacattttaagcatttttaaaagttttaagaacaaataattttaatagctacataatgtaagataataataatggatcaccattgattcaacaatactccgtttttgtttatttgatcatttgtttttggcaccaaattgatatctaccctcatgatgttcaagagaggcagtgagtgtagtgaattatgtcacctgagttcaaatctcagttcagccatttactggctgtgtgatttggggcatgctttgtatgttaatttcctaaccagtaaaatgggtatattaataaaacataccacattgttctggttacaattagctagttagcaaacaaaaaagtacttagactaatgcttgaaatatattgagacattattacagtattatataaatcactaaaatactggtactttactgtttaaaaatcagtaattaaaaatggaattgctttgagaaaattatatgtatgcatatatatgtgtatatgtgtatgtgtatttgtacatatatattcacatactttttaatcttagtagataatgctatattatttttcaaagtgttgtgacatatcacacttccacaaatgataaagaaggatgctcattttcacaacattttaaatctgtaacttaaaactgtgggttgttggaggtggaaagtcagctgagacttgcttgagggccaattgtgggtttctctttcaaactctgagttcagtgatctcacatttgcagccatgctgggagcatttacagtatggaaagtgccagtgctacaaatcagggctacttatctgatagctggttgttaatcattaactgttttgtatataccaatagtaacataagtctaacatatctttgtttgtatatgataatgatatccatatatctaaaatgtacctccattttttttacatttatcttgtttgtttgtttgcttatttatttatttattttgagacagtcttgctctgtcacccaggctgaagtacagtggtgcgatctcagctcactgcaacctccgcctacggggtttaagtgattctcatgcctcagcctcccaactagctgggaccacaaacgtaccaccacacctggattttctttttgggaggggaggagagtattgctatgttgcccaggctagagtgcagtggcatgatctcagcttactgcaacctcagcctcccatgttcaagctattctcgtgcctcagcctcctgagtagctgggattacagatgcgtgcaaccatacccagctaatttttggatgtgtagtagaaacgaggtttcagcatgttggtcaggctggtctcaaactcatggcctcaagcaattcactcacctcagcctcccaaagtgttgggattacacgcatgagccactgcacctggcagtggttttttatattgtgttggtggtatgcacaatgtaagtcatgtacattaagcaccaatatattatcttgaagtcataaggagaattaagatatgagcaatcaattttgactttaaagtatatggcctctaaaagaataattacaggtatcatgacaaattattgaacattacccagctttgacctggttttgcttatgttaaaaatatttgattttcgaagagaatccttcaaattacatgtagtttggaggtttctttttatccgtgtttacatgttatgatccgtaattaaggtaattgagttttgactgacccatattagaaaaccctgtcacatatttttttgagaatatttgcaatattgtcacccatgctattgacttcaaatataaatacataatgaaggaatgattaattccagacaaaaattttgggggtagatctagaaagatcaaatgggttttctttttgttgaaatttactacatattattataacctcaactttgatatgttaccctaattcacatagaatcaaagtaatctctttacatatcatttttcttcaaagcaaactctcttttatattattgttatcctgagtgaaatatataagaacacttttgtaatcaagatttcttaattaccagaaagaaaaaagtttatatttacttattttataatttatttatttattttgagatggggttttgctctgtcacccaggctgtagtgcaggggggtgatctcggttcactgcagccttcgcctctcgtgttcatgattctcctaactcagcctcccgagtagttggtattacaggcatgtgccaccactcccagctaattttttgtatttttagtagaaacggagtttcactgtgctggacaggctggtctgaaaccattaacaacttcaagtgatcagcccaccttggccttccaatgttctgggattacaggcatgaaccactgtgcccggcctaaatttaatttagaatcatggcaagaataatttataatttctaaattattttatgaatagcaagggtgttgtatatttctcaaatagcaaaatctagagaagggatgctagctatctttcctaacaagatataattcctaaaattataatattactatttctttattagctcaattttttatctttatggacagaaatattcaaataaaatgtgtaagcattgcaaacatatgtgtttgtataggtaaaattaattttctatattttatatttcaaccttgtaaacaacttttcagaaataacctctaccctgaccttccctcacttctgcttcctactgatgtgtggaattagtgttaattgtaaccccattgttttaactctgcaagtttcttgggcattttctgaggagtgagagtgaaatgggaggatagcaggtgatggtttatgggacctaatatttactgagtgtttggctactaaagatacatgagcatttggggctataaatgataatataattctgtctactggtttgcataaaaaataagaaatattaggcaaatatctcaaacaaaaaatgtttacaagacaatagaatacccaacttcctctggttaatgttcatagaagcattatttttttcctcaacttttattttaagcacagggagtacatatgtaggtttgttgcatgggtgtattgcactcaggtggtcagcatagtactcaatgggtagttttttgatccattctctctccttgccccagcagttcacagtctactgttcccaggtttatttccctgggcacttggtgtttagctcccattgaaaaactgatattatgtagtatttagttttctgttgctgcattaattcacttaggattatggcctccagcttcatccatgttgcttcaaaggacatgatttcattcttttctatggctttgtagtattccgtggtgtatatgcaccacattttctttatgcaatccactattgatgggcacctaggttgattccatgttttttgctattgtgaatagcatggcaattaatgtagacatgcatgtgtctttttggtagaatgcactatttttctttgtgtatatacccagtaatggggttggtaggttgaatggtagcttggttttaaattctttgagaaatcttcaaactgctttccacagtgtctgaaataatttacatacccaccaacagcatataaccatttccttttctctgcagcctcaccagtatatgtaattttttgactttttaataatagccattctaactggtatgagatgatatctcattatggttttgatttgcatttccctgatgataaatgctgatgagcatgttttcatatatttgttggctgcatgtatgtcttattttgagaagtgtctgttcatgtcccttgcccctattttaatgggattgtttgtcttttgcttcttaaattgtttaagttccttatagattctgaatattagacctttgtcagatgcatagtttgcatagcttttctcccattctttccattttctgtttactgtattgacagtttattttagtgtgccgaagctctttagtttaggtgctacttgtcagtttttgtttttgttgcaattgcttttcaggatatcatcattacgaaatccttgctaaagccaatgtcaagaagagttttaataggttttcctctaggatttttatagcttgaggtattacatttaaatctttaattcatcttgagtcaatttttgtatgtctggtagaattcagctgtgtgtctatctggtccagtgctttttttggttggtaagtttcttattactaatttaatatcacagcttaatattcatctgttcagggtttcaatagtttcctgattcgatcttggaacattatgtgtttccagaaacatatcactttactctagattttctagcttgaggttgaggagacacaattctgttcagagtactggttgaacttgtttaactttttaaaagatattcttgcttgccaactagaatcacagtttcctaacttaatgtaatatcctgttatttttaaataattgaagttaaatatatattcttattttttaaaaaagaagagaaatgcagatgaaaatgggaaagggaagaaaggagatcttctttgtggattttaatatatattagattatcacataacgtaaatgaaaacataattaaattatatggaatgtttatagaaatagttattttttattttttaccactcacaatttagaatgttatttcatttactcagaagagccttgagcagtagtatattactataaagatcaaaagtgtaggttgttttgttttttctgtttttgttgtttttgttttgatttttatctcaattgctgaaggattattttttaaatggatattttaagatcaaatctgattccaaattgggagaacatcatgaattagcattaccattatgggctcacaagttatgagtgtgcatgagacatatttttatatattttcctatgtgatatgtgttggtgataaaatgtgggagaattcccacgtgtggaaactgttagtagattttgttgctacatctctgctcacaatcattttgccaggattatttttatttcccacttaaaaatacaaattttagagctcaacactttgtaagcaatatctttccccaatatgagaaaaaactcctattatgtattttggtatacacttcctgtaaatacactatctttaacacaccagtatctattctatggagtagtgacaatgacccaaagaagcagataatagtgagagatttgatgctgacagactgaaagaaaacataacattaaaaaattcaaatttgtttattatagtgatttgatgattacatataaagaaggctgagtgacatggaagggtagaaatattgcctctggcatttatatgcatgtatgtgtatatatgcatatatatgtgtgtttatatctgcatgctacattcatgtatcacataaaatattataaatatttaatatttattatctatttactatttttataaattaaatttagattaattcaatcttttaaaacttcataagcaatcattattttaaatggtgggttaaagccaggcacatacctatagtcctagctactcagaaggctgaggtgcgaggattacttgagcccaggattttgaagtcagtataggcaatgtagtgagattctcatttctaaaataaataaataaataaataaatattttataaataaaaaaattttcaaatattaactccagtgccacaagtaaatttacaaatacatattaaatatgtcattttattaacttatttgttattgagaaaaatgtcaaatgtaaaatcattaataaatgtaacaaaagtttaccacccctattaaagaagcttccagtttatatatatatatttagaaatttaaagatttgttttagttcttaaactttaatataactttagaaatatggaagatgagattacttaatgatttaaaacactggatgatgcaacacaaagggaaatatatgtgaaaatataacctactaatctttatgaggtcacattatcttaacattagtaattttcagtactaaatgactctcttaataatgggatgaggaaacatgtcctcatcatttttttaagaccgtcagaagcagtgtattggaatctgccccttggaagctactcaggatatgctgactgaacaaatcattacatcatttgtctattaattcatatattatagacatagctataacccaattaaataaaagatcagtattaaaaaagtggcaagtttgatgagctatttttttttaaaatttaaaatatacacatacgcttattttaaattaatatttttctacatgttcaaaattcatacatcttaagaataatttataaagttaatttgtgaaccaccaaaattatctcacatgccacatgttgctcctactctacttttcaactggcctagaggttgatatacatatgggagtgcatatacacagctccttaaacagctaaagaagaaggtgtatatatttaacacaatgagagggaggaggcttctaagggaagaaaaactaggtttctaggagtcaaaggggagattaaaatagcttgtgatcatgtttatgtaggtaagaatagatttccttgttttttcttcattttcataaactttcttggcagagggaattcatggcagcctcactctcataagtatctgcttttagtgacataaaagaagttcagaaaagacttctttctgtttgttgaatctcaaatgtctttaggtttgaataatctttatagtgcctctagggatctgagtgagttccgaaactttgaaaatttaaacattttgtgtttttttaagctataattttatcgcagtctgtcttatactgtataaaaatatcaaagaatcctggaaccacagagttattacattctagacaaggttgtactgacaaaattccaccaacagaaattcgtgtttcctaaaactttaccctcaagcattgctttacaagtttttatgagcaaccagactgggaatgagcttaaccaaaatgtactattaaccatgtttaacaagagggactttttttttaattggaaggcaaatattaatgtctgggaactgtcacaaaggaagacattttatgaacaaaaaaaaaaaaatacaggtctgttagtataattacttttaaaaattatttaacataaattagcaaaataagattagccattttaaagtgaacaattcaatggcatttggtacactcacagtattgtgcaaccaccgcctctatccagttcccaaacattttaatcactccaaaaagagctggcaccactcatgcagttgctttccatatcccctccccagctccttgtagccaccaatatgtttactgctgccagatattgcatataaatggatcgtataatatgtgaccttattttttgtctggcttctttatttgaaaacatgatgttttcaaggctcattcatgttgttgtatatatcagtacttcatttctttttatgcttgaatcatatgctattgtgtgtacataccacaatctgtttatccatttattcattgataaatatgtgggcttttgccaagttttgtctgttgtgaatagtgctacatgaacatgcatgcaagtatacttgtcaatgttgtacaaaatagaattcaaaaaggcagaaaagcataatagttcttcaaaataataactaaatgctgtgaaagtaaaaacatttccagattctgtcataatgaatgatgctaccaccaccacccttgacaatggatgttcttcatggaaatgacttaggtccaatattattttcttctgtcctatgacaaacattcttcagataaatataaacaatttacatttctaataaaattactacccattctttaagtgtgtgctgtccatcatgatttccttccaaagaaatgaaagggaaacaagaaagaggaaatttatagttgagaaaactgactagatacagcctcagccaggtgatgaagttaacaacagtgataagtcatattaatcatatacttttgataaatatgtcaaaatagcagttgacttgtggttttcctacatacatcacataaccgcagttgaatcttgaggaaaacaccagataaacacccattaagggacattctgcaaaatatccagtgctcaaaattgtcaatgtcatcaaaaacaaaagtctgagaacttgtcacagccaaaatgagcctaaggaaccattatgactaaatgcaaactggtatcctgattgggatcctgaaacagaaaactgacattaagtaaaaactaaggaaatctaaagaaactttggattttagttagtaacaatgtattcctacagcaaaattgcactagacaaagttaaatgataaggaagactgtattcacagctattgcaatagagaagagagaccagaatacagactagatctgaactgatctctaatagaaaaaatggctggagagctgttaaacactccagtggacttgggtgtgggggaatcacagaccagatgtgtttactaattggcattcccaaaggaaaataaatttccttgaattttcatgacagaaagtagttttagaaattggagcaagcctccaaaggaagtcaggctcctaacctcccacagaaactgggaaatacgggcttcttccttgactattacatttcaaagagatggccccccagggcatgaaaaagatgggcctggtttgtagaactgacaagcagcttataaaagattaacacctcagaggcgcagagaaggaatttacaattacaaggtttctaaagtaaatgctctaatgagatgagagtgacctttatggttaggctgtctagtaatgtgaactgttaggtaaaggcctaacatacaaaagcttaactactgtaacatactttcaagaaagttgctttgaagacaattggatctcagtttacatcctgactcaaccacttaaaactgttggtttaagcaagttaatttaccaatcttttttttttcaatgaaaactaagtctacattgtgcctaatttcttttttgttgttgttttttgagactgagtctcactctgtcgcccaggctggagtgcagtggcgtgatcttggctcactgcaacttctgcttcccaagttcaagcgatcctcctgcctcagcctctcaagtagctgggactacaggctcctgccaccacacccagatttttgtatttttagtggagacggggtttcaccatgtttgccaggctggtatcaaacccctgacctcaagtgatccacccaccttggcctcccaaagttctgggattacaggtatgggccactgctcctggctattgtgcctaatttctataaactacctgttgtttgtttttctccctaacaggaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggtaaatatactcttatctttctccatttatttgcatgttttaaaacccaatgggatcatgttcaagtattttgtagacatataatttataatagcaaaactcagtatatgcacattgaaaaatatttatgtccgaaactattttcagggagtatgaatacatttttaacacaaagagtaattatataatttccaaatagaaagtatgttatgaaacaacagtccaacatggttattttattttatttttttaccaataaatcaccaaggaattcactagccattctgaaaaactccaaataatcagtgcagcattttcttaaattcatatttaaacatgcagtcgtaagtcagaggacacacaggtcaataggatacatttttggcccagtagaattctgaaatgttattggagattatgtttggccgtttgaaggtaggagctaacaaatactgaatacaaatacttacctcttaaagtaaagatatagaaaggtgaagcatgaatacatattttctacacttaatcctgtatttttgataaatgctaatggagctataaatttctgtcagtttggatttcacagcttggacctccccagatgattgatgtacatacctaagaataagaattttaaggcaaatggatatcctgctgaggcaaaaatatcaatttctcccctaaaaggtgtatttgtgtgtgtgtgtgtgtgtgtgtgtgtgtgtgtgtgtgtgtgtgtgtatacacatattctgtttttaaaaattccgtggtctaggatttaaccatttaaccagtatttttgctatttccctggaaagcaatcagctctctgggttcccaaaatggctcaaagtgttagaatttgttggaagctacttgactttttttcctcaaaatacatgagaactgaagttctgagggtcctctatttgagattttgaggaatagaacaggaatgcctcctaaatgtaaagccagagtgcttatccaatgttataatattaatacatctattggtttttctcacagcagatctaaaatagctgagaatcacttttgagtctactcacagcaatgatcactggtccagttaacttgcatgaataaaaaaaacagctggagagaaaaataaatagttatgtgcattggataaaaatatgttttcagccaaatgaagtatttttgcaggcaaaaaagctaatcagaacttgactggacaaaatagatgtagaatacctaaagttatatgccattatgttattttgttgaatcccagccaaaaaaaaaaacaaaacccaaaaaacaaaaacaaaaacaaacaaacaaacaaaaaaaacacacaaactattaaagatggtgaacataaaaattttacttgaaaggactggtaaaagtaatgatgacaaacataatttttataaggctgcacacctactgccatctgcccttcgacaaagctgacaaaagtagtggcaaaaagacttcctattcagtaaatggtgctgggagaactggctagccatatgaagattgaagctggacccccccctccttataccataaccaaaaatcaactcaagatggattaaagacttaaatgtaaaactccaaactagaaaaaccctggaggaccacctaggcaatactattcaggacaaaggcacaggcaaagattttgtaacaaagaaccaacagcaattgcaacaaaagcaaacattgacaaatgggatctaattaaacttaagagcttctgcacagcttaataaactatcaacagagtgaacagaccacctacagaacgggagaaaatatttgcaaactatgcatctgacagaggtctaatatccagcatctatgaggaatttaaaattacaagaattaaataaaaacatcaaaaagtgttttcttttggacatgaacacttttcaaaagaatacatacatgtggccaataaaaaaatgaaaaacagttaaatgtcactaatcgttagagaaatgcaaatcaaaaccacaatgagaaaccattgcacagtcagtcaaaatgactattattaaaaagtcaaaaaataacagatgctggcaaggttgcagagaaaagggaacacttatacactgttggtgggagtataaattagttcaaccatgtggaaagccatgtggcaatttctcaaagagctaaaagaagaactcccatttgatccagcagtcctattactgggaatatacccagaggaatataaatcattctgccataaagacacatgcacatgaatgttcatggcagcactattcacaatagcaaagacatggagtcaatctaaatgcccatgaatgacagattggataaagaaaatgatgtacatataccacatggaatactatacagctataaaaaataatgaggtcttgtcttttgcgggaacatagatggagtgggaggctaatttccttagcaaactaacacaggaacagaaaaccaaataccgcatattctcacatataagtgggaggtaaatgatgagaactcatgaacagaaggaagagaacaacagaccctgaagtctatttgaggttggaaggtaggaggagacagaggagcagaaaagatgactattgggtactgggcttactaactgggtgacgcaataatctatacaacaacctcccatgacacgacttcacctatgtaacaaacctgcatatggacccctgaacctaaaatataactctttttttaaaaaagtttcatttttatttatcttttaaaatatctacaagagggtgggtttgctccatgactaatcattgtttgtgcatgaaatttaagcatgtaaggttcaagtatattacgctggcattaaaatcttttaaaatttctacaagagggtgggtttgctctatgactaatcattttttgcacatgaaatttaaacatgtaaggatcaagtatattgggctggtattaaaatgtgcatttttgtttcattcgaaaatttctattcggaaagacaacagtgaaaaaacaaatatgctgaaacaaatatttaatacttgataataatctttttcaatcatccccatacaaatttggcactctgtattgcgtgtgtgtgtgtgtgtgtgtgtgtgtgtgtgtgtacttccaattaaaatccttttaaatataaaaaaggaaaaagaaaaatatatttttagtattaatttatgtttccgagttaatagattcagctagtgtaccagtgggaccccaagagaaggtatacattgaaaccgcaataatccaattcaatgagtcagtctgatgactgtttactagtagttagttcattgaggaaagtaaaggaagatagagactgctgcttgaaaagcagagtgtacaaacttaattttacaaagaatcattgaccttcctttcctctccagattacagactgagcatctctctcattcctatgcagtttaatgctagagaccagattatactttcaatttggggtaataacgtaagtgatcataatgtctagaggttgtatagaatgttctgttcgtaatgaactatgctaagctctgcacaaatattaactggttgcatgtgttgaatatacacaaaaacgtttctggtagacagtttaagtatatagatacaatttaggaagagtaaataaaattaagatacatttgagtcctagctctacatgcaaaaattgatagcaggttttttctggctctggcagcctgggttaagttggagattcactctgtaggtggacatagttgttgaaaaatatttatatccaaaagtattttcagagagtatgggcaaatttttggtcagaatgcctcactatctcccttgttgtactataatattcatattttgagtatcagtactcaaagtagaactagtccaaggataaaacttattcagtcttcagatgacaaacccagtccaatattaaatattgcatatcctaacataaggagaataatgaactaatggtgaagaaataagtcaggaaattttttatgctctgaatcctttgtaaagtagtgtttgggcaaagagcatgaaagatcctaaggatagtggattcttgccagtaaaaaaaggaggtctttaactgaagatcaataaatatttttttgaacaattactcttttattttcttttaaaaccttgctttttgaattaaatattatggaagaaattctggaatgatcaatcttgatccttttatcatttttaacagattgagccattccttaacatactttgaaaaaatgagaatttaagatttatacatttaagtaattatggcaaatatttatttttttatttcatgtacaaaaatatagatatatttacttgtaagcctaggcacttggtcagattatcagtcaccgtataacaggccaccaaaacttagtgggctcaaactacaatcatttaatttgctcactaagctgcaattttagcaagacttgagaaaacatcttatctttgctccatgcagcatcagctgtggcactttaactgagggctgggtgccactttcataatgattaacttagatggctaccaagttgattttggctgttggctggtgctcatccaggattgaagactgaggcttcattttcaccccactgaagcctcttataggctgttggggcttcctcacagcaagacagtgggttgtcacaacaagcttcccaagagaattaggcagaaattttcataaattagctatggaatttgaagggtcagttctgttgtagtcaaatctctgccagtttcaaggggtagaaacatactccacctccctatatgaggggtgtccaagtcacattataagaagagcatatggaaaagaaaatgttattgtggcaatctttagaaaataaaatcatccttagtactggcatcaggtttttatgtacattgttatgtatattgttattttgaatccattctagaacactaggtataaaaactggagttagtttttgagcttcacattcaaattactgtgtttatgtctgtacttttattctttttgattgtctctttttctattttcctttatatattctgctaaaatttcatgaaatttcaataagatcttgctctccagagtgaaagctaaccattaatgtcagctaaacagaacatgttgactctaattacatacttgctgatcctttcttgaaagaattcttcaaattttggaagacttgccacctgttcacctatgttgatgtgaaattttccttactttggtggtattcttgacttgagaaaccattcctaaccccattataatacatgcagaatttgtcagttcagaaaaacttttaaaaatatagtctattaataaatttatctcatgaactatgatataataaaaataaaaatcgctttatatcaaaatttaaagtcacttgtttagaaatacactgattttataaatgtagattacacggttttctaatataaacaactctctttggcaaattaatgttttcacaaacactaagattaatattatattgaacacataaatatatacatctggtgttacaaaggtagaaagcaattcatagtactctgctaatttagtattaatttgataaatttctataggaccttaatgtatgccaaactacgttgaggatgctaggcaagtaggatgaaataaattattgcccagatatattattatgtatgtttattcttaatttccaactcttttaaagttattatgtctgtaaagttaaggttttctggtattatgaaaaaagtctgtagaatttggagtataaaatccttggctttattttctaatgaagcacagataaaaccatgataaatccttatgcatttttttcaattgaacagtagcatacatttatgtgtttgcttgattggttggctgttttttcttttgcagtgttatttatccctggacagaaaaatgaatgatatattaacgtattttctatgcgtttactgtgtataccttcctttaattattgcaccatgtggttttcagtatttcaacatcagttgctcactgaacatggtcatctttttctctccccctgtttaaaaccattggattggatcccaataatttctagtgacaaacatctcaacttcaatctttgtcttaaaaaatctagctttcatgtcaaaaacagcttctctggtttatctatgaaaccctctccctccggggaagctttctcagttatcagaaaagtaatgatgattttcagtgatctacaacacttatcatttcttcttggcatagcctcacattaaatatattacagtctgggaaatctctcctctcttgcttttttatggaagtaccgttttttctcattcccttggtggccttggattttgcctcttaaatctttgatcacttttatttattttgaaatttattttaaaattatgattaaattttaaagagttccaaggcttctctcttttgtaattctttttttctcccttattgttttactaagattgagttgagcaaacctatatagagttctatttttcctcaaatagggattatgtatttgttgtagataagtcttctaacttgaaatctgtcttgagttccaagtttgaatttctcgtctttttctggatatttttaactgtgtttctggcagatgcctcattattctttctatccaattctaatgtatccatacttactatgtattgttactcctgtggtcattattgatttgaacctagacttcaatgacctccgttccaaactcaatcaatctccaaagccattttctgcattacctatatactcttactcaaatctgtttgacacctgtctatttacactgtcagaacatctatttaaagacatactctaaactcggcatccggcctccagtctctcactcctctaaccaccatcacaataaagccaaagttgtttttgtttttgtttttcaatacaatgctgatctgattttttggtgtttaaaaaggttcagtgttttccatcatacaccaaatgaattccacggcttttatcttatcattcaaagtaacttatatctgaccactttccagtctcatctcttctaacacacatagtacaacttgtctaggcacacagaacatcacatatgaccctgaacaactctgagaattaccctactttctctctgtttcatatgttaagcacatatttgttattgaaggttcatatcagttaacctaaaatgatagatcctcaaaactaatagtttctctttgtgatcccatttattcctactataaatattaaactcttcattacagtgtgttcatttactatgaatgtttttctttcactacgctatgaattctttaaacttctttgtcattatatcctaacttgaaacccattggcttcacatagcagatatacagtattttttttttctttttttgagatggagtcttactttgtcaccaaggcagtgcagtgacacaatcttggctcactgcaacctatgcctcctgtgttcaagtgattctcctctctcagcctcccaagtagctgagactaccagcatgtgccaccacacccggctaatttttgtattttttcagttgagacagggtttcaccatgttggtcaggctgatctcgaactcctgacctcagatgatctacctgccttggcctcccaaagttctgggattataggcatgagccaccgtgcccagcctgatattttttgcatattttgaattgaattaactcatcaaattttcaaaatatgtttattatgtaataagtcattgaatataaatatgaataatcatggctcttgtcctctcagtctcaattaaagtatattggttgtaaaggtacatatgtgaagtgtgtgtgtgtgtgtgtgtgtgtgtgtgtgtgtgtatgtacgtatatatatgtttgtgtgtataaatacttattgtaattgtagattatccaaatatattatttattttatacagtctagatcaagtaatcatatatcccatttgccatagaaagtcccaggttataattcttgtcccagcatattgttaataatgtctccttttgtttttaatagtgttctaaatattaaagtatatcctcactgagtcccttggccaatcactttcaaaattttttctgtggatatgttttggggccagcaaagtgatcaatgaagagggaaacaggtggtagctcccaaactgcccacagccttttaatgcgaagatcgtttgtcaaaatattttgaagaaacaaatgataaataacacatctagagtcaacatatgatgtgactgccattttgttcttcccatcaacaatcgcacacaaacacaaactaaaattcagcaagtattgtcctgaatgtgaaattgtattgtgattctaaaagtggtgtgtgacatgggggcctgtctgggggtcggggaataggggagggatagcattaggagaaatacctaatgtagattatgggttgatgggtgcagcaaaccaccatggcatgtgtatacctatgttacaaacctgcacgttctgcacatgtaacccagaaattaaagtaaattttttaaaaagtcatgtgtgaagtaatatgaaagcaaaggaatccttggttctccttatcattggtcaaaatgtatttgaacaggttcaactatattcaactgtaatataccatagcaccaattatagataatgtgaagacattgaaatttttagtggaataaataaataataagaaacaggtataaaataactattaaggaggcaaaaaaaagaaacagtcgaaaggaggaattgagttcgttagtttagttgtatgaacaaagtcactattctgctgaataacaagtatgaagtctaactcttcttgttaaggagtttgttcaaagtattactttaaattaacctttgagctatttttttctatgaaacacacacaaaagtaaaagatgtcaagtccttaagcttgtccctgatgtttataagttttcctacacatttattctgaaactctgatggcttactcaattatgagggaaaatttgcaaagatgtttaccatcacagcgtaagatagtttgtaagcactcagagtctgaatttaaatcttgtgtgatgttgggtatgttgcttactgtctctaaaactcagtttgaacttgtcatccacaaaatgaaggtaatagctcagatatgtggttttcatgactactataaaagaagatttatgaagcatgcttaactagttaccagcaaatagtaagagtttaacaatatttgctattgttactattattattggcaatggaaatttttcgtctgcttggtgtttactcagagacacatgggaagaagtagctaattcaaattagttattaatttgaatttctagctttaaaactgagttgtatgtagataggacctaatttattctgattgcactacttctaattaattcagtattattttggatttttaaaggaatgcaatctatttattcaaaagaacagtcgaggtatctttttaaataaacagagttggcattgtcactacttgtgctgaattaattatgcagtatattatgactttggggagggggagcagcagatgccaaatgccacaaggtgatactgtgagccaaaatatatcagtgaatcaaattttaaatgtcagacggggaggtatcttgctccctttgtttcttttctaaataaatataaaaacaatagattatggtaatgttttccaaattgtcccacagagcctcctgttgggctgtggtggttcagagtttcccctctaggtaaacataggacttcttcgccctataaatttggcaattgtgctgtttttccacacactaatgtagaaagtttttcaggatttactttaattataaaataattggctgctaattataaattatactgaaacatttaaaaagattagacacatattaaaaatcagaaatcctcaatcctcaaagcccagtccccaggataaccattattaatttgatgaatgtctttccaagtacctggagcctgactgaagcaattttatatatatatatatatatatatatatatatatatatatatatatacacacacacacatatatatatatgtatatatatatatatatatatatatatatatatatatatacacacacacacatatatatatatatgtatatatatatatatttaatttcaaacaagccaaatgactctggcctacataaaagtaaactattagaagattcactgtggcctcacagaatatactggtaactttttaaaggaattaggagctgaaggttgagaacaaaagccatacctatgtgttttaggggttggagatggatcatgtgatttggcatgactgtatagacaggatgtaattctttgtctttttaacccagtgcaaatttgagggagagagcaactgattgacctagcttgaatcacatgcttgccctttgaccagagggaatggagcctgggatagttaattttatgcattaacttggctaagacatggtacccagatatctgtcaaatatatctagatattgatgtgaaggtatgctttcagatgatattaacattaaatcactggactttggatctatgatatcggttggctgcatccagtcagttgaaggctttaagtaaaaagactgacctccctcaaaaaactgaggattctggcaaactatttttggacacaaactatgacaattcctccctatgtctccagcctgctggcctgtcctacagattttgaacttgcccaactccacaatcacatgagccagttccttaaattatctttctctcgctctctctctctgagaaacatacacatatacatacatacgcacacattttattggttctgtttctctggaagataccaatcaatacagggcccctgatgaaagtgtgtctaatagaaaaggtcattaatttaaaaacagataaattgttaaagggaaatggatgcaaggcagctgaaaagccaaatgtttaaagcaaatatataatcaaaccatcaaattttttttttcctggagtcttactatgggtgtctaccaggtttgcccgaaatctggtcagaatggcattgaaaaatagacattagatcacatctcttccatgcttcagtgctatgatagcttcttattaagtaatcatatctaagtgtcttcctctaccatgacctgtaaggtcctacactatcttgtctcatttgcctcatcccatctgcttctactacctctcttcctcctgcttcctggtcttttttctgtcctttatcatcccatattctttggctgaggtgaaatgtctttgtgtgccattttttttttccagaatattctcttctgctattttcctatggctggctcctttagttatttagattttccctcatatatgcctccttaaaaaaggcttccctaataacacagtctgtaataggttccctcaagaattagataattcatgactttgttttctgcagattagtttactatgtggaaatttcttgcatattcacttaattgattaatatttgtctacttccttcaaaatataaaaacatctgaaaacagagactttccctatatcatttgctatcttatcacaaactgttaggatgatggctcaaatataaaatgctcaattaatatttacttatatggaataaattaaaacttccctatcaatgcatatatattttactttttataatagctgcatagaatgactttgtataaaggtaccttaatttatttgtctgttttatattttggaattctgtgtacagtattacttttttaaaaagtgcttcactgttcaaaaaaaatacctagataaaatatattcctctctaaggagatatatttctctctgatgtattcgttagcaaaactaaatttatgttacatattccttatttcagttcttcttgattaaaacaaataatgaaggacatgctaatgcattttaatagttttaactgttggggcttatgtgtggctaaaagatggtttagaattcaatgaggtcatcagaaaagaaattatgtacataacactttaaaaagttataaaaatagctgtaagattgttcacaagcagttttgcagcttcacttttaagaagccatagtataagtgttgggctttatgattaagattttttctgaaagaatattactactcaactataatagctctaaaccgacttgatttgtaggcagccctaatagtgatttccttgaatttcactttgtttactaacatattctgcaaatacatacaaaaaaaaagggaaataaacagactatggacacagcaatgaatttatctacttcccaagtgatgttagttcatgatgctttcaagatccttagaagaaatcttatacataagccactgtcatctcctgtccctgtttctacttttgctccctatcgcttatttttcacacagccaatcagggtaatcttttaaaagcataaatcagttcaagttactctcttgcttaaaatattccagtgacttccaactgtggtaagaataaaattctcaatgcccgtgtatggcttaccaaagtacacatgattcaattcctgcctatctgctgctctgctgccaggacgttttttcctatcccttggacattctaagtttgttctcatgcccaagcttttgctgttcattttgtgtaaaactcttttctcagaacttgcaatcattggtatactctcatcaatcaatatcaggtttcaggaaacaatataacttcccaaatttcctgacaactcttcctaatgtagatttgctttaaacaacaacaaagtcatagagattaataaaaaagttttatttgtttttgttggtatatagaggcgaatacaatttatagtagctctgttttcagtgcgatttccttgcaacttgcagctggcttatgccagtgttaatttaacgggaaacaatgatatgggtgagtaaataagatacaaaacagctggctcttttaaataaaattgaaaaaaccttgccatgtcaagataatcaaagaataaatatgattggtatgataaatatttatactgataagtcaaagagttgtaataaacatccaaaaacctctaaattcctaatcgctaaaacatgggcagacaatgtatctgaagacatgaaatgaaacagcacttgtttcttaaaaaattgcttttaaggtgacattttcacacaggagaacaaaaaggagaaatgtagaatggtttaagtgtatctctgtcaagaagcatctctttaatatgatttgagtattatgtaaaagggtttgcatttatcagccttgcatgcatgcattgggttcaaaagttatttaaaacactgcttttactcagaatgcttatttgtcagtctggttgctttggtatgaagtgtcagaaataaagtacttcttggactgtatacttaggttataaatatttcctgtgttgagaagcaattttataccacgtagtgtttacagagtgtatacctgattaataacacacatttggtccttaaaaattacattctcttgtatacattgcagagtatcttacttgtaatacatgcatgatatgactttcagttgcattactctagattttgagttctaattattgtccctattatatagcaatacatttccacatactaacatctgcagagaaatgtgtatgtgtgtgcatatatatgcatatatatacacatacataaatatatttttatatatatgtacatatgggatatgaaattgtttccatttgaaacaattgtgataattggggaaccctcttaggacatataaactcatattttttgcaatatttttggtctgtagaattgtatatgcagttttcttttagaaaaaaaaatgcatacagagattaagaataaagtgacagcagtaatttgaccttatcagcaattctctgagtgataattgcccttgtaatctattgccccatctgctaggtggtggaagttcctctcagtcaagaactgtaccaattcttaaagccagtcccttctgaaggctcatactagcagtggaaattacacatagaagtgactcattattcaataaagtttcctatttttcttattatccagatggaattgagctaagttttgtaaaggaagtggggaggtgtataacattcactttttaaatttttaatatgtgtgggtgtatatatttatggggtacatgaaacactttgatataggcttgtaaagcctaatagtcacatcatgataagaggcctttgtatttttactttgtaaagtagatggaatgcattttgaaataaagttgtaaaatttctcaaatggaaaggtctgaggtcaaaggaggagcgacctactagagtacctattatgtgttaggtaagttatataaactatctgatcacaacagagtaaacatttgttttagtctgatcgactgccataaaaaataccacaaactaggcatttataaaactaaaaatttatttctgacagttctggaggttggcattctaagataaaggcaccagtagattcgatgtctgaggaggtcctgcttttggctcacagttagtggtgtcctcaaatagtggaatgtgcgacgggtctctcttaggcctttcatttattaagggaactattgttaacacccctcatgacctaatcacctcccaaccttctaataccgccatcttgagggttaggatttcagcatatgtattttggggaaacacaaacattcagacacagctggaacttacagtctagtctaaaacaacaaagtgtgtctcacacaagttttacctatactaccttttccctgtacaacacataatatctaaggattcagtaggagttattgacctgattttaccacctaaataacatcacctaaaacacatttctaggaagtgaatgggtgggagttagggtacatgtatctaacctagtaaatatcatcttgaaataatttatttgaaaatccagactgctattcattattatctatgcagttaaatatatttctgttactaacacaaacagtatgttatgttgattttgatgggaattttaaaaaaatggttttacattttattcctaagggtaatattatttaatttaaacactaaaaaaacagccagcaaccacagtgtagtcactataaccaccactgcagtatttctttgttgacttgtaagggatatataaagataaatgagaaaagacagtaaagaaattcccagaaaaaatatattagctcttatagatgtggtgggtgctatgaagtgttacatgtgtaaccattgaggcaatgaattctcccctctcaattaccttcatccccacatgctaggaatgttgctggctagtgaaaattacttgagtctctcctgaggaattgcccttcatttaaagacaaccatttcacacaaattcatcacctggaagcatagtatcaaatggctggtcagtggggctggagagagttatatcaaggcccagtcatctagcctcagtgcatgagaactcaggaagccattccttttaagatattctgtgggcttgttgtctctgcctggattgtacttcttttcaactcccctctcataattaattaaaagttaattcccttataaacatcatacatgcaaatttacctgagagtttgttttccagaaaacaaacttagtacaatggaatatctttgtgttggttcctaaagaaatattttagagatttcattcattttgtacaacagaatgatagaagacttatattttggatacaatcgattagtgttttacctggatcataacttgcataactagcttgtaaatatgtgtcttactctacctcaaagagtctgatttaatgttttggatgaagcctaggaacttgtgtgtccagaatttgttccttccagtgggttcttggtttcactgacttcaagaatgaagccacagaccttcacagtgagtgttacagctcttaaagatggtctgtctggagtttcttcctttggatgttcagatgtgtctgcagtttcttccttccggtgggttcgtggtctcgctgacttcaggagtgaagccacataccttctcagtgagtgttacagctcttaaaggtggtacagacccaaagagtgagcagcagcaagatttattgtgaggagtgaaaaaacagagcttccacagtgtgcaaggggacccaaacaggttgccgctgccagctcaggtggccagcttttattcccttatttggccccatccacatcctgctgattggtccattttacagagcgctgattagtgcatttacaatcctttagctagacacagagtgctgattggtgcgattttaccaagtgctgattggtgtgtttacaatcctttagctagacacagagcgctgattggtgaatttacaatcctttagctagacacaaaagttctccaagcccccatccgacccagaagctcagctggcttcacctctcaatccctcctctaaacaggacaccccaacttctgttaggaattgggcgatgaccactctagctacttcctgccggataggggcgaagaaggggccctgcagctgtagtgtcctccagaggggaactctttcggccagtgaaagggccagtgggtcagtccagggatcctcggtagaagttgttagttgagttcatttggggttccatttgtaagactatctatagcttgatggccttgatcctagaggaaacaaatttgacaaggaggttaaaaatacagggcccaaaggtgagtaattgcaaaatggctgctaccggacctagaaagtggagaagccatgtcacccaactccagaggttggtataagagtttgaaaggcattgtttgatttcagaagccttttcctgtaaatgcctggcagcatctcttactatccctgactggttagggtaaaaacaacactcttcccctaagaaggtgcagagtcctcctttctcagtagtgaggaggtctaggcctcagcagtttaggagagtctctgctgccaaagagtctacttcggattgtagagtaaggatagatttcgttatttcttgcaaactgtctgagaattcctttaagagtgtgtggtagcaggataatacatattacactgttaacttttagcaaactttagttgaaagccttgtaagtttgggattataatttttctttactattaatgaaaacctcgttcagtccatattaacttagaattggtatagatagctccttcctgattctgtaagtactttaagatttggctgagtgcaaacaactcgcacgtttgagcagaccaatcactgggaaattttcctaactctgcttctacaagagtttccttatcacttgctgaacacccattgtgtctttttcccttaactgcctgggaggaaccatctatcctcctgtcctgaagggagttcctcctagatctggtcagacctttgtatggtaattcattaagatttagatccctgtttggaaacctgctgggttaaggatttttgataggaaggctatgggttgtcagtagcctcagtgcttttgggctacacccttgtttacactgacaacaaggtggtattggagtgttatagggttacagagaagacccttaattatcaattatacattttaaatttaccctggcttttaaaggaatagggtacactgttttttctttactacttctatctccctctttctctctctttgacttcttgtctgtctctctcttctttgtctgtctttctctttctgactccctctttgtctcttcctctctttacttctttgactctctgtctctctgtctcttcctctctctcactctttgacttcttctttgtctctgtctcttcctctctctgtctcctcctctttgtctctctgtttcttcctctttctctgactttctgtctctttctctctttcctttctgctggtctttccctgcctctgtcagcagcttatgctgctgttctcccctctccttcccctttttgatggcttcggcagtataagactgccacttccttgggtttttgcactgcatgcaataactgcatgatttccttgtggtatttaatgggggttcccccagaggttaggaactccctttctttccatattgcagcatgggcatgtaggattagataagcatacttactatctgtagcaaagtcttccaattacaacagaggaggtgggagaaatacctggttacaggctctcccaggattccttggatggtaacggaccttgaggacagtcatctgggacaggagattaacactgagaaggctatgccagtgtccaggaggaagtcaatttcctggtcatcaatagttaaacgtacctggggttcagtgagggtgatgacatgagctggcacttgccccaggcaccctcagtcctgttgttggatcatctggttgggggcttctggcccagagaacctttgccctctggggcagtgtgccttccagtgattgcctctgcacagtggacatggatgagggggcagcttgtttctcattggacaaccttttttaaggtgtccttgcaagccacactggtaacaagccccactgggtgattggcctgctccattttctgtcctctctgaaccagcaaggtaggtttgtctgagggccatgactaaggctgcagtctttctctgatctcgcttttccttttgggccggttcctcttggtccctattatagaacaccaaggttgccaggtttaataatgcctccagattttattcagggcctagggctcacttttggagctttcttttgatatctgtggctgatcgggtaataaacttatcttttaggatcaatagaccctctagtgagtcagttgacagtggagtgtatttccttaaggcctcccatagctgctcgaggaaggcaggattttcttcctttccatgagttatggtggacatcattgaataattcatgggctttttcctaattctccttagtccttctagaacacaggtcaacagatgtttacaactccagtccccaggatctgagttgaagtcccagtggggatccatactgggcacggcttgctgaccagtagggaatttgtccctttcttcagctgtcattctatcatttacttgattaagctatcaggtatctccaaactctcaggctgcagctaaagccacattcttttcattaaaggccagggtttgatctaacaatagcatgacatctttccaataagatcaaaggcttgccctagaccctgtaggacacctatatacctatcaggatcatctgaaaagttccccaggtctgccttgatctgctttaaatcggagagggagaaggggacatgtacccacgttgggccaaattcccctccccctacttaaaggggacagaaccaatagcctgggggattttgtggtcctttggatatttcttttcttatttccctctgggcaagggagattagaggaggtttatcactaacaggaaggggagctatagggaggctaggatatggaggtaagctgagaggtcctcctgtgggatgtaaattgcaagctttgcatagttgtggattctccttcaatgaaaagaaagcttggacataaggtatttcactccatttgccttccctcttacagaaaaagtcaagctgcaggatagtattgtaacttatacttccctcgggtggccatttttccccaacagagagataatattgtggccgagccatagtgcagaaaaaaatgagctgcctttctttcagggtttgcgggtcaaattggtcccaatggcttaggatgcatttcaagggtgagcccattgatgcctgagtgtttcccatctgaaagacaaaaccacctgcggttttgttttgtttgtttctccccctgcccaagaacccacagtggcccctggaccctgctgatcagaatagttacactcactgacgtggcagcagaaacccctcttgcccaagcacccacaacagtccctggaccctgctgatgggaatagttgcgctcaccaacacagcagcagaaacactagttttcctcctagaccacaaggaggaatgaggaaggtcggattattggcccttaccaatgcattctagaaaacctgttagagtcctaagcattctcctgttaatattgggactttatccatgccctataaagatgttatgccccaaaaatgaagtggagggccataccctgagagagggaagagatctccagggttggaagagtgatgccttttgtcctcacttatatgaatagcaaggatacaatttctgaggctccccatatcctagcttcaggaatagcctttgttaggcctgctagcctgaggaggggtcctaaaattccagataagatagtctggctcctccgatggggctttgggcaaaaattatgtctttctgattggtgagcctgggtgcctaaagaagggaatagagtcctaaagtttatgctagaaatcattcttatacgagaaactagaaaagcaccagagacagggagtggtttttagaagcgagactagcctcagagaagagaggcaagaggaagtttgtctgacaggcatgaggacccaggaggcaagggtcaggatagataggagagatgggcgagtctcccttaggcgacatgtctttgagagttccgctcagcctcagggtcaaccaacttgttgttgggaccctggagctgaatggctttccactctgtctaccctcggctcagcccagaagtacaagaaaagtggaagctggttccaggcaaatcaatgcttccaaccccgaagagtcaggggttgtaagagagccctttcctagaatgcctgacacccgtgtttttattccagtggccgtgccaaccactttttttttttttttttttttttttgagacggagtctcgctctgtcgcccaggctggagtgcagtggcgggatctcggctccctgcaagctccgcctcccgggttcacgccattctcctgcctcagcctcccaagtagctgggaccacaggcgcccgccactacgcccggctaattttttgtattttttagtagagacggggtttcaccattttagccgggatggtctcgatctcctgacctcgtgatccgcccgcctcggcctcccaaagtgctgggattacaggcgtgagccaccgcgcccggccaccaaccacttttaactgaccgacaggtgcccgataattagatcctgaattctaaggaaaaatagaacagaattgcaagtgaaaggggtccgatggtactcactacttggtgattatcccttcgtggttgccaaatgtgtctggaatttgttccttccactgggttcttggtcttgctgacttcaagaatgaagcgcggagcttcacagtgaatgttacaggtcttaaagatggtatgtccggagtttcttcatttggatgttcagatacgtccagagtttcttctttccagtgggtttgtagtctcactgacttcaggagtgaagccatgaaccttctcagtgagtgttacagctcttaaaggtggtgtggaccctaagagtgagcaccagcaagatttattgcaaagagccaaagaacaaaacttccacagcatggaaggggatccgagcaggttgacgctgctggctctggtggccagcttttattcccttatttggccccgcccacatcctgctgattggcccattttacagagtgctgattggtccattttacagagaattgattggtccattttacagagcacttattggtccattttgcagcatgctgattggtgtgattttacagagtgctgattggtgcatttacaatcctttagctagacacaaaagttctccaaatccccatccggcccagaagctcagctggcttcacctctcacttgaagcttcaactccagggtattctaattcaatatgactggaatgtggcctaagaatttgtatttcaaaaatgtttatatagcaattttcaaatatatacaaaaaaacagaagaccatcatgaccacactatgaatttatcacccagtttcaacaattaccaattcataggcatacttgcaccaactatatcttctcccatcctttcttcccaaattacttgaagcatgtctcagatatagtttcattttatttgaatatgtttcagtgtatattatgaaatgatggcataccacaatgcctttatcaaaaataatatgagttaaattaggagtgtttactttttaatgtgtcaaaataattctaataatccagaaacactgatgtataattgatgaattaattaaaagcttggtgtgtaattttgacagattgactcatgtgtgtgtctgtgtgtgtgtgattactgttgctttcaggtggacacctttcaattatgctaagtatgtacttaatcatgtcctaaatccatgaattatacagggtgacttttggtaactatatcattgatttagtagatttttatcttttggcatcttgatgagttctgcttaataaattagtaacatgcgttatatctatttgaggcagaaaatgtctctaatttctgtttttatactttaagttctagggtacatgtgtacaacgtgcagattgaatacataggtatacacgtggcatgtttgtttgctgcacccattaactcgtcatttacattaggtaattctcccaatgctatcccttccccagccccccaccctctgacaggccccagtgtgtgatgttccctgccatgtgtccaagtgttctcattgttcgattcccaactatgagaacatgtggtgtttggatttctgtccttgtgataatttgctgagaataatggtttccagcttcatccatgtccctgcaaagaacattaactcatccttttttatggctgcacagtattccatggtgtatatgtgccatattttctttatccagtctatcattgttggacatttgggttggttccaagtctttgctactgtgaatagtgctgcaataaacatacgtgtgcatgtgtctttatagtagcatgatttataatcctttgggtatatatccagtaatgggattgctgggtcaaatggtatttctagtcctagatccttaagaaatcgccacaatgtcttccacactggttgaaataatttaaactcccaccaacagtgtaaaagtgtgcctatttcttcatatcctctccagcatctgttgtttcccgactttttaatgattgtcattctaactggtgtgagatggtatctcattgtggttttgatttgcatttctctggtgaccagtgatgatgagcattttttcatgtgtctgttggctgcataaatgtcttcttttgagaagaatctgttcatagcctttgaccactttttaatgggtttttttgtttttgtcttgtaaatttgtttgagttctttgtagattctggatattagccctttgtcagatgggtagattgcaaaaattgtctcccattctgtaggttgcctgttcactctgatggtagtttcttttgctgtgcagaagctctttagtttaattcaatcccatttgtctattttggcttttagtgccattgcttttggtgtcttagtcatgaagtgtttgcctatgcctatgtcctgaatggtattgcctaggttttcctctcaggtttttatgattttaggtctaacatttaagtctttaatccatcttgaattaatttttgtataaggtgtaaggaagggatccagtttcagccttctacatgtggctagccagttttcctagcaccatttattaaatagggaatcgtttccccattgcttgtttttgtcaggtttgtcaaagatcagatggttgcagatgtgtggtgttatttctgagcccagtttcctgttccattggtctatatatctgtttttgtaccagtaccatgcagttttggttactgtagctttgtggtatagtttgaagtcaggttacatgatgcctccagctttgttcttttttgcttaggattgtcttggcaatgcgggctcttttttatttccacttgaactttaaagtagtttttttccaattctgtgaagaaagtcattggtagcttgatggggatggcattgaatctataaattaccttgggcagtatggccgttttcacaatattgattcttcctatctatgagcatggaattttcttccatatttttgtgtcttttatatcattgagcagtggtttgtagttctccttgaaaaggtccctcacatcccttgtatgttggattcctaggtattttattctccttgtagcaattgtgaatgggagttcactcatgatttggctctctgtctgttattgacatataggaatgcttgtgatttttgcacattgattttgtatctgagactttgctgaatttgcctatcagattaaggaatttttgggctgagacaatggggctttctaaatatgcaatcatgtcatctgcaaacagggacaatttaacttcttcttttcctaattgaatgtcctttatttctttctcttgcctgatttgcctgaccagaacttccaacactatgttgaaaaggagtggtgagagaggacatccctgtcttgttccagttttcaaaaggaatgcttccattttttgcccatccagtatgatattggctgtgggtttgtcataaatacctcttattattttgagatacatcccatcaatacctgatttattgagagtttttagcatgaagggccattgaattttgttgaaggtcttttctgcatctattgagataatcatgtggtttttgtcattggttctgtttatgtgatggattacatttatttatttgtgtatgttgaaccagccttgcatcccaggaatgaagccagcttgattgtggtggataagctttttcttgtgctgctggatttggtttgccagtattttattgaggatttttgcatcaatgttcatcagggatattggtttaaaattctctgtttttgttgtgtctctgccaggctttggtatcaggatgatgctggcctcgtaaaatgagttagggaggattccctctttttctattaattggaatagtttcagaaggaatggttccaagtcctcttcgtacctctggtataattaggctgtgaatccgtctggccctggaccttttttggttgataggctattaattattgcctcaatttcagatcctgttattggtctattcagagattcaacttcttcctggtttagtcttgggagggcatatgtgtccaggaatttatacatttcttctagattttccggtttatttgcatagaggtatttatactattctctggtggtagtttgtgtttctgtgggatctgtggtgatatccactttgtcattttttattgtgtctgtttgattcttctctcttttcctctttattagtcttctaaaggtctatcaattttgttggtcctttcaaaaaaccagctcctggattcactgatttttggagggttttttgtgtccctatctccttcagttctgctctgatattacttatttcttgccttctgctagcttttgaatttgtttgctcttgcttctctagttctttcagctgtgatattagggtattgattttagatctttcctgctttctcttgtgggcatttagtgctataaatttccctctacacattgctttaaatgtgtcccagagattctggaatgttgtgtcttttctctcactggtttcaaagaacatctttatttctgctttcattttgttatttacccagtagtcattcaggagcaggtttttcagtttccttgtagttgtgcatttttgagtgagtttcttaatcctgagttctagtttgattgcactgtggtctgagagacaatttgttgtgatttctgttctttcacatttactgaggagtgctttacttccaattatgtggtcaattttataagtgcgagttcaaatgaatgagttcaagtcctggatatccttgttaaccttctgtcttgttgatctgtctaatattgacagtgaggcgttaaagtctcccattattattgtgtgggagtctaagtctctttgtaggtctctaaggacttgctttatgaatctgggtgttcctgtattaggtgcatatatatttaggatagttagctcttcttgttgaattgatccctttaaccattatgtaatggccttctttgtctcttctgatctttgttggtttaaaatctgttttatcagagactaagattgcaacccctgctttttttagctttccatttgtttggtagatcttcctccatccctttattttgagcctatattcgtctttgtatgtgagatgtgtctcttgaatacagcacactgattgatcttgaccctttatccgatttgccagtctgtatcttttaattaggacatttagcccatttacattttaggttaatatttttatgtgtgaatttgatcctgtcattatgatgttcgctggttattttgccagttaactgatgcagtttcttcatagcatccatggtctttacaatttggcatgtttttgaggtggctggtattggttgtttctttccatctttactgcttccttcagaagctcttgtaaggcaggcctggtggtgacaaaatatctcagcatttgcttgtccataaaggattttatttccccttcacttaggaagcttagtttgactagatatgaaattctgggttgaaaattcttttctttaagaacgttgaatattggcccccaatctgttctggcttgcagggtttctgctgagagacccactgttagtctgattggcttccctttgtgggtaactcgacctttctctctggctgcccttaacactttttccttcattacaaccttggtgaatctgacaattttgtgccttggggatgctcttctcaaggagtgtctgtggtgttctctgtatttcctgaatttgaatgttggcctgcattgctagtttggggaggttctcctggataatatcctgaatagtgttttccaacttggttccattctccccatcactttcaggtacaccaatcaaatgtagatttggtcttttcacatagtcctatatttcttggaggctttgtttgtttctttttactcctttttctctaaccttctcttctcactttatttcattaatttgatctccaatcactgataccctttctttcacttgatcgaattggccattgaagcttgtgtatgcatcacaaagttcttgtgccatggttttcagctccatcagttcatttaaggtctcccttcactgtttattctggttaggcattcgtctaaccatttttcaaggattttagcttccttgcaatgggttcaaacttgctcctttagcttggagacgtttgttattactgaccttctgaagcctacttctgtcaactcatcaaagtcattctccatccagctttgctctgttgctggtgaggagctgcattcctttggaggagaagaggcactctggtttttagaattttcagcttttctgctctgttttctccccatcttcgtggttttatctacctttggtctttgatgttggtgacccacagatggggttttggtataaatgtcctttttgttgatgttgatgctattcctttctgctttgttgatgttgatgctattcctttgttagttttatttctaacattcaggtccctcagctgcaggtctgttggagtttgctggagttccactccagaccctgtttgcctaggtatcaccagtggaggctgcagaacagcaaatattgctgcctgatccttcctctggaagcttcatcccagaggggcacctgcctatatgaggtgtctgtcagcccgtactgggaggtgtctcccagttaggctaaacgggggtcagggacccacttgaggaggcagtctattagttctcagatcccaaatgccatgctgggagaacaactgctctcttcagagcgtcagacagggatttttaagtctgcagaagttgcctgctgctttttgttcagctatgccctgcccaaatatgtggagtctatagaggcagtaggccttgctgagctgtggtgggctctgcccagttcgagctccctggctgctttgtttacctactcaagcctcagcaatggcagacgcacctcccccagccaggctgctgccccgcagttcaatctcagactgctgcactagcagtgtgcaaggctctgtgggtgtgggacctgacgagccaggcacaggagagaatctctttgtctgccagttgcgaagaccttgggaaaagcacagtatttgggcgggagtgtcccatttttccaggtacagtatgtcacatcttcccttggctaggaaagggaaatcccttgaccccttgtgcttcctgggtgaggtgacaccccaccctgctgtggctcgccctccgtgggctgcacccactattcaaccagtgagatgaaccagtacctcagttggaaatgcagaaatcacccatcttctgcgtcagtcacactgggagctgcagaccggagctgttcctattcagccatcttcattggacaatctagtctctaaattttaccagaaaaaaggatgtttctctctcctctctctctctcttatttatgtatttatttagagatggagtctcactctgatgcccaagctggagtgcagtggcacaatctcggcttaccacaacctctccctcctgggttcaaatgattctcctgcctcagcctcccaagtagctgagactacagacactccaccatgcctggctaatttttgtgtttttggtagagatggggtttcactatgttggccaggttggtgttgaactcctgacctcatgatccacctgcctcagcctcccaaagtgctgagattacaggcatgagccaccacacctggcctttctctctctctttcccatcatcatcatcatcaactattccaaaaggttattgtaaatattcagtttcccccattatgtgaagtgcctataatgataagttctaggataagtgttttaatcccaagtgttttatctagcgtccagagtccatctctaaccagaatagatggtatgtatgccaccccaatcatgattgtaaagagaacttcgattatcttaaatagaattgaatcccaactgtctattcatttggcatttagattcagatataattaatatctgttaatgaaactaatgacagagaaattagtatattaatcttgtcagaattgcatgaatattaaacagcaggaagtatatataaacatcttgtcttgtcctcagtgctttaaatagtcctgtcataaagagccttagaacgaaaaaaataggcaaaaataaattttgttttaaaaaggtaaaaatatacccctaggatatattggaaacctgacattatcaaaaacctctgatgagagagacatcaatattcttctcggcaggactcctggcccaccaaagtaacagagaaattaggtactggaattcagttttgcagaaaaaaaggcattttaaaacacatttttaaagaaatgtgctacatgaaacagaaactataatatttctgtcttcatgtactataaaccaagcaaataaacaaaatagtaaaattgttgtgtgtcataaaagcccaagattaatggtcagagagaagcctcattattgttttcagatacaaagtgcatactttggtgacaattttctaaactatttttctgcttaatacactgatgggtatatagttcattaaactttagaagttttgagaagtcagtaaatttaaccaaaattataatgaaattttgaaactctaaaaattaaaaaaggaatagaaatactagaggtcttaagcaaatcaaatcatatatttaatgtataacttatcaatcagtttcagatcttatgctactggtttgtttttcatcttcttacctattttctaggataatagaccatttaataagtacagcaaaagagaatgagaaaatataatgatagacattaacatttaaaatattggccagtcacagtggctcacgcctataatcccagcactttgggaggtgggtggatcaccagaggtcaggagttcaacaccagcctggccaacatggcaaaaccccgtctctactaaaaaaatacaaaaattagcctggcaaggtggtggtgcttgtaatccaagctactctggaggctgaggcaggaagaattgcttgaactcaggaggcggaggttgcagtgagctgagatcgtgctaccgcactccagactgagcaatagagcaagactcctttcaaaaaagaaaaaaaaatcaggaagagtcatgtttttcagaggattgaacgtacaaaacaaaaacaaaaacattacaatttctattgtaaagtagttagattactcaagcttttattgtgttcattacatcattgcttgatgaatctatagatgctattaaaatatattgttttgaaaggatacaataaattctttgttttagtatgtagaatttgacttttggcaaaatggaaaaaaaaaatcaggtgtctaggagccaaaagatactttcattagagagtgattaacttttaaaaattttgtttttgacacataataattatgcatatttatggggtatagtgtgatgtttcctacatctatacattatgtaataatcttttcagggtatacagcatatccatcatctcacacagttatcattttgtttgtggtaaaaacattcaaaattctttcttctaagtattttgaaacatacaatacaatactttttaccataatcactctaatgtgcaataaagcaccagaacttattcatcctgtgcaaatgtaactttgaattttttgaccagtctctctccatctttccttctcactctacttctcagtctctagcaactgctgttttactctctactatgaaatcagctcttttaaattccatgtgagtgagatcaagtggtatttgtctttctgtgcctggcttatttcatttcaggttcttttatgttgccttgaataacaggatttatttttttatggctgaatggtattccattgtgtatatataccacattttctttattcatttatcagttgatgaacaattaggttggttcatatcttggctattgtgaatagtgctgcaataaacatggaagtggatatctctaagacatactgatttcatttcctttggatgtgtacccagtagtagaatgactggatcatatggtagttctattgttaatttttagaggaacctccatattgtttttcataaacactgtactaatttacattcccacaaacagtgtaatagagtttcccttttcctacatccccgccattatttgttattttttgtctatttgataatattcgaattgggatgagatgatattgtggtttttatgtgcatttcccagaagattagtaatgttaaatatatttttcatatatctgttggctattttgatgtcttcttttgagaaatatctattcagatttttttgcccattgtttaatcaggttatttgttttcttgctattgagttgtttgagttccttatatattttggatattaatatcttatctgatacatggtttggaaatattttttcctgttcttaggttgtctctttactctgctgattgttttttttttctgttaagatgcctttaaattttctttcactgtttgtgcttttaagtttttatccaaaaaaacctgtgcctagaccaatgtcatgaagtattatatggttgacttctcaaatgaattccaaacaagtataacaaggccaggaaacagtaggttctcagtaagtatttattgaataaaattggtgaaaaatatttatggtttaaattttattgagttaagtttcttggaaacaatttctttcatatgaaatttgcatagtcaacataaagccatattttacttgtattattttcatggatgccatgtatcaattactttatttagtctttgggcttttggactagactaaaatgctgagatgataaagaagcttgtatgactccatgaaccagggaaatgaatattttagagactctactcctgattaattttttactctctctttcaaggcaaaagggtcttagataatgcttcatataatgaatatttacattggaatgaggaaggcctgctgcggttgctatgcatggcataactgcatcatcaacttctcatgtggtcaatttgaccacaatgggcagctctgtaaggacagaaaagccagccaacccagaggagtttacactctatctgaaaattcacagtattacttattctgtgaaaacttcaacctttatgttacgttctataaaaggtgatgacttaggtatcaaagagctacctctgtgatagactaacgaattcctcagataaaattttcagtcctccttagatccttaaagtgtcacattgttaatatatttatgatatactggaaaataatccttaaatgtgccacacattgcccaatcataagaataaatggagtataaataacaggttctgacaattttgaagaactagactttgctatttggtaaaacaattacaataagaaggcagctactttcaaagcatcttttcaaatttgttttctctgatttaaaaagaaacaaaattaacagacatccatgcgtagatacatacctacatccactccttaaagctttgaattactagttttattttttggttaattctaatccattttgttaaatataatttattgaaaatcatttattaggccgggcaccatggctcatgactgtaattccagcacttagggaggccgagatgaaaggatgggttgaggccaggagttcaagaccagcctgagcaacttagtgagactccgtttctgttaaaaatttttttaaaattatttgggcatagtggcatgcacctgtagtcttagttactcaggaggcttgagcccaagaacttgaggctccagtgaactctgattgtgccaatgcatcccagcccaggtgaaagagtgagaccctgtctctaaaaaataaataaataagtaaataaaatcatgtcttctcatgttaattttggcatgtttttactgaacctgtgcatccttccagctctcctggtgtatgaagcatcaagcgaggctcattgcttggtctattttatctcacagaaaatgctaagtgtctaatttttattttggtattacactttagtatatagagtattcaggatgttttttgttagtatttttcctttcttgtgtttttattagtcaatattttgcttattgtaataaatacatgaagaaataattttctttattgttgttattgagaaacatctatatctatctagctagctagctagctagttcccagagaatagttttaaaatctcagtgctctagtgagacttgacttttcaggccacctcttatctaaactcagctaactttcacacaactaccagtacttgtattttctacacagcctagcagtggttgaatcatttaaacactagtaaatatggttaaattacccatataaaaggctgtaagtttattttaattatttcccaagaattgtaacaggagcgtgtatgggaaataatgagaagttgaaggtgaaataagagtgacaaatgctccttctactattcctcttcaaacaaaaaaggatactgcagagtccagctttgctaaaatatcatcagatagtaatggaatggagctgtggccttctaaaacactgcataaatattgccttagtttctctacgctatcaactgtagtggtccttatagcattcatagatcttgggaagtctgcacacattcaactcgtaatatctaaattttctatatatccctactctttttttcatagtaaggtctacttttttaactttacctactgaattcttcttttcaactattttttcaaattgtttgtcacaaagttttactcataatctcatatagaaatctctttaacattctgccccccaaagcactgaccacaaattacccacagaaatcatgaatttaaacattatgtaacttgttaaagtttctaaatcctagcaatacttttattcacaatatttgtatttgggtctatatttggtcaaaaatcatccagactttcaaaatcattctagtagtgtcaaaattatctagaattcatcacaagtctaatgaaatatttatttccacctccagggcagactcatcaccttaatcaccaattgagctaagcctctattagtttaaatctcatcaacatacaacattaaaaaaaaagacatcttaaatttgtttgagctttacttgattgtagagaagcattatactgttaaatatacatttgaataatacctaagcaggaaatgaagttgtttataatcagagatgttccctggactaatgggctcctttcctttgtgttcaaatgtcagctataattcatctctaaaattttgaacctgttgtaaagtcctaacactctatttctagtgcagtgtatggtctgggaatttgtctccatctctcctctctctctctctttttctctcctcttttccagtgttttcagacttaacctgcattgaaatcacttgaagatcctactaaaacagtgattgttggggcttatccctagtgtttctgattcggtagacctggggtgaaacctgagactttgcaggtttccaggtggtgttaaaaccaaactgagaaccactgctgtcgtcacatatagctagttagataatttgtaccattgatttaaaaagaataaatgcaggagagttcttgaagcctggacttagcaacagtctgtagtagtaaatgtcaaagagcacaaagtcaactgttatgtctggctccagaaattaaattatttaagaaatttgcttcgaacacctttaaataattgacatgggcaggtattgtagcttttattaccttcataagaaaatagttttgatgagttactgaattttttttgtagtgcctgcaatattacctcaaattaacagcctgatagttatgtacaattttataatagttatgttgggctggcatgggcaagagttacagtttaattatagcatcttcatttcatatttattagtctcttttatagatggtagtactaaaattatctttcctagtatagagctctcttgtcacctgttatatctaaatatgattttcaaatactgcactaaataaattataaattgtaaaacaaaaggtcaatttttcctagcagcagactctgcttccattgtataccctaaacacatttagtaatgacttatgctggtatttaccacatgaagttcattcttagataatattcctaagataatttactttaaaatagtgctttgaatttttaagagagaagattaatagactcaatattcatatattaatttaattaggctttgcaaaaaacaaagcaaaaaataattttgaaagcaagcagaattgttgtcatatccacaaatcttttctattttactgttatacatttttagacatgatgccaggtgatattctttaattgtgggtttttctgaaatgtttcttatttttcacatcaagggaaatataatatatagatgccatagcaaatgtttttaagggttataagttcgttgccaagataagatatttaaatttatctccccaagttgggaacagtttatttaagtgggctgagaatttttctagctaattaaagacaaggctgtactccttcgtataattaatttcatatcaagttttggggcatattggcaaagtaaaaaatttgcatgaaactttcaataatttatgaatatatatgtgtgtatacatatacatttctgtgtatatatacatacacacatagataagttagaaaacaaactgcctttgtttaagcaaagttatttttaaatttttaaattaaaaaattatataaatttgagagttgtattaagatactggggcaaacattgtgatttcatagacaaataatttactgtgcctgcaatggctacctttatatgtgttatatttataggccagcaaaagtcgagaaatagaacaattacttaatgtaaaatactggcttgcaagatctcttttgagtaggaacatctacgaaaagccgacagtgtccacttgagggagataagggaacaattgacagagatgaagactttagagaatacgaatgtacagaaaattgagatggaaagaatgaaacgaacaaaggcctcatatgtgaaggtaatatataggcactgataattattctgaaacaaagacagtgggtcaggagccaaagagaaagaaattgaatagataaaagcattctcttacaccatttattctaacatgtagcaatgaaagaaagaagaccaacaataaagggccaagatttgcgatcatgagatagcagggcttgctgaggactgtaatggtgtagagaaggaaatatgaagcagagacttgataaatatcttttaagatagagacacccggttgtggttagaggcataggataaaaaaggtctttcattccactgaactgctctagaagaaaaaaaaaaaaaaactagaaattttgttaattaatgtttaacaaaatcacagaagccacatgaataggcagtcttcatttctaaaatgcgaagttacttaaaaggaaatgggtagcagggttttactaaatcctgtgaccttgtaagtgacattgattttattattttaaattatctggctataatctgcaaagtttcttctaataattaaaggataagggaataaaaagtttgaacccattttcagcataaatgtgtaatatatggtatgatggtttaatgacaatggtgatcttgcattaatatccttttaatgggacatgtctttctgccatgccaaaacaagttttgatgagctaacgatttctaggaaagtctcaaagcaccatagcaagcttaatgtcctacatttattttttctcctgccttttctgataaaccagatgtctaccatgcgcagtcacctgataagtgttttagataaatgtcaccgtaaataagtgaagcatgaaaaggttaaaattataaagatgtgagttccaggcaattaatttttatatatctgagactgctttaagaagggcagggataattaaaagaatctgctgctaattgtaatgggaaagtgagtgaaaatagagagggcaatcagtatcatctcctttaaggaatgcatgatatctggaaatatttgttaggaatgagcagcatcttctatcatatttggatggcaaatgagtagagttgaaacaaagtaaagtagttttcttgttatctaagactgataccattcacattcccttctctactgcggaaactttccacaacagcgaacatttttttgaagttgtgagtttccaaagttatttaattattagtatatagcataactacatatttgtgcactattgggagagttgagagacacttaaaataattaatttcaaatacatttaaaaattggtgttcggtgaatatcaatatacttaatttcctcatgtgaacaaggagatattgtaccaatagaacatcctgttatatgatggaatttgaagttgaaattgtatgattgtgcccacaaaaagctgcccagcctaacatgcccatctatttcaatatttacttatttgtgttatttaagctaatatttaatattgatatttttcattaaaatcaatttgtgttttttggtttattttgccatccagtaatattacttagcagtgagacaataacaggaatatatgtaaaaaggagggcttaaaggcaagtccaatttctgtgaatatagtacataaatgtataattctagatgtttattgtataatatcatgtatacttttttagaaacaacaagtaagtgcagaaaactaaggatgcggtaggttgaagtgagtctcgaactaagaagaattgaagtgcagatttgtaaagtacaaaagagatcttggggcatgctgaacaaatagaataacctgataaaaggtacgcagatggcaattaatccattctaaaatgtatacatatagcatgttgccattctccacaggctcctcataaagatggaatcactttgatattcatgaccaaaatttagtgctgtagctgacaaaatgatctcaactcccttccatcccagtgcttcttcagaaataccaagaatgacaatgtctcaaatatgctccttagttatgttgggtcactgggttctatttttttctctgtactttcaggaccatgatctcttggactgctaatttaccatcatcttaatagtgaaatatgagggagtagacataatttacccatttctgtatcctaaacttggaggaagttctttaaatattcactacaatatagatgttaaagtcaaaattttaaaaatatgttattaaagcgttatggctaatgaaaaggaattccaaaaaatacaataaatttacataactaaggactatggcaaggttcactgactaggcaattactaaaaattgtcttagagatgacaccaatggctacaaattgagggtgagtataaattgagtccttctttttactaaaatatccatttttaaagagtgtagttatagtagaaccaattacatcgacctattgtggggactcagtgagttaacacataaaaaaatttacatcaaggactgacacaaaagaggttaatattagcttttattactattttatctttataaacttagtatactgtcatctatatgctgtcaatgtccatatttatgtcttcagtttgaatctctctcctgaattcaaagatgtagatattcaactatctatttgatatctctagttgggtgctaataagcaactcaaattacaaatgtgtgctattttcttcatttcaggtaattgatattccatctttccatttttcaaaccataaaccttgatgtattatattggcttcctctatactcctctcaccctacaatcttctgtgaaatctggtcacctctacttccaaatttccccacctagtttttaaaatgactagtgttttgcccccttctctgacttcatgttcccttataaagtcttgttaaataacttttatagtaaccaagaaatattgctacttttctatttcacaacgtctccctcttgatgggattgccaggtaaaacacagaaaaccagttaaatttgaatttcgggtaaacaacactgtttttctttagtacaaatatgtataatcatttagtataatatcacatggaaattttactaaacaataatatctgttttatatctggaaatcaaatttaactgaatgccttgcaattttatttgctaaatctggccatccttctcttggaactacaattttattaggaatgtcatgtaccttccatatttttgctggtgaaagtcttatcaaatatcctgtcactgcggaagatgtattaccatgctttcagctttagttatagttgctttgccactcacccaatgatcactaagactatatcatatattttaggattcatggcaggaattctaatagcagtcagcgtatgctaggttatcctgtaacaatgaaaccaccttaatattagtgccttaaaacagtttaaggccttttttcctgaaggttatttaacttaaatcttccacttccagatcagttagggtatttttctctacgtctgctcactgagggactcaggaagagagtgacaacacctccatgcttttcagggagagaaaaagaggaaaaaaaacgtgctgaatttccaccagctcttaagtttgtgagtcagatcattttaaagagaataattacagaagcaattgtagctatcaccctctctgcgcaaccccattttctacttgtagatacaagaaataatacctatctagaaagtcatatgtatatttcctttatgtgttatagccataaaaatatagcactatttattttgttaatttgtggaaatgatatactgaacatgtctactgcaacttgatgttgttactcaaacttatgtttttgtgatttatcagtttactgacttccactgtataaatttatttataatctgtttttcaagttctttgttttgatacatttagagcttttctaatctttaattgaattttaaaatgttgcagtatacattcttatatagattttattatatatatgtacaagattattttctagaatagtggaatttctgggtcatatgaatatcatcaactatctcacatgctgtcagtttgctgtccaaattgctatatactcatgaaatcacattttcaccaccacatggtattcagaatttttaattgttttcaataggatgggaataaaataatgttattggcaatttaatttgtattgctttaatagtttgacttgttcaacattctcttataatatttagtattcagttggattttctcttttgtgaattaccaattcatattttttcccatttttctatagggttgtgtgtcactttcttagtgatgtattgctttcttatttattctggatactaattatttgctagttaaacatagcagaattatctagtacctctgtgaagcttccttttcaccttgtttttggtgctattttgcatgagttttaaacttgaacatcttcaagagtatcagtttttctctttatgggttttgctttctttgtgtctttttaaagaagtcttttttttatttaaataccataaagatgatgacttacatttttggtaattatgttaaagttttgcttttgcattatgtttttaagtccacctggaattgatttttgtgtactgggcaggataatgagtcaactttacttttttccacataaataattaattgtctgaaatattttatggtttttaaaatttaacctctgatttgttaatgcaatttctgttataaaacaaattttcatatatggatctgtgtttttctggactcatttttcattcatttgtagtggcctggattgtttcagtgctagatctagtataatagcatttcagtatgaatgttgtagttataagaagcctttctgtcagcaagggagatgccttgctcttttatcctcttcaaattagtattgggttttctctcccacatatttgagattggcttgcacatttttttagtattttggttgtaatgacaccactattaagcattatctttgggaaatattactaggtttatgacttggacatttcctgttcatggactaatttaaatatttttttctttcaagttcttgatcatttaatagagttagtgatagagtccagagaattggcatatcatcaggggcacaagaaatactctggatctagattgttgtgaatgaattctacatctgccgccttttaacttttaccttaggcaagtcaagtgctctctgtgcttcagtttctgcatctattaaagttaagaaaaatatggcctctacctcaagaatcactgggaaaattaaatgagttaaacttgtaaaatatttcaatcagaatctggcatataagaagcactgtttccatatttttgttgcttttcagtgttaagatttaacgtatatatatatttttttcctaattggttgttgaaaggtcactgacaacttgtacttgtttgttttgtttccaccaagcttgctgatgtctctttttgactgtaatagtttttagctttctcttataatctttatgcagacaactttattgtctgtaagtaacgttttatattttctttatgatccacatgtcttttattttcttttatggcttggatccctaatgctgtgcaatttgaaaagaagtcatgttgccaattatttgtcttgttccttattttaaagagaaagcttctaatactgaagtatgatattcactataggtcttttataactactttaaagtaattgatcaaggttcaatttattctttatttgctaagaatctttaccatgaatggaatttaaatgttatgaaggcttctgcattattgaaaaggtataggaattagaatcctttatctgtcaatatgatgaaaaaaataaaaaattgcataatacgaacacgtcagtcattctagggttattaacagtgtgcttagggtgactttagacacacacacacacacacacacacacacacacacacacacaattaaactgagttttgtttcgaatcaaaggcatttatacccaccaaaaaattttcatcgcatagtgttggctgcttattttattccaggccctgttctaggctctgaaaatacatcagggagcacaaaacaaacaacagtccttaccttgaaggaactcatattctaataaagtgtgtaaaatatacactaaaaatatataaattataacacagtagaagatgaaaagcgctttgtaaaatgttgactaggcaaaggggtttgggaatactagggaaaatgtaagactacaaagtgggtggttctgacaggcttcattcatttttaacttttaagtttaggggtacaagtgcaggttcattacatacgtaaactcgtatcatggtggtttgttgtacagattatttcatcaccccggtattaagcctagtaaccattagttattttttttgtcttctccctcctccaactctccaccctccaaaaagccccagtgtgtgctgtcccccactctatgtgtccatgtgttctcataatttagctcctacttatgagttagagcatgcagtgtttggtcttcttttcctgtggtagtttgctaaggataatggcctccaactacatccacatccctgcaaagaacaagatcttgttcttttttatagctgcatagtatgccatgatgtttatataccatattttctttatcccgcagaccactggtgggcatttagattgattccatgtctttgcttagagaaggaaataaaagggtgttccagagggaatagccggtgccaagctctggttcaggagtgtggctgttatcctctaaaattgcaagcagttataactgagagttcttgcttaaagtgtggtttatgttcacccatccgggactgtacttttgaagttgttcacccatctggggctatacttttgaagtctatacttttggaaggatatatgtttgatgacttttttttcttttaaaactagtaagttgtttttgttcagtttttttaagtgtctctattttatatattcaaaattaagttgataatgttttcttgtgctcattatggcttacattgctactacatttataagtgctgacccccttttcattcatcatcttgtgtcttttgatctgtctccttccttttctctttacttggtcatcaatctggctggaaatttgtctatttaattacagtttttaaagcatcacctttttttttttactgtactacttccttttttctctttgatatatttttacttcattataatttacacttattttgtgtgtttatatttatatttcctatataatttcagcttttgctgtattcagtagtcttcctttttatgtaattttcactgtcattaagttctaaataaagtataacttctatttttatttttctttgaacaataaattacatgcaagcttctgtttaagttcacaaacaacagcattatctggctgcctctttttattgggttctttctcacatttgggtcagaaaacatagtcagtgtaaaacagtttccttaacctctaaatattttgctaaattcacttatttaaaatgttctgctaatcagaatattatgtaacataatcagaacataccacattatactctgataatcaattcactagaaagatatcatcccttaggtgttacgatttgttcattttttagaaaatattctcagaaatatttttcaagaacacttttcgttaacattttacatttaaaaatgctaagtgaaattatgcctaagtgtactatattattaagtatgattttataagtggcatataaacagataattcctttcctagaatgtagagataccctatgcactgtaagacagtcaagggaaggagttggtttggtttaggatgcgtgataaagcatctcatgaagtgtctgtatgctcagttttagaaaacggatcccatttttaaaaactggattcattgactgcattattaaattgtttcaatgttgtattccactatctgtagcattctatagaatgtttacttaacatcttttgaataatcattaagtaaacaaaaagtacccctcttcctcaaaactttctcttactcccatgcttatccactgtcatcaaattaccatatctgacagaaataattttaatttcaccatcaattgccagaatattaatttagactacaaatagctgcatataaacataaatgaaaaaatatttttccactcttgttgaaacagtgggagtcctgaatgatttgatagctgtacaattaatcaaataatagactactggattaaatctgagtgaactaaaaatatctgtgcatagctgtaaacaaaattaaattaatatcctcggtacctcttatgcctttaatgccatcaggatcagtagacatgattttaaatgatgattcatataaatatgaatatacataaaatttaaaaatactaggtgaatttatacccaattgtactacattattaagtatgattttctgagtgttactcctaaccagtagcaaatgttttatatatatatataatatattatatataaaatatatatatatgatatatatatatcatatatatgttactgggtaggaggtacagtagtaagttttctttcttaatgagaatggtataatctggctctaaggatgacaaacagatgatgtggtgggcacttaccaaagtattttatttatactgatctgtacccctacaatattctaaaatgaagatgtatgagatatacaatacttttattctatttttctgagttatcccttccagttaggttttgggaacacaaacatgttgtacagttgagcacttacatgatgtaagggcaaatagtgagtataagaattattacactttattcatctgtatcttttatacttcctctattgggtaaatggataaatgcaatgaactgctaaataatacttgttgagtccaacctgaatgaaaacaaaatcttgtgcctatggaaaagtatacaatgtttgtagcagggagaagggaatctgatagatgtctgatctttaaatgtaagaatattggccaggcacagtggctcacgcctgtaatcccagcatctattggaggctgaggcacaggctgataatctgagatcaggagttcgaaaccagcctcgccaatttggtgacaccctgtctctaataaagtacaaaaattagccgggcgtgggggctcctgcttatagtcccagctactcaggaggctggagcaggagaatcgcttgaacccgggaggtggaggttgcagtgagccgagatcgcaccattgtacttcagcctaggtgacagagcgacactctgtctcaaaacaaacaaacaaacaaaatgtaagaacataattatgtgaaagaaatataaacaattttaaaatttaaattatatacaatggcagatcatagctgcacttgtaagagaagatcaaattaaaatcggttatctgtttgtttattcccttatcagtgcctggctttctggaaaaatttagtgattttcatgaaattctctgataaacattatgaactcatttctttctataatatgttggtaatattggtcatatataataatttagaacttcttattctccttcatttttctcagtgcagccattgccatctgacatgttatatgtttatttttgttagtttcctattttgccatacagctaattaaaataaacttttcactaattcaagccctgttcttatcaacgttatagcccaagtatctaaaacagtgtctagcagtaagtagtcaccaggtaactttgctgagtgaataaatcttaggaggagaggagagagaaaatctagatcctttatattatccctgattttccacaaacagctagaatgtaatattttattattttgcaccatgtaagttagaatcattgtggaacatcacatttatacaactctcattagactatatctagatctttcaaaacaagcaagcaagcaaacaaacaacaatgaggatacgctgaagaagttttgagaggagaacctacatctttatagtttgacccccaacttacccataccttccttcaatgaattcccagggctatttagaaaatagtttgtgcaattcaggaagtgtttgttttaaaacaccaagaatgatgactgtccaaatttagaatgtgttcatgtattccatagacaatgactgaatatctactaggttctgaaaaatgtgctagttgctgcagtggataaaataataacgcactgtaagacagtcaagggaagaggttggtttggtttaggatgtatgataagacatttcatgaagtatctatatactcaattttagaaaatggatcccatttttaaaaactggattcattgactactatcaaattgtttgaatgttatatttcactatctatagcgttggaatattagtccagtaaaaaatatgaaacaaaagataaatgactacccaataaggcagtttattttattaccacctagtacagtgtgttaaaagagatcaaagataaatgaatacttccaacataaaatatgtaataatttacttcaggtaacatatttttaaattatgggtataattatgggcataatcataattactacttagaaatttattatgtgtatcatttaacattttatataaaacactttgaatttttagaatatttatgggtccttgttgttaagatgaagtggtgttccagaaatagttgattgtaggtttgttacacttaaaacagagaaatccagcatttatgggtaataccacagttaagaggaaagaaaactaagaaaattgcagtagaatgcttctgtgaagaaaaaactaaaatgtcaaagatagaattgttatgggtctttaatcacaatcatcaaattttaacaaatggaactttaaaattgaatttgtctctttgcctgagttaacacctgagagtatacctgcataccaagtgaagaatcatatttcataatgcatttcatttggcttccaacactgttattctgttgaagacatttctgtaaagcttgacagatacaggaaaatcaatttaataaacactatgatgaaataactattcaattgtttttcatcttttttaacttttaacaccttgcagatcattgctagaataaagtgttatcccctcttcacagtgattcattaacctatattaattgttctttacaaagtcgtttttatacaccttactaactaccaatgcgaggaaaaagtctatattgctttcattcagtagaaagcacatgcattttaataatactgtttctgaaaaacacctattggtttgttttctttcagtttctcatttatcaatcaccttcactgaaagctgaacatatgcagcctaacaacaacttgaattaattgaatatgtttcatatatattctccagattaaattttcagttgctcactttttcatgattatattaagaaaatgtagccataattgcttgtataagaaaaattactgagaaagacattcagattaaatgtaggaaatgttttaaggatctttgaaaggaaagaaatgtcaggttctatattgtattcaaggaagataggagatgaaaatgtcagatatgcaaggcagagaagaaaatagtttttaaaaataagtcatagacattcttcgtctgatagttattgaaaaatcctgttcatcaaaaaatatcttaaatcaatgaagatttcctcaaccaccagacaaaattgttctctgtgtgtgtatgtcttattagaactgtaattatatttacagtactataattagtggtgttcttaactcttgttactcactagaacattattattgataagaagcagtgacatatcttaaagatttttcttgtgtcccagcatctgcttagcataatggcatccaggcacatccatgttactgcaaaggaaaggatttcattctttcttctggatgcatagtattccatggtatatatgcatcacagtttctttatacaatccaccattgttggaaaccaatgttgattccatgcctttgctatttcatatttgcaatagaacatgcaagtgctgtgcagaagctctttagtttaatttggtctcacttgtcaatttttgttttttgttgcttttgtgttttagtacttagtcataaattctttgcctacgtcaatgtccaaaagagtttcttaggtctaattctaggcttcttatagtttaaagttttacatttaagtcttttatcaatcttgagttaatttttttatatggtcagagacaggagcctaatttcattcttctgaatatggttagccagttttcccagcactattaattgaatagggtatcctttccctattgcatttttatcaattatgttaaagatcagttggttgtaggaatgaggcctcatttctggattctctattctgttccattggtctatgtgtctatttttgtacccataccatgctattttggttattgtagccttgtagtataggttgaagtcaggtaatgtgttgcccctgtctgtgttcttttagcttaagattgtgttggctattcaggctcttttttagttaaatataaattttagaatcaattttctaattctgtgtaaaaaatgattttggcagtttcataggaactgcattgaatttgtagattgcttcgggcagtaaagacattttaatgatgttgaatcttccaatctataagcatgtaatatttttccatttgtttgtgtcatctatgatttcattcagcagtgttttgtagttcgacttaaagagatctttcacctccttggttagaggtattcctaagtatttcatttttttctcttgtggctctcataaatgggattgtgttcttgatttggttctcagtttgaacattgcattgtatagaaatactactgctttttgtatgttgattgcctatcttaaaactttactgaaatttttaatcaactttaggcgtctttggtcagaatcattagggttttctaggtatagaatcctatcatcagtgaagaaataaaatttaacttcctcttttcctatttggatgtctattatttcttgctgttggtcgatcattctggctagggcttcaagtattaagttgaataagagtggtaaaagtggatattcttgttttgttcttgttcttatgagaattcctccaacttttgcctatttagtataatgtagactgggtttgtcaatagatggttcttattattttagtatgttctttaaatgcctagtctactgagggttttaattatgaaggcatgttggattttatcaaatactttaacgtatctgttgagataatcttatttttttcatttttaattctctttatgtgataaatcacattaattgatttgcatatattgaacaacccttgcatcccaggaataaagttcacttgatattgtattatctttttgatgtgctgctggatgtggtttgcaagtactttgttgaggattttttcatctatgttcatcagatatattggcctagggttttcttttgtgtgtgtgtatttgccatattttggtatcaggatgatataggttttgtacagtaagttagagaagaatctctcatcctcgattttttggaatagtttcagtaggattggcatgagctcctctttgtatgtctggtagaattcagctatgaattcatctagtcccggacttctattacttattcaattctgtaactcattgttggtgtgttcagtgtttcaagttcttcctggttcaatcttgagaggttgtgtgtttccaggaaggtatccatttctcctaggttatctagttgtgcacatagaaatgttcatagtagtctctgagaatcttttgaatctctatgggactggatctaatgttgcctttgttattgctgattgtgcttatttggatcttctcttttttgttaatcttgctagcagtctatcaattttgtttaaactttcaaagaaccaacttttcattttgttgatcctttgtatggatttttgaatctcgattttgttcagtcctgttcttatttttgttatttattttcttatgctatatttggatatagtttttttcttgttttattaatttctttaggtgcaatgttacgttgttaatttgatatatttctgtctttttgatgtatttagcactataatttttcctctttaaactgctatcgttgcatcccagaggtttttgttcattgtgtctctgttttcatttgtttaaaaagttctttgatttctgccttaattttcttgtttacccaaatgaaagtcattcaagagtaatttgtttagtttctgtgtgtgtgtgtatgtgtgtgtgtgtgtgtttgtgtctgcgttttagagttcctcttgctattgatttttatttttattctactgtggtccaagaggatgcttggtattatttaatattttttttaatttcttgacacttgctttatgactgcatatgtgatcactcttagagtatgttccatgtgaagatgagaaaaatatatattttgtggtttgttgggtagagtgttctgtagatgtgtattaggtttaattggtcaagtgtcaaatttaagtccagaatttatttgtttagatttctgcctcgataaatctatctaccactgtcagttgggtgtagaagtccccagttattactgaggggctgtctacatcttttcttaggtctagtagtgatttctttatgaatcttggtgctccaattaatgttgggtgcatatttatttaagatagttaattattcttgttgaattgagccctttgtcattaagcaataacattttttgtccttatttctgttttaggcttaagatctgttttttctgatagaatagaaactcctgctcttttttgttttccatttgcatgattaatctttctctatccctttactttgaacccatgagtgtcattacttatgagatgggtctcttgaagacagcagatggatgattcttttttttttttttaattccaattcaccactctatgtcttttaagtgaaggatttaggccatttatgtccaaggttaacttttatatgtgagattttgttcctgccatagttttgttagctagtttctttgcagtctcaattgtgtagttgctttatagagtctgtggtatagagtctgtggactatgtacttaactctgcttttgtgtgtattgttctttcacatccacatttagaactcccttaagcatttctgcagggctagtctggtggtgataaattcccttaccgattgcttgactcagaaagactccatttctctttcgtttatgaagcttagttttgaagaatatgaatgtttttttctggaatgtcttttcttttagagtactaaaaatagacctctaatctctgctggattgtaaggtttcttctgagaagaccagttagtctgatggggttccctttgtgggtagtgttgctcttttctctagctgtgtctgagatttgttttttcttttgtgttaaccttggatagtctaatgactatgtgtcttggggatggctgtctttatagtatataaaaggggttctctggatttctgatgtatgcatgtcaacatctctaacaaaattgagaatattttcttgaaatttttcctcaggtatgttttccaagttggttattttttcttttctctcaggaatatcaataagttgtagaattggtttctttacataatcccatatttcttgaaggctttgtctttttaaaaaatattttttctttatttttgcaagactgggttaatttgaagaatcagtcttcaagctatgaattttttccttctacttggcctagtctgtttttaagactcccaaccgtatttcgaaatttatttagtgaatttttcagttccagaagttcagtttggctctttcttaatatagctatgttgtctttcaaattcggactgtttttctggcttctttgtattggatttcaattttatcttatgtctcattgactttccttgccatccatcttctgagttctatgtctctcatttcagacatttacatctggttaggatccttttctagggagctagtgagaggctttggagaccacaaaacactctggctttttgtattgccagagttcttgtgcttattcctttccatctgcgggagttgatactttgtttttgaatttgcttcatttagatggggtttgtattagtcagagttctctataggtactgaagtagtaggatagatgtacatttgaaggggagtttattaaggatcactgactcacacaatcacaagttaaagtcccacaataggccatctgcaagctgaggagcagggaaggcagtccgagtcccaaagcctcaaaagtagggaagctgatgtgcagccttcagtctgtgactgaaggcctgagagcccctggcaaaccactggtgtaagtacaaaagtccaaaatctgaagaactggaagcatccagcatgggataaagatgaaagccaggagactcagtaagtctgctcttctgtcttctcctgcctgctttatcctagctgtgctggcagctgattagatggtgcccacccagattgagagtggttctgcctctcctagtccagactcaaatgttaatctcctttggcaacactctcaaaacacacccaggaacaatattttgcatcctttaatacaatcaagttgacactcaatattaaccatcacagggcttttatattttttattctccttgaaagtatgactgtggtgtatgtgattcattggcttcatttctgggtagttgcaggggtgaagtttctatatatgttccttggttagagataggttcctgcagtggctttcatagatgttgcttgttttagcaatgtatttttatgtgatgctataattcaaacttcaatctggtagacagatttaagagtaagagctggcaggtggggtcttggtgcatgcttgtcctcactggagcatcatgagaaacaacttctttcagtgcacactttctaggaccttatgggaagagctactgctgcatccgcaacagtgcactgggaagtggagatggaggcaagacatgattccttctccaagtctggttctgggccttggtggtgacccttttagtggctgatgccatggccacattttctttatctcatggtgtgctttggcaggctgcactccccttccctcaggagtggtccacactgaggattacatctctagggacacaactctccagagacccaccagtctactgtgcttaccaaagtcagagcaggttttagggtatgtccgcagttgctgtgatacacaacttaggtatgagttgtactgtctcaaaacacaacatgagacaaagaaaatacagtatttcaagtgtagagacaaagaaaatgcagtatttcaagggtagaggatctccaggcagggcagtgccacaatgggtgcaacaccagtatggagcttgcagcccgtgattttcagcccagctggcaaccatggtgtctgcctagctcacactcccctaacccagcagatctcccacagacactcgccctggcggcaagcccaaccaactaggctttccccaagccatctgctcccacattgttgagctactccaggcattctgtgccaggatactccctggaaaaaaagctacgaccatcaggccatacctttcgttgtctggtcttgcaaagggaggggtgtccagctcccatgccccatgagaacccataccacattcttctctgcattctgactgtggaggatcctcctccttcacttgagattaggtcacaaatctcagctcaatgtccctgcgtggtgtactggagtcttggggagttgggactgggctcacgggactgagctcacgggcctgggctcactgatttgtcctctggcctctaagctttaagcactggctatgatttggggacagggtggtgaacttctcccaggctgttaacaaaacacttaagctgggcagtggatgttgtgctgtggacaccctcttgcaggagtggtcaggcatgaggtctgggaaggcgttgacaggcaagggggcatgtggaccagatgtaccttaatcacgcagcatgggtgatggggcctatcttgggcatgtgagcaggccaggcacggttcactcccagcctggcagatagcaggaacttagccactcagtatgaaatggagacttgtgggatgggcacctagggttgcattttgctgcagctgcaccgcacaacaaagccttctgggctcggtgtgggttcaaactgtgcctctgcatgtgctcgaggcagctctcctaccagtccaaagatctatgggggtcgtagaaactcctgtagctaggatctcagaagtacattgtgggtatgtagtgtcccagggttccttcactcaccccttccttgggtttgttcaaggtatatgggccagtcctggtgtctagtgactctgagcagactgccccatttcttccctcttcaaccatggtgtctgtgtcacctctgtatcaactttcagtgttttctctcaaaagatctgtttaaaatgtgacggtttactggatatttgggttcctctccatggaagaggcacttcccagctgcatctccttggccatctgccattctccaaatcttttttggtgcctatttttcctttttactttctgtgcttcctccttattctcttcctccaacactgatatgtactctgacattcaattctttatattataaaaaatagatgtaatatgcatatgtgtgttaagaatagaatacttgtatacacattttaatgtatcttgctttactttaaaaaccacttgtaggaaattcctacaggttatcaggtacaaatctaatacattatttttaatacttgcatccactacacccaaaaattctaatgaacctaaacatttttttttccaaatgcttacaggtcatttgtatttctcatctgtaatttgcctattaacaactttgtctttttcaattagcaatatgctttttcttatctatttgaagtattattattattaattttcattagtattattataggtattacaaatcattctggtaaatgctatttttccaaaatctgtcatttatccattgatcatattaatgatagcttttttataaaaatgtttaaattttcatgtagtgttaaatctgtatatttttaatagctatttattatcctacaataaataaggtctcactgattttacattttcaaacagttatctacatttccttctaaaacttcatttttatgtctttatcctaacagttttttatcctaacaaatattttatgattattttgtctctaagagactaagaccacaatacttgtcagtatttaaatagaaaatatgtgcagaaatataaactgtttgaacattatgaaggttgattatcaaaccaacagcggtcattactgtaaagaatgagaccaaaagccatttaaaagcataaaaatcaggccgggcatggtggctcacacctgtaatccccacactttgggaggccaacgtgggcatatcacctgaggtcaggtgttcaagaccagcctggccaaaatgcccaaaccccgtctctactaaaaatacaaaaattagccagaggtgatggtgcatgcctgtagtagtagtagtcgtagtactactactagtgcatgcctgtagtagtagtagtagttccagctacttgggaggctgaggccggagaatcgcttgaaccggggaggtggaggttgcagtgagccgagatcgcgccactgcactcttgcctgggtgacagagcaagactctgtctcaaaaaaagaaagaaacataaaagcataaaaatcaacacagagatggcttccactgaaaccattatgaatgtttttaaagactatataaatcattaaaatgaaaaactggaaatagttactttaaatattgattaaaaagagacaaatgttggcagtgatatgatggcatatttaagcattaaaaagtttctataaatttttttaaactagcatagttaataagaatgcagtgaccctaatttggtaactcatgttaaataaaaattgggggcgacagagagagattccttctcaaaaaaaaaattaaacatttagaaaaagttaatggactttttaaatagtttctcccagaaagaacacatggaaaatcttctaataaaactcgtgacaaaactataataaattttaagagatcaaattcattgtttttaaaatactcttttgtaccttaaactattttaaaagcttattatggttttattttacatacgataaataccattaccgtcattacatgagtactgatttctcaaaatgaatcaaagttgacaggttatatctttcctatgatcttccttgcttctagtggcataaatttagcggctgtgctcctgttactaccacagaaaatctatcttaatccctaaaattcttaggaaaaaatgtattttagtctagattaaggccatgtttacatttcataaggaaataatcttcactagtattttctttatctttttcctggaagggactaagtcttagtatattcataattaggtttattgcctcttagactacagatttctagaaccttgtagaatttacaagactggaacatagaaaatgagtttctaggacacaattgagtttatatcctacaatcttctctaggtttcaggaaacacacagagaactaatccatagtaatgccctagtttttgctgctttggcttattaaatagcccactacattaacagatagagccatagtaattataattttatagttactgaattttactcaagaactattccataatactcaccctatgtttgctttctacttcttttcttatcttctcttagtctccgtgtcactttgttcactctcttcttgtaacatatttgggattggtgatcccatctacattcatttatccttacattgattttgctctcatggaccattctctcacgtagactgttttatactgccaccacaagcatgttgcatgctgattctgaatccattcagggccctgaggatacagcttcagctagacctaaggtgaccccagacaggggccggtagaagatgttggctaataatagaaatcagtacattggcaagaggaccagtgtctaaagcaattttcttttcaaggctgtggcttatttagagtaggcctgttaaatgccatgcaatttattactttctaaaagtgaaactttgagcccttctgcagcattctattatgatcaagattacctttaaagtaatttaggtcactatctcctcaaatttagaagtttcataatttctcaagaagattttctataaatataatttaaatgaatatattttataagattcgaagtgaataagacagttttaaaggatatatggaaaaaaacttatttgctcatattgaaaactgcatgcattcatttttatcaggatgaaataagaaataaatgcaaaacgaaaaacaaaaggacattttatgttttatatcagacttctgccttgtgagttatatcacgaaaattgtttttttcacaatattatttgcaaatgagatttttggagaaatacgatgattacagttattgaaaaaaatattttccctctgagtcttcagactttattcacgttggatattattattgtatttcttttatcaaatgattttatttttattagaaaataattaaggacagaaactaatgtttcaaaaataaatttaaagacatacctgggtggttcacttgttacacaaggtttgttttatatggagagctcaggtcttaactttattgtacttctggctctgcctttaagtctgtgtcatgatgtgattctgcctgtcctctagcactcatttatatttaggttagtttaggatttttctccagtcgaagcaatcacttgatccatttcagcaggagaattagcaagtgtttaagttcattgtctctctattctaatgaattattcctataataatattcactgtgtttttccttatatctgttatttcctcttgaattcattttatagcaaaataatatgtcttcccgttcttgactgtttatattttccttctctgtcagcaaaacaaataaattctgttttcaacaagaacaagacatcaatctaattcactctttgaccttcagcttccctttggctatacaggatttgctgtgtctaagcaacctcatctccagtttttcatcactggcagaaatggctctgaaatattgggtaaaaatcaagcacagaggatgatcccaaaaaagaatgagagactttgaatgtaccaattaattatcttttacatgttaaacatctgatttttttttaatcgttaagcccttttaatactgactggacatcatgcagtaggtcaacttaatgtgtactgggccgtgccccatgcagaggactgtgaatagagactctgttccttagcaattttttattgattgcctgcacatataaaatataaaaatattggcttattccaatgtaaagacagtttggcaagtatattgtttcaagacgaatgcttctatagcatgcttttatttttggtcagtggccaaatatatctgtatgacatcacactgtagctcactgatttctagaatatactgaaagtgtatgcatacaccctccaatcctacacatgtaaggccacaaaatgtttcttgttttagggatttgatctatgatgccttcagcaagctaacttcatcaaatatcatacacgtactcacagtagcagatttaaaaaatctcatcatttgctctaattttctcaatgaagagtagcaatttaaatttctgaaaaataaacaaaggagggtagtatttttagcaagtttatcttctttagggaaccttgccttaccactggatttgtggattgagatgtcatttgacttctttgacaaaaaaaaaaaaaaaaagaagacaattctctttatttcacacagctcctatgaggcacaaatgaaataaaatatatgttaaactgtgaaattctgacgaaatgtgaagtgatatctgtattcctcagattccctcataacgcaaccctctgtcctctcagtaattcagtaggtgagttccacatactatacattgttttaattgttagttgtatcatatattagttaaactttctttacaattatattttcaactccttgacaaggaacattacctaaaaaaatcagtccatcagttatagatacatacacactatatctctatctcagtatctatctatctatctatctatctatctatctatctatctaatctatcgagagagagagaatgagaaagtgaatgaaggcatgaacaagaaagacttttagtgcaggacaatgttttatgtactagggatatagacattgttattttactgcttcagggagcttacatttcagtgtaagaagacaggaaattaaaatttcaacaaaaaatttcaggcactgatacatactattaagaagacagcattctttggtaactagagtggtcagtgaagcttctctaaggaaggagaatttgagttgaaatgtgagatataaatggaaggctaaagaaataaccaatgaaaaacctggaaaaggaaagttttggcttattttaataagaaaaataaaccagagatactaaggaatgggaaacacaatagtaggaggtacaatcagccaggacaggtaggtaatgtgaggaaacagcagccttacacatataatggtggaaagtcaaattgatccaaaaaacagagtattcaaagtcagattctgattcaatctatattacttattacttgaagcttttgataggttctataacagtagaattgtgaaaattaaacctacagaaccagatgcaagtagagtatcaataaatgttagtctacttccaatctactcactttctctcaataagtgtttgttggttaattaattaggacaacctatctcaaatatttctaagtaaagctgaccatctgattcatctttacctttaaaagttaacttatttattagttgctttgttagtcatcagatcatcattaaatgcttttttttatcttttctgccattgcactccagggtcttaggtgagcctagctgaccatcttctccagaggcaacttcttctcttcagtaggatacgcttcaaagatgagtcttagacatcacctgattcccaagtggtttattgtggcagtgctcttacaagacagtgggagcaggctggtggcatggccaccaaatagctgggagggtatccttccggagactattctcggaatttggggaggtcttcccctttcttacatctgtattcagtcctggtcaattatcagatgtttatttcatataaggagtttaagttattcttgtaagggttagctttgttttaacatctatgaaatttgcacctatgctgaggcgtctttttctctagggcaactggtgttctaggtcgcattttcatagatgcctggtaattcttgggccagggttgtaaatccccaggacagattatatatgatagctaagttacagagtataggctctgtgagatatctgagtgggctttcaggctatcattaatattattcttatagacatgatactacacacttgaaactccattttcccccatgcataattgccagcctatttattgctgtgtatggctaccagttagataagttcagcaaaaaatagcatatgaattcagttaacttttgggtctgtggatgtcttatcattggtaccttgctactagtttgaatatttcaatttaaactgacattttgcagcataaacttcatgataagattctgaaagtgggctgcccaattattcagattttgatatttgaaaacacttcatcacaagagcataatcttggttttcaacagtaagaatcaaaagaacaactaagaaagttctaagtgaagagaactggtcagcataatgtaaatgaaaatgcaatgcaaagaattatttcagcaagttcccaaaggaagtgatgtgcatctgcttcatctcttccaacactggtcaccacctctctttttgaagagtactgagagagaaacaagtaaaagaaggaaatcgatgtcaggatataggaaggcttatcagaaagggttaaaaggttatagtttgtatacatcttttttgtacataaaaaaagtctgacatgtttgtccaaaatacaaattacctacagctcttgtaaggtgttatgagaatatgtgctttctggggtcacccccaccagtgtgattactttaacagatgcttctgatgcgagtgtgatggtacctacacttttaaaaatatccacatagtgtgaaagaagtacatcctatgtggaagacataaattgttgccaatgcagaaaggagaaagaaaaaaaattacgttgaaattctgaagacaaattgagaagtttagcagatgcttccagagacccggtgggcaaatatcaagaatgtcatttgaaaaagatttatgaagcatctatcagtgccttacaggcatcagcatccagagttatcaacagtaccctgctgtggttaaagtagtcacctctactacaaggacaaaacagaagtgtgaaaacaaatttaggtcatgataatttcaaacattaaaaccaagtgtttcagtttgcccttccacaaaaagaccctaatctcccaaggtccttcagtatgctgagggatttaaatgttgccagtggttgagttctgggaagcttctattctgtttgtgattcagatgctagctgtgggagttgagtaagagtgaattgggaaccatgctattggtggttattatacatgctctgccaaatgttttatactgttcagtgaggcagacataatcccaccaagactatctatcaaaaaaatgaacctttattttcgctcctcttgtattctcagaaaattcaggttatatgagctctgtaaagcattaaaactttatgttgctagtatatcctggtgtgcatttctatttttagcattgctgttttctaaattttctttttgtcaatgtgagacttgcatcatctctacaaattctaatcattgcttcttaagtcacatacactaaccacggggtgagacagtaggtcctcttggtaataagaggatgttattattctttattcaattttaaataccaagaaacagatagagtttatggtattttgagtctgaaatcaacatcttttaggataaatttatccttttcaatgcctaaaaatggtttacttatattcctcattttgttaatttcagaaatgtttctgcaaagaatataattactgctagtgtatttttcctaaagctaatgcacaaatgctgtatatgtttaaaatttttaacatattagattaaatactattggaaaatgacattaacatctctttttcttcctagtattaaatggccatgtgttctattaaattaaaaatacagtatttgagatctaaaatctacgttaaaagacagcaaaagaatgttttcaaaccagctgtaaaaggaacagttatttatatgatttaatttatagcaagcattaccatatgcatattttaatataaatatagtaaggtgacaaaattattttaatattactaaagttcacattgcatttataaaaagaaatcactaatcactaatatctcttttaaatgctgctgtataacataatttatatcagagacaaagttcagaatttgttctgtaaatgaaactaaaaatgttggtacttcatacagcaagggtatattttgtaaagtattatgtgtcctctatgctggatgatacagaactagaggaagtcaataaaatatataactcactgttgtcacagatttctcaatattctcgatgtacatgtagggtctacagtgtgctagtgaatgtgatcagtgacagatagtgctattagtagtaatatttgaatattctgacaataaaaaccactgtgttcattccatatagaatatacccaaaaaaactgtaggaaaatgcagtaactttaatattctcgcctatattgaaggttcaatcaacatatgaaaattaatatcaaaacaaagttatttttattcattttttctgtttcttactcttttaaattttctccagttctgaattgtgaatttaaaatgatatttctctagtaaacccaatcctcaatcgaatttactaggtaattgttttccccaaaatgtatctcttcttttggattttcctatctcccagctttataacatgttgtaattattttactcccataattcaatcaataccttggttctttgattcaataagtggcaatcgagtatctacaatgtgtcaggcaccaagtaaggcactaacatgaaagaaatagacattctcttcaatataactatagtacagatcagaaagaaatttatacataaatagaataataagaaattataaaactaatatttattgaatgttccctgggacagtcactgcaaggccgtctaatgttactttaaaaaaaaaaatcctgagaaaagttctataattaaaatgacataggattaattggtctaatctgatatatgaatcgttgtaaattaatgttactattatacacttacaacgttgatatttagaaagatatatttacataatgaataagttgtggagaagagttttgaagaccttggtcgttctggctctgatggcagcatgctttcctctggactggactgctataaaatatatgatgatgaactaagaatgtgagagttctgattaataatctaatgcagaggaaagcatattttaatgggaatagtgaggataatcaatattattctatctggaaaagttagaggagaaggctttgcctcgaagtatcaatctttgaaaacatagttttaactaacacctcttctgtgatgtcattttccatctcttaacctaaagtaggtttggattgaaatacatagagtaggtctgaattgaaatgtcaggcagctactagtatctgcattagttttactcatggccctattgatgtacttgtggagacagcaaaaagggatgacaagttgcatcaacactagaaacaaggggtctaagtacgatttttgccaagactagtgtaagaaagcagcagtagagggaaaagagatgtagacagggataaaggagagatttctacctctccaccacagaaatatggaaactttgcagtcagcaaggtagtgatcatcgcttaatacacagtttcaaacacacttgaatcccttgaaagattccacaacattagagcagcattttacactgaagataaaaaggcaggggggagcatatatttaataagattgactaaaagaaacactattaaattatttttaaaagtttggataagaaataaaatttaattaagaatggaatatataggatgatattgaaagttaaataaagatattgatacagaagaaaaatgaaataattaaactgaagagatttaagacagaaagataggatttaagatgcagaaagcaaagctgcgactctaaacaataataacaaatatttttttagaacttgataggacaatggtagtaggtgttttacaagcatttccacagttaataaacaaacctcttggtaaagaaggtaagattactctttattttatagaccagcaaaaggtggagttcacagaaactaatttgagaggcaagactttgtctgcatcagcctggttaaaaaaagcactctctacgattttatagtatgctcttacatgtttgaaaaatcttccagactacagacgaactgactaggagaataaagcaacgaagatcagagagccagataaaaatgtaattagtttgtgtttattaataaaccaggagaagtaagcaagtacaataacaaagatactgtaaggaaaaacaaaaacaaagacaaaaacactcaagggttatataaagaacctgtgtttgcagatcaaaagtgttaattatgaatcacagttaaagcacagacaaatacttggaaaatccctggtaaactatatttatttctaggataaaagcaaatttctaccagatggttaaagaagaaagcataaagaaagcaaagattaggtagaacttgcagtgcattgaaagaaaaagtttgtaaatagagaacctaaaattcaatcaaatttttatttaagaatgaaacatcattctcatatatacaaggattcatattatcttcagaataaaagtactcaaagacgtctgtcaattgactgttgaagaaaaagaattaaaccaataaaattaatctaaatatgtatttttaacttaatataggaatttaaaatgataattaaagtacatgtgtaatgcaaaaagtatacatgttggttttcaaccctcaaattttatttacaaggaaagcagttttgttgggttgtgtgtgtgtgagagagagattgggaagtggatgtggaacacattagagacatttaacaaatgcaattacatggtcttttcttgtttggcattccatcttgtttatctccatgaattttgtgactagttttccgtaaatccagattatttgatacccaattccatatttcaagtcattgtgtgctttttaaatgtctagctttcacacatatccataatcctaaatatcatggctctcttctactagagaaaacctgtgttaaaaaatgtaataagccgggcgcggtggctcaggcctgtaatcccagcactttgagaggccgaggcaagtggatcatgaggtcaggagatcgagaccatcctggctaaagtgatgaaaccctgtctctactaaaaatacgaaaaaattagccgggcgtggtggcgggtgcctgtagtcccagctactccacaggctgaagcaggagaatggcgtgaacccgggaggcagagcttgcagtgagccgagattgcgccactgccctctagcctgggcaactggttgacagagcgagactctgtctccaaaaaaaaaaaaaaaaaaaaaaaagtaatagcatattatagaagcatggcatcattgagttttgcaatgagattacattttataggccaggtgcagtcactcatgcctgtaatcccagcactttgggaggctgaggtgggccttttgcttgagctcagaagttcgagaccagcctgggcaaaatggtgaaaccaataatacaaaaaaaaaaaaagccggatgtggtggcatgcacctgtagtcccagctactactctggtgctgaagtgggaggatggtccgagcccatgaggtggaggttgtgagactgcaccatcatactcaagcctgggtaactgagccagactctgtctcaaataaataaataaataagatatccatttaagatacaatgggaaaatatagtttttcaatctagttttatttctgttataaatgataaagattaaaattccacctataatttggtgagtattaagtctttactattcaatttcttgatggattgaaacattacatataaaaaagccatagtacttgaaaaaaaatagataatttgatattcacataattttcagatggtttaaagtatctagcctgaaatccaaaaggaaagggaaatatttgagtaaataaaaacaccaacctcctaaatgtcaaaaacaacactaaaaggcaaacaacaaactgaaaatatgtttaaggctggtgacaaagtgttgatttctatgctattcacatatgccatggaaataaaattttaaaatgcccaaattaaaacaaagcaaaataggcaaagtaaatgaacaggcaagacacaaatatatcaagtaaattatgctagtgaccaaagaaatttaaaattatactttatgcttaactagcaacactctagatgtatatctccctcactattgacaagcatctgcagttagacttttttacacactactgaagaggaaatatatcattttataaattatgacattagtgggtttggaaagctattgcaaaaataggtttttgatgcatatttattgatgaagaccaatgttatgatatgagatgaaaatgtcaacaaaattaaatatggaacatggtaaaatattacatgtgtttatatacggacaattagacaagcaatatatatacatagataacaaatactgatacaaaataccttaaatattaaaaatgataatcattgggtggtagggttataaatatttttgcttctctgaactatacttttaaagatactctaggatcattttttaatcaccaagacaataaatatttttgctatttacctatagaagtttttcattggcaactcagtttatgaaaattaaactcctccatttttaaggcgatttagaaactctcctcaaaatgtctctagatgattttctactatattttgttactcttttttcccactcctatcagagacaagaacatcatttttcactagcagtatcacatttgatacttggatcaaagtacacatgcttgaatgtctgtttgttgttattttttataattcacctttaatacttgacagcatgaatttttttatcagagctttctcttaccatgtattgagaaatgccctaacaaaacattttctaaattaacttgtggtacctgcactttgaatccccatccctgatactgtgagctttttcatatctccagaatttgtgtctaatttattttctactgcttgagcagttagtagagttcttggtacctgccaactgcttaatgcatttatataattcatctgaatgttaacaaattaagaaatttcacttcaactctttacaataaaaatgtagggaatgaatttattattggatataaaagtatgatatgtcttagtctatagaaaataatttcactgaagttacctttaaataaatcaaaataagataactattttaagtgaatattcaactctctggcagactatcttatttttaagtacgatttttaaataatttaattcataagtttctcatttgaagcttggcttcaagttaaatagcagagatagataatccctttttacttcctcaattatttgatcaactatggaattctaaataaactttcaaaattcatatcactgtcctattttcagacagatgtgtaagacatggtatcaattaagcttctagtttcaaatgaaaatttttttctccctagcttataacttggagtcaattttaacacccagattacacaatttaaaagcattaaaattatcaatttaaaaaactaactataataatttccacatattaagaatgtcatttactgtatgtgtatatatatatatatatatatatattctttcatgcatcctcacatcaatcatgcaatgtagatatatatatatacatatttctttttttttttgagaaagagtcttgctctgtcacccaggctggagtgcagtggtgcaagtaatgtagatattattaatctcaccttgaaaatcataattcaagctctaagagactagtttatcgaaaagctttattgctacttattggcaagcttggcatattttgttgtaggacataggagttcaccgttcattctattggaatgtttatgacattgtttattgtactaccccaaaaggccatctcaatgaagcgctgtgagcccctatatgtgtatatgattcactcttatgaccagattattttggcctgtagttaaatgcagcaatttaggaagctcaaagatattgaaattataaatagattctcaaaaaacatcattatttgtatttagatgtcctacagaaattcagagagcaaggcaagtgtgtatgagcctaaaaatactctaaataatctacaacaaagaaacactttattcaaagtttttgagtctccgtgtgccatatgtactgtctggtcctacagatataaaagaaaatagaccttcactttgctctcaagaaagttgtagggaagccaactcagtttacataaattctgatgtggatgagtgcaatattttatctatggaaatagataaggaaaattattgtctatacttcatacattcaggatatgtgtacaggtagaggaaatagccaggtatatatggaaagagaaagggataaataaaactatattaaaattagaaacttttctttgacaagataacactaatagggtctaaatataagccataagaattgtaatatttataaaacattaagctgataaatgacttaattataatatatgaagaactcttgtgaatcattaaggaaaacagacaattcaactaaaataggcaagagatatggaacagcactttacaaatgtccaagatcatcaaacagttgttcaaccccattaatcatcatcaaaattcaagttaaagcaactataagataataatacatattcactggctttgctaaaatcttaagagactgaaattggtaaagatgtgaaagagttagaattctcctactctgtgatagaatgtaaaccatacaaccacgttagaaaactgacagtaatctagcctatcagaatgtatacatactctgcaactttattcttctatttaacacaaatgcaatcatatcagtaagaagacatactcaagagtgttcgtaagagcattatcctcacagcataccctagaagaagtacaaagttcatcgccagttgaaaaaaaactaacatataaaatatgatgtattcatctaatggatgatagtataaccattaatatgagtatactagtactgcacttaattatatgcaagaatcttacactcatacatatcatataagacataataattgattaaaaagccatatataaaaggttttatactatgtaattcaatttatagaaaatttaaaacaggtaaaacaaatctttcatattacaaatcaggccatctctaggatggaagtaggggtagttatgagtagataatttaataagtggttttctgagatactgacaatattctatttcttgatcacagtgtgattacatgaatgaattataactttgtaataatttgtcagactgtgatctaatgatttaggaaggtatctcataacttatatttgaataagaaatttatttttaaaagtacattatatattgtgcagtgaatattcttgtcaacacatctctgagcgtatgtccctctcaatatttatgtaagatgaagctcaaagtgcaatcctgaagtttaagctacatatattgtcagaccttgtgaaaatatcaatttttttcctggaatttataattataacattgtgataattcatcagactgtgaactattgatttatgaaggtatctcataggttgtacttgaataagaaatttattcttttaaaaagcaaattgtatattgtacaatgaatatccttctcaacacatctccgagcatatctctcaatatttatgtaagataaagctcaaattgaaatgctttaatctatactatacatattgtcaaacctagtgatagatttcattttttttttccttgaacttaacctgctttttatttccatcacagatataaaagcccacatctcctcatgccttcaacagttccaatttttgggattgttttaaatcattgctaagcaagcatttgcaatatttttaagtaatcatttaccttattttctactatgttgacttctaatacatgtgtttttctcatacattcacttttgttctacaaaaatttatttggcataagcaatcgaccaaagatgtatctggtaaagacttatctggcaatcttccaaagctttatttggtaaagtcaatatctatcataatttttttctctatttattgataaccaatatttaatcattctttattaaaaatccattttctcccattgatttgaactttcacatttattacacatatactcggtagaaatataaaatgataaaaccacttgggaaaactgtacattactttgcttcatttatctaaattaaaaatgtatgttcttttaccaaactactgcatctgataatgcaaaatcagattttatttctccaaaatcaaatcaataaaaaaggcctactttgttatatatgtttcatatttgttgtccttgttttattgccttcctattgagtgtggaggccttatatggagagattgagggtgaaaaacctagggagtgctcacacagtccctgctaacaaggaggtcctagatagaattgtgatttgacaatgaattgaagtcatcacaaaaacagtcgtctcctgacctgatgagagcacacaatgggaaccatatcattattatcattgaaatattcatccaaatttaatgagactaaaattatgaacaaataaattctcccaagattgtctccttatcttcatggtaaagcaaactctgtctgctcaatttcttcctttcctctgacttccagagtgggtcatgcttgtcaaaatcgtttggaggatttttgatgtgcacgatgggaatgaaggggaggtgaataaccagaagattttgagttagccctgtggcagtgtgagaagtaggaaccagaatagttgttatagaaatggataagaatgtgagaaagggttgtaagaaatatttctgtgatctatgtatcctccttacaacatctgtgaaatgcatattctcaggtttgagttatgtggaaaacgatttttgatagtcaaagccaacttgattgcagtaatgcttcagactttgtcacttggacagcgtggaacaagtcaccaaccttttgttaccaacaagattttgttacaggcttttattatttattcatggaaaataattaccgggttaccaccagccaaggtttttattgcctgtctagaaatcatttgatgatccatagaaaaggaggcatataatcccaggtaaacaaactttaaagacaaagacattcaaggaagtattttgaaaataagggaagtatcagtaaaagtattcaaatatgcaattgagaggatactgaaatgcacattttggaaacaaattcagtcacattatacaaggtaaatttacacatacttggtagaataaagagtatgatattggaggggtcataaaatttgctcatggaaataataaaacaagggtattttctgttagctaagtgagtttttgttttaatatgtgatacgaaattccagtgatcaggcatgaattgttatgattttcatgaatcataattatatacctatctcaaatgtgctcttcactcttctgttctaaggataataattgtcaaaaccatttgaggaactttgatatatgcagtgaatcagtttcaaagaggtttgtgaatgttcaacctgtgtttcttccataacaatacaaaaagttcaaagtaattggcttggcccatactactcaccccaattcgttactattttttaaaataatctcaccaggaaaaacatttcgatatgtctgatactttttcaaacaatctgatatttctgacccttgaaaaaagcaaaactaagcaaagtgaaaacagaaatggttgtttggcctctaaaggtaacatataattgtatttatgtctatatgaatgtgtttgagaaaatttttgatttgttctaattctctatgttagtaacacatggaaacaagcaagaatctggctgaaaataatcaagagctttgaggaaaatagtacatttgcaatgtaatatgaaatgagactaataatgttcactaacttttttttttgacgctgagtcttgctctgtcgcccagactggagtgcagtggcacaaactctgctcactgcaagctccgcctcccaggttcacgccattctcctgcctatgcctccctagtagctgtgactacaggcgcccgccaccatgccccactaatttttgtatttttagtacagaaggggtttcaccgtgttagccaggatgatctcgatccctgacctcgtgatctgcccgccttggcctcccaaagtgctgggattacaggcgtgacactgactttccttaaatgtagtagaaattttctgttgttaaaggaagtgtacaaattaaatattaatgactttaatagatattgaaaaagcacctacttaaatgtaaagaacacacaaaattagtgaaagtaattaagtactaaataataaattcaataacttaggtattaaattatatagttactaagatttcaaatcacttaattattggtcttggaatacttacagcatatttttactattttagcataacctttctccaaatactatgatgttattacttgattaaaatacagtgtaaagatctaagcaatgataagtggaatattatataatacatcaaagtttggcttttataacagcaaactgtgtacttatatgagctcagattacctttccagggatgtatcagaacatattctttcttgaagataattataatgccttcagttaatttgaaatacttgggcacattcagtatactactatgtatacgttactcagatgaagacatcattcaaatgccaagttgagaatatttagtattttaacaatgcttctattatgtctatctcaaccaaggctggaagctttaataatcagtctgcgaaatgtcatttttttaagtttactgacccatcaacttgtgtaaatgatagatattatttttcattggtgaagtgagaagtattttaaaagtaagaactggtttcatattattttaaagacaacctacccatgcatgaaacagtgaaaatcataggcatcatgtatgcatttaacattagggatgatataataggttaaatcttattgttctatggatcatgacttctgttaacctgatataagctaaacagtgaatgtatccaatctctgaaatctgagtgtttctcttgaatataccttttgttcaagataaccatatgaacacctaaatgaccagaaagctgagattttattaaatctacaaaaaggcttcttaatcttttgggattgcttgctaatatatttttattaatgattatgtgtatgtatgtatgtgtgtgtgtgtatatatatatatatatatatatatatatatatatatatatatatatatatatatataaaaatagaattcagaccaaaagttcattttcaatctggtagtgaggtttcatgaggcataattaaccctcactcacatcaaatgttaattggctactgttatcctctcagaataatacaacagttctgcatgaaaacattgtcttaacattgctcaaaagagaaggtgtgtctccagaaaagctaatgaataggaagcatgtattcaaaatagaataattttaaggttcttaaaattaaaataataattttaaggttcttaaaccatataattacacagtattttcacagaagactttttttgttattgtttaatcgtttctatgattaccttctcattatgaatctctttatatggacctaattcactttacttatgtgtccccatgactaagacagggaatgtagctctgacagttcaaacagcaatgaaatgcaaatctgctatcctgtgtgcttctaatatatgcttatcaactggaacagaattcaggagacatgacctcttcttgaagacaaatgagacagcaaagaaagcagctttgcttcagaggcaaagtataaaagaaccatccagggtttggggagctctttctgtgtttcttgacttgataacaaaaatttgttgaaatctgtgaggcactaggctgagggttgtaagtacaaataagataatttctgcccacagaccaataaagcttttggcaaaaagataaatatagcaattgtaataaaatagaggaacattttgatactttccataaaggatacccaagcatatttgagctatgggtggacttctaatttcttcaacacataccgtacttcctctgtaatataggcagtaaagtcaaaaactaggagaaatgaggacgacagagaataagcaacagcaattattgtctatgtgaagagactctgttcttcagaagaaacaagtcactgaatcaatctcctttttggaactgtggaagacctggcagtagccacagatggactattttctgctagtggatattacaaagttgaccagagagtagtgatctctttggataactcaacagaataagttggcaaaattatgttaaatatctgctatttgctaaatcctgtaaatgattacattatttcaattcatgggcaagaataattctgttctcttcatagagctgtaactgtgttcaatgaaaataacagaattggccaggcgcggtggctcactcctgtaatcccagcactttgggaggccaaggcgggtgaatcacgaggtcaagagatccagaccatcctggccaacacggtgaaaccccgtctctcctaaaaatacaaaatattagccgggcgtggtggcgggcgcctgtagtcccagctactcgggaggctgaggcaggagaatggcgtgaacccgggaggcggagcttgcagtgagccgggatcgcgccactgcactccagcctgggcaacagagcgatactctgtctcaaaaaaaaaaaaaaaaaaaaaaagcaaaagaaaataaataacagaatttagaagtttaagtaaatgtctctaagagagccaacacaccatctgttattctcttatctttagccctttattagattggtactctaggtttaaagtcagagaactgacctgaaactaacttagggaaaaagaggttcattataaggatactatttttcaataaattcaaggacagtaatatgctggcacttggtaatcaaagactatttcttttatctgtttcctttgttcatcagcattggatactttactactatatactacttttttttttcctttttcattttatttttactcagttttctttggatttaccctgttgttaaaaaaaaatacttgaactgaatacgtacatattattattattattttacttctgttctctctgtaaaattctcacttattctaaggaaccatttcaatctgggttgttcttgcttatatgaataccctttccaggcctggtttcatctactgtggaggttgtgttggcagacagaagttcaaacataatgcatgttatttatgttgtttcttctaattaatgtatataaattgtctgcctctgacttcaatgctacatatctttataaaatatgttaaatatttaacaaggtcatcctaaaaatcataatttttagtattctttaatgtcatgtattaataatatttaaacatttcaagcttcatggagcacagtttacttgagaggtaatcatacacataatagttaagaaatcattcttttcacctttaatcctagattatctgacaatttcatttatggtagcagaaggaaaaataaatattgtaaaataagttgctagtctctataggacaagataaaatgtcaattctgataagttatttaaaccacaccatttcttttaaatttgcagaaacttgtgaaagcctttatcaagagagtttattttcttttattctcaatactataatttatttattaataatgttaaaacaaatagtacgggctatggtaatgacatagtcacacagtaccaaatggctttatgtaaaatattttctatcccatctaccctcacttccatgctcagtatcctgagatactcacagtttttcatcttctaattattaatataattctaaatactacacttgtttctttttagttcttcagttcttactctatatatatatatatatatttaatcacaggcaaatgtgtaagatgaggaatttaattttcatttctcccttcctcttggttttgtttgatgtgttacttttagtttttacattgcttatacaacaattcaatgtaaataaattatgttgctcatttcaacaattctatatattatagaaagaatattttatactacattactaattaaagctaaaactgcttatgtgtaggtaacttagcaaatctatagaaataaatagatgaaggtgatcagccaacatatcctcaaatattgtgatttgcttacattttacattccaaacgaaaagctaagattcaattttattttaatttctagataagaaattacttattttataatagcaaaaattgtttaggaaaatatttttctgactatgagatgcagaatggaactgcagaaaatcctcagatttgaaatgcctttacaggatccaaatagagcctcggttttggaaaaattactgcagatttaattatatgaaccaggagtgatacagcttaagtataagctgactttggctgatggcaatcagattcctcagtgaaattactagaaagagcttgtcaactcttaagtcctgtgctcaaacatacatatttcaaagaacttcagatttttttttcagtttagggagaaatacaggtattgcataccaagcaaattgattattgggaaagtgtgtgtgtgtgtgtgtgtgtgtgtgtgtgtgtgtgagagagagagagagagaggcagcatgggaggaaaagttcagtgagagttgcgttttaagaacaataatcttctggatttaatggagtaattttgatatttatttggtattttcgtggttctgattccacgtttaaaggagagaatagagtattagtaagttgctactaccaacaactctttattttcaggaaaatactgataacatttagactacttaggacctattagtgataatgaactcgagagaaaccccatacaatgtctatggtgtttaaattattggtcaataattatccttattataacttcaatataaaatcaagtattatacataatgttttaatatcattgctctttttttagcatgccatcactatacatttttgctgagaactgaaactactggttttgtataaaagtacattacatatttcaatgttctgtcatttgagaagaaataatatgagaacattgcagtaattttttagaatgtaaggttgtagatattgagacatactaaatgtttgggaaacagtagtttaagtttcacagccctcagcccaaatatgtaatggaatttccctttagaattaccctttagaagtatttcatttagaattaccacttacatatttgggatgagggctacataacttagagtagtgtttcccaaactgtgttctaaaggcatcatttcaaaaacaggttaatgggtgtttcttgaaagtgagcaaatagtacccttttcttagaaagtcagtatgcagattagcataattaagtctgaaaagatttgcagtacagttaattggctttcaaaactgtatttaatatcatatttcccaagcatatctgtgtagataagctttttattatttttcaacatacctattgttgtatttttagcatatctattatgatcacagtagtcagtaacctcatataacttaccacctgtttttgtaatgttttattgcaacagagccatgcccacttgggctttggtgctgtaatgacagagttgagggtagctgcaacatagaccatatggttggcaaagcctaaagatagttattatctggttctttacagaaaaatgtttgccagtcctgatagcacaacaaaatagtactggacattaaattgggaaacaccaaattaaagaagtatattataattttaaacattatttcttatagaccattgtaaaatacatgtaaatacctgcaatatttaaaatcaattttaattatatgaaatttgcaataatgtgacttttatttttatgaaattatttactttatttatattttaatataattgatgtgtatgaaactaaaaaatgatttagcaaggaaagaatacaagtattcttacaaatcttgtctaaagcaaagagaaaacattacttcataaactatttgataggctgctatttcttttgtgaaatcctctagagaagattaaaagtgcattatcattcttccttgatttccttttaggagtagttactgatataaatgtctatgtgcataatcactatgtcttaccattttgactttgagaatactttgctcccccttaacattcaaaattaactagtaaaaggtattagatcataaatgttgaaacttgagtttactgtctcagacgttatatagatttccaaactaaagcatctgtctcaatccttcatgaagtattagtaatgcggctgaatgaaactctcttaatttttttttcaggaagaactgaaccccattattgttacgccaccaatccaagccattgatcaggaccggaatattcaaccgccatcagataggccaggaatcctctattccatccttgttggtttgtatctgataacattttacactatcagttattctagaatcttacagtaacaaattctctcaattccaaggaaatattttaaataacaaagtttattatttgacatgattgttacttttgtgtataaacacattttaaaaataataattcaagatatttgcttcctcaatttgttggactgaaatgtgtagaatgataaatgaataacttttatggaagaagcaaagcaattcaaaatattaggaaattaacctacatattagtatttttctacatatcaacttatcatataaaacttcctctagcaccaactttcagctttaatataaaatgaaaaacattttacacgtgttttacctttggttggttactatacataattgtgataatatatgactgaatttaaaaagagctattttggagccatttaaaaaaaaaaggtgagagagcacgattagcccaagggaacacgaaatattaacctttggtaaatatttttcttgaaaaattccacagaaaccatcctaatccatccctatgcatatactactaattgtgtcaaaagcaaaaatgatgagaaattgattatgctgctcttcttagattgcttttgctgaaatatggatgttgctgatttgcatagcctctagacagacagatgcatgtgagacaggctatatatcttttaagggagaaagggcttcttttgaagtgtgcttgaaaaataactttaatggagttcagcattagccctcaacccctttctgtcctcttacttgaagcctatgtgcatatacaaatacacaacaaccaacagatattagatttgcaaatatcatactgtatccttcttagaaatgctgtctgtaaagaaaattcaagcaattctgtttcaagcctttggtctttataaagacacaaatatcataagcagagctcagacttttatatttgtaaaaaactttcataaacagaaactattttaagtctatagagatcttggtgtagataataaagcatcatttatttcattaactgaaggcttgactgtatgtcaatcactcttattagatgctaaaaacacaaatatgagagatgaatgttctaggttagggagtcgtggagtctgtggctaaaaaacattaaaacaacgtaaaagataaattaaaatacaatatttaaggcactctaaataaagtttgaaccacatgtaggctcatgagaggagagcattaagcattttatgagaattgcttaggaagtgtcattttagcagaaagacaggagtttccaggtggaaaaagagagacaattatctatatagataatgcagcatgtgcaaaagccaaaggatgaaatttaataacagacttggataattatgatactcagagccagttggatgcattggtgttcaagtttatttcacttttaaaagttatgtgcattctttttctcaacaaacgatcacctaccctgtgaagcaacccctatcactgactttgtggagccagttttctggcagaagagataggcaataaacatttactataataagtaagtgtttattatcaaagttagaaagttgtgaatgctatgggaaaaatcgatcatatgaatgggattggaaaagcagaggaggattgtagtagaagttgcagtgttaagcagtatcatcagcacttgtgtcatcaaaaggtaagctgttagcaaaggcttacagaagctgaggaagttattctcgttgatatctccgggaagagttctaggcagagatcaaaactgaagcttgccaggtgggtttcagaaacaacaagggggccggaagtactggaaagaagtgagtgaggtaaaagtagaaaggtgacagataagaacagagcagaaactagagagccttgtatgttatttatctactttgtatttttctctgagtgaaatgaggagccaattaaaaaattttaacagaaaagtgacacagtgatggaaagtttcatcagcctacaaccgtaggatagtggattgtcccaaacaatagatataaactcttacaattatttgctgtcacagctaaggtaaatgaataatatccttttacactatttacatttttagaaggaagagaattgtaggggttgagagtgtagcctctggaaattgtactgtccatgttaaaaatcctgactttaactcacactagacataattttatttaagttatttagcccccctttacctgaaattagtccttcttattttcttcttttgagacagtgtcttgctctgtcacccgcactggagtgcagcggcacaatcatagctcattgaagcttcgacttcctgggttcaagcgatcctcccaccttagcctccctaagttctgggattacaggcgtgagccactacctgaccagattattcttctttaatataggattaacaaaaatagatctttgtacaaaagggttgtgagaatttgatccaatacattgtaaatgtacataatgctgcctggaaaaaaagttaatgctcaatacattttagttgacattgttattagcattaggaaggaaaataaggcatgttacctaagtcacatcagtctggtacaaatggaaacacaaaaacaaaaaccagacacagcacacacacacacacacacacacacacacacacacacacacacagaaggggatatccatgactctgacttcacgtactttgtcaaaactcttaattttccctaaatccatacaaatacttctgaatatatgtgtttctccaagctaacagtaaattaccacatggacgactcctctcctgcttccatttgttatagacagtctctgtttactatatgtgaggatacggatgctgatgtctatgacgaggtcatccaagggctgttgtcaacctcttcaatggttctactgtcatgaacatcaatggcagaattattgactagccaaaagtctttaaaggaaaagctagataatgatgttcatagggagttttaaaaagtttaacatatttctgggattctaaaaagataaaagcaagctgtatatatactcaggaagcacttgggaaggccctaagctctcatctctgactaaccttgaaactctgcaaatgcagtaacttaaggtcaagatggaacaactccataaagcagctagacctaaaagatatctacaaaacactctaccccctaacagcagaatacacattcttctcaagtgcacctagaatgttcttcagtatagatcatgttaggccataaaaccaatatcgttaaattgaagatgattgaaataatacaaactctattctctgacaaaaatggaatgcaattagaaattataatgaaggaaattttggaaattcacaagtgtatggaagttaaacattctttaatcaatgactcatggaagaaataaaatcagaaaaatactttgagacaaataaaaataacaatactttgtaacatgtattttaatctctaatcaataatgtaatatttgtcacaaagacactggaaatgttaagcaaactaaagaaaaagagcagaagggaggccatctgtggtgactcacacatgtaattccaacattttgggaggccgagacagttggattgcttgagacctggagtttgagaccagcctgggcaatatggcgaaaccctgtctctacaaaaaatacaagaattagctgggcatagtggtgtgcacctgtggcctcagctactcaggaggctaaggtgggagaatcacctgggtctgggaagtcaaggctgcagggctgcagtgagctacgatcacatcattttactccagcctgagtgatggaggagattggaggtgactctctttaaaaaaaaaaaaaaaaaaaaagaaagaaagctaaacaacacaatagaaataatagagactacagtggaaagtaataaaagagggattaggaaatcagtagagataataaatgaagccaaaatcaattctttgaaatcatcaacaaaattaacaaacctctagctagactgaccaggaataaaagagataagatgcaatttactaacttggaatgaaagagaggaccttctatttagcttagagaaataaaaaaatgttatgagggaatattatatacaatttatgccaactagacaaatggatgcaatggacaaattcctggaatcaaactattcaaactgacttcagaaaaaataaaaaattggggtagacttttaacaagttaatagactgacttagtaatcaaaaagatcttcccacaaagaagaattctggatcagatgctttactggtaaattctaccattagagaatatttaatacctcttctgtgttagtctgttcttgcactgctataaataactacctgttactgggtgatttataaataaaaataggtttaagtggctcacagttctacaggctgtacaagaagcatggctggagaagcctcaggaaactttcaatcatggctgaaggggaagttggcgcatcttacgtggccagagcaggagagagaaggggtggtactacacacttttaaacaaccagatctcatgagaactcactcactgacaccactgtcaccagaacagcaagggggaaatttccccccattattcaatgacctcctaccaggtccctcctcctacattggagattacaatttaacatgagatttgggtggggaaacaaatccaaaccatatcatgaaacccctggttcctctgaaatctcatgtcattctcacattgcaaaatacaatcatcctttctcaacagttccccaagtcttaactgatttcagaattaactgagaagtccacagtccaaaatctcatctgagacaaggcaagtcccttccgcctatgagcctgaaaaaacttacaagatacaatgggggtacaggctttgggtgaatacacccattccaaaaaaggagaaatcagccaaagcaaagggtctacagtccccatggaagtccaaaacccaggagggcagtcattaaatcttaaatctccaaaataatctcctttgacttcatgtctcatatccaggccacactgatgcagggggtgggctcccaaggccttgggtatttctgcctctgtggctttgcacagtacagccccattggctgatttcatgggctggtgtttggtgcttgtgccttttccaggtgcacattgcaagctgtcagtggatctaccattctggggtctggagaatagttgccttcttctcacagctccaataggcagtgccccagtgggaactctgtgtgggggctcccacctcacatttcccttccacactgccctggtagaggtgttccatgagggctccacccctgcagcagatttctgcctggacatccagacatttccatacatcctttgaaatgtaagtggaggcttccaagcctcaaccattgccctctgtgtgtccacaggtttaacatcacatggaagctgccaaggctatggcttgcatgctctgaagcagaggcctgaggcatatctgggggccatgtagccatggctagagctggaatggctggatgcaggaagcagtgtcctgaggttgcacagggcagtggagccgtggtcctggcccacaaaaccattctttcctcctaagtctcaaggcctatggtggagaaacctgccatgaaggtctctgaaagaaaagcataatctgtagaccccttaatcatatatgtagctgaaatttctgcttctaattgtgttatcaagtctgaccatttttaatgtaaatgttaacagctatcaagctctgttgcagcactgtcattaataatgatatcatacaatgtgtatttatttctaataatataagaaagtctgctgactttagcttgtaacagtagcttgtagtattaagtactcttatatgagcagctaatgtgtgaaaagtaatatgtattaaatatcatatagatgagatatatgttacatactaaaacataaatataatattgctaacagtattttttctaatttttcaaagtatgattataataatattatgaatattctggcaactaaaatgttggtgtcacccattgattaagaatggagatactagagccagaaaccttggtttaaatttttttatcaaccttcattaactgtggtaggtattatcaagtattagcactttcatggccaagtatacagtatactcatattggaaatgtgaagagaaaaacacattttttgtcccttcctcaatgcatatatcacattgagaagggatgaaaatgttcatgggcccaacatttcttctattgtgtatttcatatttcacagttaccatatttcattttgtatttcatatttcacagttatcagagagtccatatttttctgtttccttttttgttttcttattttttgtttatattttcttttgtttcatgatccttgtgctacacaactgggttcttataactgaacacttatagctgagcacatgtggttttttcaaacattatataaccttaaatatatcccccaaggtgtatttttcctcatgccttaccattctctagaatgcttcttctaattttaatgtacttctacattttggaaattattttttaaagaaaatgttctttatagaatttatttaaaatagtccatttaattgcatgtatgcctgccttttaagaaggcaaaagtgaaagctatcaaacttctgaaggcctgatcccagaactgaatcagtagaaataatctactatcatatactggtcaaagcaaggacaattcctgcccagatttaaggtgaggggaaaaaaagattattttacttgttaggaaacaaaaaatgttttccatctttgatctaattcaagtaattcaaggagatgagagggttcataaagtggagctctgaactttaagacataaataactttaggcaagattgtgtgtgtatgttagtatattattccgttttcatgctgctgataaagacatacctgagactacataatttacaaaagaaagaggtttaatggatttacagttccacatgttcaggaaggcctcacaatcatggcggaaggtgaacggcatgtctcacatggcaaaatataagaaaagagagcttgtgaaggaaactcccacttttaataccatcagatcttgtgagacttattcactttcacgagaagagtacaggaaagacccgccttcatgattcaattacctcccacaagcttcctcccatgagattcagaaactgtgggagttacaattcaagatgagatttgggtggggacacagccaaaaccatatcatttagttaatgatagctacattttataatgaatacataacttttatgatccttcatcccatgaattaaaaaatatttttgagtacacactctaatatttaagaattatacatgtattttatcagtcattaaattttcaatgttcatatatcacatagaaaatgattaattgtattatatataagtcaacattataaataattgtattaattacatcaaaattgtcagtctgactttatttccggtctgcctggatctccacggttttgacctaataacatgactgattaagctgttttagcagaggaatgggaagggatttttccatctctgttggtgttcacttctacacatatcattagtgttacctttaatctcaggtttatttgcagagatatttctcagctatttattcatttttttgagcattagtttggtgtaaaattaatattataaaatacagatccctttaactggccaaatgtaaactaaaagtcactgcaatgtgttgaaagcaaacagacaagagagaaggctgcttgtgatgcttaattttatttgacagcttgactgatttaaggcatgtagaaagagctggtaaaacattatttctgggtctgtctaagagagtgtttcaaaaagagactaatatttgaatcagaagactgagtgaagaagatctgctcttaccaatatgggcaggtatcatccagtccattgagggcctgaatagaacaaaaaggcagaggaaggatgagttctctcttcttgaactggaacgtccatcttctcctgccatcaaacattacagtgcttagttctcaggctttcagattctgagacttataccaatgactcccctggttcttaggcctctggacctgataaaaaatgcaccaccagtttttctggttctctaatttgcagagagtagatgctcttagcattcataacaaatgatatcgcttggctgtgtcaccacccaaatctcattttgaattcctatgtgttgtgggagggacaaggtgggaggtaattgaataatggggccaagtctttcctgtgttgttattgtgatagtgaataagtctcacaagatctgatgatttttttttaaaaagaggagttcccctgcacaagtgttctctctttgcctgctgccatccatgtaagatgtgggttgctcctccttgccttccaccatgattgtaaagcttcctcagccacgtggaactgtaagtccaattaaacctttttcttttgaaaattgcccagtctctggtatgtctttatcagctgtgtgaaaatgaactaatacagtaaattggtaacaggagtggggtgttgctgaaaagagacccaaaaatgcagaaacgactttggaactgggtaacaggcagagattggaacagtttgcagggctctgtagaagataggaagatgcgagaaagtttggaactctctagagacttaccgaatggctttgaccaaaatgctgataatgatattaatgatgaaaaccaggctgaggtggtctcagatagagatgaggaacttgttggtaactggagcaaaggtgactcttgttatgttttagcaaaaagactggcagcattttgcccctgccttagatatttgtggaactttgaacttgagagatgattgaggttatctggtggaagaaatttctaagtagcaaaagcattcaagaggtgacttgggtgctgttaaaggcattcagttttattagggaaacagagcataaaagttcagaatatttacagcctgataatttgatagaaaagaaaatctcattttttgaggagaaattcaagctggctgcagaaatttgcataagtaacgaggagctgtatgttaatcctgtagataatgggaaaaacgtctccaggacatttcagaggtcttcatgacagcccctcccaccaccagcctggaggcctggggagaaaagatggttctgtgggctgggcccaggatccccatgcttgtgcagccttgggacttgttgccctgtgtcctagctgctccagctgtggctgaaaggggccaacatagagctcaggccctgcttcagagggtgtaagccccaagcttcagcagcttccacaaagtattgagcctgtgagtgctcagaagtcaagaattgaggtttgggaagctccacctagatttcagaagatgtgtggaaatgccttgtatgttaaggcagaagtttgcttcaggggcagggatctcatgaagaacctccactagtgcagtgcaggagggaaacttggggtcagagcccccacactgagtccctactggggcaccacctagtggagctgtgagaagagggccaccattttacagaccccagaatggtagatccaccaacagcttacacagtacctctggaaaaactacagacacccgaccccagcccatgaaagcagccaggagggggctacactctgcaaagcaacaggggtggagttgtccaaggctgtggaagcccaccacttacatcagtgtgacctggatgtgagacatggagtcaaaggagatcatttcagagctttaagatttgactttcctgctggattttggacttgggggcctgtagacccttcgttttggccaatttctcccatttggaatggctgtatttatccaatgcccgtatccccactctatctagaaagtaactagcctgcttttgattttacagatgcataggtggaaggaacttgccttgtctctggtgagactttggactgtggacttttgagttaatgctgaaatgggttaacactttggaggactattgagaaggcatgaattgttttgaaatgtgaggatgtgagatttgggagaggtcaagtgcagaatgatatggtttggctgtgtctcacccaaatctcacctagagatgggatctcactatgctatgcatgctggtctcgaactcctgacacaggtgatctgcctgcctcagcctcccaaagtgctgggattataggcatgagccaccatgcctggccatagatctcatcttaaattcccacatgttgtgggagggaccatgtgggagataactgaataatggtggcaagtctttccgttgctgttctcatgacagtgaataatctcacgagatatgatggttttaaaaagcagagttcccctgcagaagctctctctctctttgcctgctgccatccatgtaagaagtgacgtgcttttccttgccttccaccatgagtgtgaggctccagccacgtggaactgtaagtccaattaaacctttttcctttgtaaattgcccagtcttgggtatgtcttttcaccagtgtgaaaatggactaaaacaacaaatttgcataatcaatcagccaattgattgacagaatcaatccctctctctctctctttctttctcactgtcagtactaatatgtccttatagcctatttgttttgtttctctaaagaactctgaataatacactgctgcttatcccttcacactgtacacttgtcacatctccctcaagattccttgcttgtccctaaaacatacagagacacagtgtcagtcagtatataaagcattagctaagtttacttttgtattattttatttaaaaataaatataaagtttgaataggagtggtaatagcatgggtctatgcccctaaaacgttaaagcttaagatctgtgcatttcactatatgtaaattgaatcaatcataaagaaaaataaatttataccttttattctcaattctattttaggggttaccccagtacacaatagataaaattttgtctagataattgggcaataaaagtagcgttttagaaagtttccttcagtgattataagggaatggaatgtcagaagatattaggaggctatcaccgtggtacaagtatgaaatgacaagggtctaagtaaggtaagagattaggactatgaaaaaggaacacatcagagagacgttctaaggtaaggaagaatcacttggaaaatgtgtagagaactggctagtgaaagtaacttggggatttgaatctacgtagtcagaaaaaatgttggttctattagtaataacatagtttctgaattttgtaattatttttatgtttaaataacagatatgaacgtatcatgtaccatgaagaggtggttttcaaactttaaaggatacaagaattcagtgagattgttcaaagtgcattctcttgacctcccttttcagagcttctgattcagaagatctgggacaagaactcggtctttctagtgtaggtatacctgaactatacaatcagaagcattgtcataaatatgcataggaaaagcaacccaataaaatctttggtaaagattttttgaagttgagatattggctactaagataagaattttagttttccctaataatatgtaaaaatggatttaaattattttggtggctattacacagttattaaaaacattttcgataagaaaatgaagttcgttatttataacaagtagctgaaaaagaagttttgcaaaggagacagatttagaactaatgatttttggaagctgtaaaagcaggacaaaggtagtttactttttgcatttagaattatcaaagaatgcactaagagaacatattagctgaaaagaaaaagtgctaaagttaaaattaatggaagaaaataatgagaaattagaggtaatttttctaatatatgtttgaacctagggataacttgatacaaaaacaaatgtgttgttagggcatagatgaaaataatggttaaaattatcaacaaaattttagttatgtaaaaggggtagcaggtgaatttaatgtcagaggaatggaatattaatataattaatcccaagatcaaataagggaatgactaaaaagaaataaaacccagagcttcagagatggttcagaagcagctatatttttagatgaattaagctttgctaaatagagtttatattacattttctaagtgggataaataagggattctgtagggaccttgaacttagacatgtgtttctattctcgtacaatgtttttacatttcaataccttggcttctgcagggtatccagcattcatggttcattaaaaggttttcacaaaaaaattacctggagagataagttacatgttataattgtttttgttctaccaaaggaaattgtgggtgttttcattagcagtgttttattgaaactgactataatttctatatatctacaatgtcaaaatctgaggaattaccacacatcttcatggcacccagaagacagtgttctcttttatttctgtgttaatcagcttactaattttatatgtaaagataaacattttcagtggtgaagggaaaaatttgatactgtattttttgaggtagtgctcctttgaagtatattagatgtgcattttcaaatgtatgaagcattaaaaacaaatgttttcctgaatgggcctctttgggtaaaaaatacagaggtgaacttaagttcatcttggcgtttaaggaaatttattgaaaggactttgttttcttccagaattcaaggaactgtcaaaaacaataacattttaagaagcagaaacaggaatttcaagatgagggattagagggcctttcctctagatgcccattatttttgtggtacagattgtacatccatcttctgattctttgctctaaataaaaattattgaaagattaagtggtaattatatagtttaggtcaggcatccacatttccttcaatttactatatgtagggaatcagaagtattatgctaataaatgataggcaaatacagctatgagaaaaaactgttaaggtataaacacttcaaaaataatatgaagcaaaagacaattaaaagaaggaaaagttaatctttacaaccaacattgcagaacaattggacagccatatgtaaacaaataaacttcaatccgtacctcacactatctatagaaaccaacttgaaagactttctatacataatgtaagagctaaaactataaagcatctaaaagataatattggtaaagatttttatgaccttagggttggcaacaatttctcttttttttttttttttttttgagacgtagttttgttgcccaggctggagtgcaacggcacaatctcggctcaccacaacctccacctcccagattcaagcaattctcctccctcagcctctcgagtacctagattacaggcaagtgccaccatgcctggctgattctctatttttagtagagacggggtttctccatgttggtcaggctggtttcaaactcccgacctcaggtgatccccccacctcagccttcgaaagtgctgggataacaggcgtgagccactgtgcccggctggcaacaatttcttaaatgtaacaaatgcaaatctataaaagaaaaaatttaaaatttgacttcatcaaagtaaaaacgcatttgcttttcaaaaggcactgacaatagactgaaaaagaactgacagaaaaggagaatgtatttgcgaaatgtatccaacaagtgacttgtttggggaatatatgaaaacacaatttaataaaaatgagacaattataaaatggcagaaagttttaacaaattattacagatttataaacaaaataagaatatgaaaagttgctcaatgtcattagctaattgggaaatgcaaattaatacctcaatgaatatcactacatacacaccagaatggccaaaatttaaatgactgacaatatcaagtgttggtgaaaatgtggaagatctgaaatgctcatacattgctggtaagaatgtaaaatggtacagacacattggaaaaataatttggcaatttctttaaaagttaaacattactcaacaatgaaaatataatattattgatacacagcaacttggaggaatctctaatgctttatactgagttgaaagaagccagtctccaaatctttatactacacaattccatctaaatgtcattctcaaaaagatgaaagtacggtggtgatgaacaaatcagtcattgctaaagatttaactttggggaaggaaaacacaaagtagttatttgatcataaaaccattctatatcccgattgtggtattgactacacaaacctatacgtaactgaaaattaacagacttgttccctgcccaaaaattcttaataaaacatttagacatagacatatcatatggcctagccattccactcctagatatttgctcaagataaatgaaagcatagattcattcagagaggtatacaggaaagttcatagcatctttatttgtggctggaggcaactcaagtgttcatcaatgtatgaatagataaatgagttgtagcatatccatacaatagaataacacctaggcaatagaaataaataaactattgataaatgaaacaacatggacttcaaaatcattatgctaattgaaagaagccagacacacctacgaaaagaatatatactgtaaggccaggcagggtggctcatgcctgtaatcccagcacattgggaggccgaggccagtggatcacctgagggcaggagttcgaaaccagcctggccaacatggtgaaaccccgtctctactacaaatacaaaaattagctgggcgtggtggtgggcacctgtaatcccagctactctgggggttgaggcgggagaattgcttcaactcaggaggcagaagttggagtgagccaagacagcaccattgcactccagactagaaaaaagagcaaaactctttctcaaaattaaaaaaaaaaaaaagaatacatactatataaatgatcccattcctattatgctgacagacagaaagtgatcagtgtttgcatagggtgagaaatatgaatggggagagaaaggagacattgtcataaggaaatttctggcaattatggataggcttactatcttagtcatggtgatactatcttgatcaacacgtgtaattaaaattctacattttaaatatatgaagataattgtgtagcattttttctttatcctacagaaaacccgtaatcttcaaaattgtaaacttttcaccaagggattaatttaggttgccatttcctctataatactgaaaaagtgaaaaacgtagaattttcttagcatatataaaaattaaaataaatgttttggcaaccactaattatgttggctctaataattataatgctgaaattcaccgtattatttataattgtgataataaacatagttatcaattttacatctaaatttaggcaatcaaagctgtttctaaagaacctccccagtaggtgggactacaggtgcccacaacctcgcccggctaattttttgtttctaaagaacagctttaggttgactgtaaacattgtgtataatgaaagcacaaacattaagtgttcttagtcctcgctggaaaagcattacacttttaagaaatgcagggaaataaatttcacttggttttactctttgtccaaggagatgtatttattttacttatttatttatttatttatttatttatttatttatttatttattttgagacggagtctcgctctgtcgcccaggctggagtgcagtggcgcgatctcggctcactgcaagctccgcctcctgggttcactccattctcctgcgtcagcctccggagtagctaggactacaggcgcccgccaccacgcccggctaattttttgtatttttagtagagacggggtttcaccgtgttagccaggatggtctcgatctcctgacctcgtgatccgcccgtctcggcctcccaaagtgctaaggagatgtattttttaattgctagttatactcttgttgagttgatattctgtaaggatgtctaaaaaccaaccttccagaaacagatggccgatgaagccaaagtgtctaattcactgaactcaggctatatagcataacaggaaagagtttacactctgaatttagataccttgacttctgacctagtcatttactagccgtgagagttcagaatattttacttaacttctgtgagtgttggtttcttcacagatcaagcaataaatatctttcccataagattgttttgaaacttagatgagatagatcatttacaaataaagagattataacattttcaccgtagtaactagttaacagctagtaagtattactctctgggaaatgaaaatctttcccagctcagcggctattattcaattatcttcaccattttgggttcattcttccaggagccctgctccattctatgctgatgaaagctagggtaaaagcaaaccaaagcaaatgataaattatattgcatttttgaaaactcttatttaaaaatatataaaataagagatagtaaataaaatcaccatttggcatcacttagtttcaagaattatgaagacttggccaaacttattaaaatatatatgtctatcaatttttttcctcattattttgaaaaaatatataattttaatccacaaatatttgaatttatgcttataaaataactatttttagagcattctgacaatatcatagcacaaataaaaagtataacaatccttatttaatattaaatatcagtcagtgtttattttcactttctcacaaatattatttttgttttttagtttcttttctgtttttttgtttttgtttttctcggaaagggagagatgcaaggggaccagaattcatgtaagttcacacgttgggattgataattctcctaagtctcttttttttttttttttttttttttgagatggagtcttgttctgttacccaagctggagtgcagtggcgggatcttggctcactgcaagctccacctcccaggttcgcaccattctcctgcctcagcctcccgagtagctgggactacagtcacccgccaccaagcctggctaatttttttttgtatttttagtagagatggggtgtcaccgtgttagccaggatggtctcgatctcctgacctggtgatctgcccgtctcggcctcccagagtgctgagattacaggcatgagccaccacgcccagcctctcctaagtctccttttttttttttttttttttgagacaaagtctcgctctgtcacccaggctggagtgcagtggcacaatctcagctcactgcaagctcagcctccttggttcacgccattctcctgcctcaacctccccagtagctgggactacaggtgcccaccaccacgcccggctaattttttgttttttttttgttttttttttttttttttagtagagacagggtttcaccatgttagccaggatggtctcgatctcctgaccttgtgatcctcccgcctcggcctcccaaagtgctgggattacaggcgtgagccactgcgcccagccctaagtctcttttaatctacagtggttctctttccatttatttttaaattgttttcttgtgattcatttattgagaagtcaagttgtttatattatagagtttctcgtcatcttgattgtactttccttggtttaattttacatgttactctgtcccatgtttcctataaattttgacacttaatcaaataacatattttgtttgtttctttgttgggttttctcaaaactgtttcataggtggtataatagtctgcttgcactaccattaagaaacaccctagactgagtagcttaagcaacagaaaggtgttttctcacagttctggaggcctgagatcaaggtgctttcatggttggtatttgatgaagcttctccagctgctttcttgtgtcttcacatggcctttcctctgtgtgcccttggacagagagagagggaagagatagaaagaaagagagacaaagagaacaccagtcccatcagatttaagagcccacccatatagactcatttaatctgattaccttcttaaaagggtctatctctctataatggtcacattgggagtaagggcttcaacataaaattgttaatggtgagggggacaactcaggccatagcagatgatgttgaattaattcttctattgagtggtatgtatgtggctttatctctttttttgtgatattagcagcatttagtgctcaatgccatgatccattcatttatgaggggttgtaaaatgatggcactctgatactattactcttcttaaattattagctgaaatagtttcttaatgagacactttttaatcaattatttgtttaccccatgttaagctcatatggaaaaagcatgctctgttttcttattttctaatttacaaaatatttctctagcatgctccaaaagtgatcaatacgttattttgcaacactcgtaaacttatgaatttaaacatatttgatctgtttcaaatcattactgatatgatccttattgatgctcaaattgtcttatctttagcttaaaaaacaaaaaaacaaaaaaaagccttttggctcttgaaaacttttcaaatcagtttagtagtctcggaattctttcttgctacttagtgtgagcagatgtttcacagctatttgttgattttctgccctggacctgaaatcagctctctctctcagaaatcttaagtgcttttattggtaaatagtatttcaaaaccatagtctgaacattagaaatattcatcgcttctatattggccattatatatagttctgtgtttcagcattcagagctgtgttgtatgcattttgtttcttaagataaactacaacctgagtttaaacttccactgccaattcaaaatcaaaaccataggtgttctattttacctctttaatttttaatttctatctctttatcatcccctgccaagaatccagctttcaatactgaaaagaatagaatcagaatgacacataataatgtgcttatttattgtaaaatactcctataactatcttggaatcacaacataccaccaatatgattactgtagatagcttaactttttgagttttgtaatttctctggtacttcacctatattacactgtgggtgtgatgtcagtactacttttaaaattcacctggggtagttctttttgtttgtgcttgtgccaacaactaaatatacatttagattgaattattttattttatttttagagaagtccttgaatttaattagttttataataatatataacatatgtagctctaaaatgtaaaaaacttgatatgggtaatgaaatttagtttcagtgtttatcctctccacgtgttccctctctttctcataagtaacaattttttatgttacagtctatcttcgatttttaaatgtgtgtatgtattcctttgtaaatatgcatgtgtattcttcttaaaggttagcatattataggcccttgtttccaaattgcttttttttacttaatatagctgaaaataactccatagtaatagctaaagatatctatcatttatcattacatttgaattatcatctgctttaggatgtatcaccatttatttacccagaccactattgatgtatatttaggtggtcatttatcttccgttattataaatgggaaaatgtccagatgtgggatgtatgggtcaaaaagtaaacattaatattattttggtagcttatgtcatactctccttcataaattttacaacacttgtattaacaccaccagtgtccaaagtgtctgttttcctgcaggctcgccaacagagtacagtctccaactgggacaactgctaatctaagtgactaatgaaatcttaatgtaggaataatttgtagttttcttcttatgtatcgagataagcatctttgcttatctttgcttatgatctagagtcatttgcctttctctttctgtgaacagttttttctctagccccgaacattttgttttgttttgtgacggagtttggctctgtcgcacaggctggagtgcagtggcacaatctcagctcacgcaacctccatgtctcccgggttcaagtgattctcctttctcagcctcccgagtagctgggattacaggcgtgcgccatcacgcccagctaatttttgtatttttagtagggacaggttttcaccatgttggccaggctggtctcgaactcctaacctcagatgatctgcccacctcagcctcccaaagtgctaggattacagacgtgagccactgcgccgagccagccccacactttttaaatccctcactggccctatttttagctaatttataaacctatatatatatattcgggatatgaacattttgtctggacataaatttctcttttttttttttttttttttttttctgagacggagtctcactctgtagcccaggctgtagtgcagtggtacgatctcagctcactgcaagctccgcctcccgggttcacgccattttcctgcctcagcctcccaagtagctgggactacaggcgcccgccaccaggctggctaattttttgtattttttttagtagaggcgggctttcactgtgtcaggcaagatggtctggatctcctgacctcgtgatccgcccgtctcggcctcccaaagtgccgggattacaggcgtgagccaccgcgcccggccgtctcgacataaatttcaaatgttttctcagtttgtcacttgtggttttactttgttcattgtgtctcaccatgcaattttgcaatatagttaaacttatctctttttcttcctgacttcttgactttgagccatagttaggaaaggtttgctcactctcacattagagtaaaatttatccacattttcatctatgactagtgctcatttttttattattatgaatatcttcttcatttggggtttgctcatgtatattccatgaagaatgtatgaaactctatgattttctgtatgactctcctattaggagggataacttctttatcatatattgcatttcatctataattttgactatttgtagattttacagtcggttttaatggtgtgaaatatgtttctgttttttttccccctcatttactgcccagtagaatttcccttcttgtctcagagttgaggaaaataagtagtaacaataagcccctttttggatgtgttttaacatctggcagcctggatttttaataaaagctctgtttcagattgtccctttaacttaaataagtcatttaatctccccagtctcccaagtcatgatctgtaaaatgtaaatgatttagttattgatgattagttatataaagcatttagcacagagtaggtttccataataggaagctatattatttttctcttatggttattaattttacaaatgtatatactatacaattttatgatttgacttcttcattttgggaaaagaatgttgcagtacacaaaggaagattatacaattagaagacatttcttcatgaagaaatgtatattgattattaaaatacattaagaaataccatcttggctaggcgtggtggctcacacctgtaattctagcactttgggaagctgaggtgggtgtatcaccagatgtcgggagttcaagaccagcctggccaacatggcaaatccctttctttactaaaaatacaaaaaatagccaggcatggtggcacacgcctataatcccagctatttgggggctgaggcaggggaaccacttgaaccgggaaggcagaggattcagtcagcagagatcaagccactgcactccagcctgggtgacacagcagggctctatctcaaaaataaatacataaataaataccctgtgtagacattaagagtatcatcagaacctatatttaatttactatgattaacattattagcttgatattaatcttaagaaataatatatgcaacaaaatatgttcacattaatttccaagcatctcactatttggtacaaattactaatcatttattacaatatatgttgaaagaccaaacagttataattaagatttatgcaccattaaaataaaatttcataataaaaaatttactctccctccacttaatgtctattttcatgtgatgaagattcaaattaattagagccctcttaataaaaaaaatttcaaaaatcatccaaacattttccattttcttactgatatgctaattattaataactatataccacatttgtgtctgctttccctgaactgcataattgtgaaacttaatttactaatgaaattgtagctttgttcctcagctgatgaagggaaatagaaaaagcagatacacatattacttattgttctcaattatgtactgaaatctcaatgtcttccagggactcctgaggattacccacgatttttccatatgcatcctaggacagcagaacttagtctcctggagccagtaaacagagactttcaccagaaatttgatttggttattaaggtaaattaagctaatatcttatttccttgtgtttatgaactgctaatcagataaatctgtagacgctactgtaggcagttttatgttataaaattaaaattaatgtggacagcagtcagtcaattttttgttaaaaagaaaataagcgaagcccacttttaatacatggcattgcttttctctaaaataacgttttatagtactatggggtaaaatactaaatattcttatatgtaacaaatgccttggtcaagcgtatacaattctacacaattcattatgtcttctaacattatttttctactaaaaggaattagcgttttaccacaaaaacatgaccaattaagacatctaaaatgtgcttgatttatatgttgttttaattttgttttcatttttattacttaattgtattctaatgtatttttaatgatttttccaacataaaaataagaggtcttgcctatccaaagatgctttcaatatatgtctcattattttctttatattgaaagatgatcttagacttgaaataattcaaagctaagctaatctatttggcatttcacttttggtttaatagtatatctatattttaatataatcattaaatagatactgaaaaaatgcagatattcttctaattaatttcgatggacttcattgagatggtgagatttaatctaagcagtgaaggaaaaacaggaatttgccaggcagagatgggactgggaaaagggcattgtaagtacaagaaaagacaaaagcaaagattcagcataagttttgtatatagtacataactctctcatatttaagcatgcaaaaaaaacctctagaaatgcatcccgatggtatttttcttaccttttgaaaaatgtaaacatactaaaggaaaaggaagtaaggtagggaagcttactgagaatgaacattgtttaagctgctttgtgtgcatttttcattgaactgttgccgcaattttagtaatattctcatttgcacaaaatggggaaactaaagttcggataaggtaagtgattaccttagagttacattactaataaggggcagagttgagattcaaatttagttttatatacgctaaagccatgctcttttcacttcacaaatatgcagatacttagaaatggttgtctagtttaacaattaatagatatgtccttagcacagaacctgtgtttattcagcgatctttgtccttgaaaaaacttatagtctagaaagggaaacagtcatataatcaaataaatcagataaaatgcatcaaatgctaagaggaagacgtgtaaaaagcggtaacgacacacagaatagggacatttaaattaatctggaaactcagggaagattttctggagatcaccccaagctaaatgttgctggattgaaagagtatggtcaatgaataaaagtgggaaatgatgtttgaacataaggaggcacagaagtaaacgcttggagacataatgcacaggctacaagcagttaacagggaaatgaggtatagcgtcagaccacggagagagcctgaaggatgactacagtttcctgggatttcatttattaagggtttgggagttattcaacaaaaaacaccactttaaccagttgtattaaatggccatgcatgagattcaccttcttacattgactattttatgttaattattatgagagtatataaaactccacaatgtgtactgattttctattgtggatctacctgactcttgtggtgctgctttctatgggaattaagaaatttgacaaagcactgtttccaaactgtcacatgtgaaaccaaaaatcaattattttcctttattatcgaattcagctgtcctggtgtacctgggtacagtgtaactcagtccatcaattacagaaaaaaaatcaattacaataggccacagattttttttttgttttaatagcactttcttttattaatggaagttttaacagacaatattagattcaaattactatgttttgtgtgaagtcaagggcataataagcaaaggtatctaactgtaataataatgtgccacctgcttgaataataactgagtattgtggcattgttcaggggaccattgaaatgctacaatctggcagttctcctctatagtaaatctttcaatttcttctctctctctctctttttactttaataatacttcattttttcattggccctaaaagtttttgttggactagatcccaatttatgtttcaaaagcggagaaaaaataaaatgaagtctcttctcctacattttgaagaagaattctgctttaaaaagctatgtgtgtatttaacagctggtgagtgccacaaattagagatttctcatgttcatttttttctctttttctcccagtgatttattcagcatgctgacaaataaaaatgtaaaggtgtaacttggaagacaaaatggaatagttcacaaactttagactatgaaaagattaaaacatgcagttgaaaaagtttgttccattccaaaacactatcctaaattttatataattgtaatcatttaagcatactttaaaatgtgatatacactgtgaacaagaatcatagatttggtttacccagggcagtacatgtttatgtccattgtctttgtgtaattattcataatacctctgttgctcttttaaatgtcccagtttggataagttatttgatcactacactcataaaataaaaaccacctgtgatgtaaaaatatgaaagcacatttaagaactctggtaagagtgaattagttcacgtgtggaccatctattacaaagtccataaaatcactttcagtattgtaagtgaaatattttcaagtattattagttgatatatttatacttcaggcatctaatacaaagctactagtcattaattattaaggccaattaaatggataaattttgaataatttactgtctctcagttcttcaaataacaattgcatgttttaatctaaatccctttaattaacaacgaagagcaaagatcacaatgaaattagaagcataattgtttcatgtttcctctgattttcatgttgttactcactgacctacttattctatctagcatgctgccttttaacttcttttccttccaactcatgagctcactaaccctgagctctcactagttaacttgcacaccctctgttccaaacatactaaaccgcttccagtgccctcaactgaccatgctctttctgacatctaagcatttagagatactctccctcttcctgaatcattcctccctcttcttgtcaacagtctaattcaaactgatgtttcagtttttaactaagaagacatttgccctcgaaaggcatagccactgttaggaagctgcttttttgcagccttttggcccctaaagtggccccaattactctattgaatgtacctgtttattttctcccaacttttacaggagggcagattgcaaaacatttatttacactgcatcccatgcccctacacctacctatatacagcacatagaagctgcttaataaacatttgttgtaattattttctccctggcacagtaaatcttttcagactgctgaatctgtgtacctacgtcttcactctatctaaatacttacatgtgaatgtgtgtgcatttgatacaatttgatcttgcatctctgtccagaaaaaaaaaagatgcaaatgtagcaaatagatttccacataaattcaatgcctagaaaaaatgtcacacctttgttatggcacaactaaagctacttatgactgcgtcaaaaaatgtgtttcttctaaagaaaaattacatatttgccatagaaaattagccagggaattaaaactagtgagcttgattcttagtgctgatgtgcctgatgccctggcaaggtgtcatccttcagtaatttgagagttacaggaaaacagcatttgagaaatgattgagggctaagaggaggacagctactacaacccctgtccctacatgaatcactaatgtcataactctagaaaatgtttagtcactatttgagtaatgataaaaatcatattttacttcatagaaatttaagagaacaccctgattcaatgattttaaagcatatgacatttgctagttttcaatttccctaatccttgttgaatgcttctcaggtgcctggcatttttcttggtctgaggagacatattttacttctgatgcctacggacatcttttcaattattggttggataactactcctagtattatttaattgtgacaaattaaaaatatagcaaactatatacatcctttaaaaattccaaaccttctattttctattccctttttcagttaatcatattttagttggtcacccactcaagctagacacttccacttcctcaaaggtctcttctctcgtatgttcccactcagtcactcatagaatcccttcctgatacctttgaaatcctcttgaatatctcaactctgctcatctactgcaattctttatttcgcattctcttggcccatgatcttacacaagcagtctctaaaatcatgcttcatttctgtgcatcttgtccatcttttcacactgccaacagagtatcgctaaaacaacaaaaaatagatcatgctgctgcatgttgccttcaagccaatttacaatttgccccctacctgaatttcccacagagatgttgtcaagttgaaagatcacaggtgtctaagtcaggcagagtagcaagtcaaagatcatcagtcatcacttctcaaaatgaaaaagatggaacctaccgtgaaaatgaaaaagctaataaaattaattaaatctgttatggagatgtgaaatataagttatattctttctactctaatgtgtatatcatcagttttcaaacaaaagagagagagagaggaaaaaaaaagacaagagatggaaacgattggcactcctttaaggtgaggttgaacagggtccatagtgacccagagttaggacaagagaaaaaacatcagggctgctattgccaagctacaagaaggaagacaaatgctacaaatgacatatcttctatatctggaaatattctagcaatatattcctactcttattcttatggcaagaatgaaacacacacaaacacacatgcacacgcacacgcacacacacacagacacgtactagtcagttcaggccactctaacaaagtacaaaagactgggtggattataaacaacagaaatatatttctcactcttccggaggctggaatttcatactcaatatggtcgggttctagttaggttccttttctgggttgcagattgccaaattctgtttgtatcttcacttggtggaaagaggatgagaggatgagagggtgagagggtgagagagctttctggggtaccttttgtaaggacactaactacttttatgagacctctattctcatgacttaattacctctcctaattgcattacattgtggattaggatttcaacatatgaatttggagagatacaaatattaagtccattgcacaccacacctcagttcagtaggttactaaataatataataagtttatcttttctaccccaatagccaggtctctaaggtaaggcaaagtaaatatctcttacacattttagagaaaatcaccccacagaaatttcaggcattacttgttattagtaatgaaatagcaatctttccatgaatttccaacaaatattacaatttctgaaatcaattgacctttgatacactaagtgttcgtattttaattttgtgttctccttttttttaaacttagcagattgccacacaaagcataatttttgtcatgatatgtcatagcatccaactaacaaaaggggatgttatcaactggcttaaaaatggagggccaagaagaatttgggagaaaactatattccacgagactctctatataagatcactaatgcttctaattaatgatgaagaaaagcctttatgttaggaaatttgaacatatcactaaataagagggaatggttaagacaaatgactatatctgttttaccttaagtgtaacagagtaagtaaatgagctcagaggtataatatgaaatttaatctgcctaaggataaagtgatacacttggatagaactaagggatcaaatgccagagaaggcagctaagagtatccttcaggttttctgctacagtgtgacgttgtacaccacctcccaccagagagttcctccacagggtgcctgataccatatccaacaacacatcatgagaacagcaacaatttgactcagataacatactgagatacatcacagaggatgtagaagctcaaaaagaagtcagtctaaaaactttaccttttacaacttttgttttaatgagttaagtttaatcaaagcaaaaatattgccgaagagcaacactaccattactaggaaataataaataataccaaaacacacacacacacacacacacacacacacatacacacacacacaaaacaaaacagtatttgtgtttcttcagaaagaacaccgtgtgtttttattttccactggtttgtctctaacaattctaagtactggcctaaattaattaactattatgccaattatggaagctaataaaaggaaaggaagtatgatgtcctcttgtctcatatcgttattcatgcagcagtgttagaacagaaatagaatgtagcagttgaatatagtggctgtcaaaaagcacaaactgacaaaagacacacagaggtgacattttatttggccttttttcttcctcacaaggtgacctgtaactgcttgggaagaagaaaggcaatttatccattctcatcagagtaccttgctttttgccaaggccttcttgtctgcaaaggtcattgtaagagtacaagagcaagaccaaacattgtaaaatgttcaaaggaaaggcactttctgaacccttgtcacgtctccccactctgcaatccccacacacataaacatccttagcactctatcacatatgttcccgagtaatcgttcttcataggtttcttggttccatagaaatataacaatgaaagagcatattgaaaaacttgtaggctaaaactctttgttattttttgtctcaagaacggtccagtaggtggaggagaaatattgacctctcaccctcaataccttctaggctctgaaaaataaacgatttagatataatttttatgttaatgattttttaaaatttgcttattacaaaatacattattctggttggctaattcatagaaggtactttagtgtggttttctcttggttgacaaaaaactgggaatgggatcagacctcagtgtaggataagatggctttgctggttggaaggcaaaaggcaggataaaataataaaaataaaacataagttggaagattcacagaaaaaaagttacccctttatcactatcagaattttatatctggctgaccttgctgtttatacccaagatgattctcacgttccaaacaccagctaaatagttcaacatgtcggtgataagtgagagttttcagaatctgtggtcttccccagagtggcaaggttattttttctttaaatcattcaaaatccttttagtcattccagtgtcgatttgtatctcatgctctaagcaaaaagaaagatttttatcattgaaaggtatacaagagctttgaggattcatgtgttcgttgtaacaagttataaacagaatgggcatattcttacttgaagtgaagatagaaagtatttcgttttattaaaaatattccctaggtgtgaaatgtgtcagtattatttcgtcgttatattacaaggctttataaaatatgtgctgcctatattctatctagtgaagtttcttttcctttttgtcatacaaaaaaaggtatttgtttccaaccaagaatatactcttttgctgtatagccttgcaaacaaactttacagcatacaacagttatttgtattttatctcatgaattttataggtttttgaatttatttataagtttttgagtatgtttagtaatagtaataaattggcttaaagtcaaactgtatatgcatcctttaatttttagagtattaaattttgaataaaaggaggctcctgtaggttttaaggcagttaattttataagtagggtcaagaatcaatgggatattcttatttttattaggatgatgcaaacataattgtggtgtttgccattacttttaatggcaaaaacctaataatttttagtcagttgataatatgttcattgattcatggagcacaggttattcacagtcatccctccctaagacattttacacacacacacacacacacacacacacacacacaaaggaaatataacctgataacctgttaccaattactgttgctttggacctatagcttttgtagagcttcagtgagctgcaggatcctacagagaattcccttacataaatgaattccttccattcagtttccaactaagtccaaattaagagactttgctgaaagtgaagaagagtgataatgacttacataaaaggctagaacagagttggcctcagctgctcaccctaggcttttttagtgtaacagctacctataagcctgtgtgagagaagctaaaatgcctgatccaactgatcccaaacgactactgattctacatatccaggaccaggggatgtggctgttttggaaaggcagacttcagggctctccctacagaatcaagatttacatgtgattttcggatgctaaattttgagagcaagtcatatattaaaattacttgaaaacttaggaagatatgataaaattaaactaataaagaaaacaaataagcaatacagcagatacatgtcagatattttggttgagcccctgggaatttgctttaacaattaccttagattattttaaggcagcagataagaagcagggctttggaaaccacagtatttgggaaacacttagtgggaaagtgcaaaaggccaagtttacttttggggtccatctttaatgaacacagatggttgaagaggggagcatctttaattttcacgtatcttcataatgttggttttccatgtcacttcctagggcagctgctattaaattaccacttggacttgagcgcccgtatcctagtttactgtgataggagaggaagggatagtctatgtacacttttttggggagcaagttcatagcttatttttttagtaacatttttattgaaatgctgacatgctgctgacatacaggaaagtgtatatcttgatgaattttcacagagtgaagttaatcatgtaactaacaaccagatttttgttaaaaaaagatgctacaaacatcccatacgcctcctacacctcctcctagtcactaatcaccttacctccacctgacacaaccacaaacttccactataggattctaacagcatagattacttttctctttttttttttgcaacactttataattggattaaatgttgatgtttttaatcagattcttaagagttttatgattccttctatttttctgtactgtaaccaactcaggatgtatatgttccacaaccatatactttccacctgtgaaaaaattcaatggcaatgaattgtctgctaaagaaaaatctgagacttttattaacattttgatttcaaaataaaagtacaagtaattcacgtttgaatcccaagacaaacatgtccaaatgtcaggctatttgaaggttatacactaataatattgttattgccaaaaaataaattggttgaaagcttaagtaaacatattttaactgtctaaagtgatttttaaaatgttaagcaaatgcaatttctatccataaagaaagacaggatatataatttagccctccagcaaaattaaccaaagcaaacaatcttctttgtctacttgagagttgaatttaaaattgaaaataaaggaataaagggatatgcgtgaatcattggtagttcggtcaatttgcccgtttttcagaatcatcctcatataaagatcaatatgcagcctgcaccttgctgggtgaagaaacttggaaaaattacacccttgtatattgaaggctttactgaagagctgtttagcaagaggtgtggtgtccaggaagggaacacaggaagaagaaaattttgaattacatagtagccttatatcctatgtttagtcactagcaacaggaatatactattactcagaatgttgtcattatctgccttccgggtacattctatatgcgtttgtctttctctgactctgactagaaaccaaaaactttctgtatgtcaaattaccttctctctgctttttttctcaatctgaggttcctttatttaaaaatgataaagtaaaagtggtggcttacacccaaaactatattgatactgtgtatacacaggcatacgtgcacacatacaccaacatacctaaattctaattaattatgaataatggaatgtcaagaggatttgaccatgacctatgaatactagctaagactgagcttattacttgtagagtattcccactgacacacgagcaatctttggtaatgctagagtcacatgacaattttagtggtgttgaacctacacagttgataattgtataattgcatgcagtttcagttactagactccaaatcttctggcgtgacaacattggctcttggatgcactgtattatctggagtttttgctccagattataaggactatccattagtaaagactggtccactaaccaatagggctaaccaatagccctaaccaatagggctaaaaagaaagattctctaaaaattggagtttgagtagccacacccagaataatgtctgtgaaagtacattctgctcacattataaccaccacagacagtttgataaaaatggagattccttgcctctaacatcaacatatgaacgagaatctttgtggatagggtgtgggaaactactttttttttttttttttttgaggtggggtttcgctcttgttgctcaggctggaatgtagtggcgcaatcttggctcactgcaacctctgcctcccgggttcaagcgattcttctgcctcagcctcccgagtagctggcattacaggcatgcagcgccatgcccggctaattgtgtatttttagtagacacagggtttctctacattggtcaggctggtctcgaactcccgacctctggtgatccacctgcctcagcctcccaaagtgttaggattacaggcgtgagacactgcgcctggcccagggaatctgctttttattaggccttccattctattcttaggtacatcagagtttgagaatgattgccttgtgtggttgccatgatttttaacatttatctgtcccttacctctggtgaaaggagaatgccatttgttttccttacccactccctctatccatcctttattccctctttttcttcctccctccctcttttttttttctcttcctaagatatctaatgtttgcgaaaattggccaagcaggttctaagaactaggtattaaaagctatagttcagtaagtaaagcaagtaaattaaattaataaattaaaatgtgttgagtggactggaagagtacacacagtcaaaatcatgctaaagtcctcaatttgcaccattctgacaataaaatgtatctaagccatgtgttaagagcaaagtcacaactaacatctcattctttaagccactgtccattcaaaaatgcatataaataggcctttttgcataaatattacatgtaaatgcataaaccttctagaagattatacgttattctgttcacagcaccatccctatagatatagaatcataattgatgattgagggggctgggtgaggcccattcataagactggcaagaatgtgcatcagtattaattacccataggtaaacttgcagatatcacaaacctttaaaatgtgtgaataaagacattctataatctaaggtgttcatgttgtacattcacattaattaatttccacttcgtgtacgttcacacacacacactggaaaaacatccataaatatctatcgaatgggaattagaatgatgtcacaatcacttaatttttaaaaaaatatttaaagcctattaaaattaaagatacagaaaagtaaaaataaatatatatttgaccttcttccatataccagggattgtccgaaattttagcagtgaatgaaactgatacatttacagtgtttatgctcatggaatttaaaaatctaatgaaaaatgagattcagactaattacaagaaaggtttaggtttacaatagcatagaacagtggaatttactatacaagcaatatgattatatttctatttttacatattataaatatagaaaaatatttcataaatttataatattatccaaattaaaatgtggtattaccttaactttgaaaattgcaatatttacctttaatgcttcagtaggataagaccataattcactacattgacataagagtattttttcatctcaagtttactaacatagaatatttcttggcatatataatctgctaatactgtattgtgaaatgagaagatggaacttcaaattcaattttcaaaaaagtggttttcactttttccatatctatccactgaagcaagaggtgcctccaagtttcttgttttcggtacctgtaactatgtagctgccattaaagaagtggaaaagaccatgagtggaggaggttcgtgcagggtaatcagaatttcattgttgcaggtatttatatctgaaacgtctgttagatacttacgcagtgttacgaagtacacagttggatatggactgtggaattcaaaggagaaatccaggttggagattgaaattaggagtcataatagtactgacatttttaaggtgtgagattagactagattgagcaagggagtgagtataaagaaaagatgaataactcctcacttctgggccactccaaaattaagtaggggagaaaaggggaaaccaccaaacgagaatgagaaaaaatgggtagtaaaataggaagagaaccgagaagctgttgccgtgaaaggatagtgaataatgctgaagataggtcaagtaagataaggactgaaaataaatattgcttttagcaatgtaaaaggcaccggtgattttgacaaaagcagctggctttgagtggctgaggcaaaagtatgattgaagtgggtttaagaaaacttgggagggtgaatacagatgaaggtgagcacttgcgatctaagaagtgggagttgagcaataagaacatatggacacagggaggggaacatcacacaccggggcctgtcgagggtgggggcctagggagggatagcattaggagaaatacctaatgtagatgactggttgatgggcacagcaaaccaccatgggacgtgtatgcgtacgtaacaaacctgcacattctgcacatgtatcccagaatttaaaatacaaaaaaaaaaaaaaaaaaaaagtgggctctgtagatgcacaataaataattcctggaaaacatgatttctttcttctatcctagaatttatttaaatgataaataatttgataagctttaccattgtcttttttaaattgttgaatctacttgaaaggtttcatattagagattatgaaattgttaaattgtttgccaccagttaggaagaacaaagttattctgtagtctcagtcctccgttacaaggtgctcagaaattatcagtatttccttttttcaatattgaagatggagtggtttgtctttttcaatgttttgccttccaaagtaacaaaatggtgtgctttttatacttcattttttttggcttcagttttactttggtctcgttactgaaagtgagactcatgcccagacgcttttcaaacaaaacctagcacttaaatataatgtttaactcgtaactatagactctgtaaatataaataaggttaccttatgaaagtaaatgatttttaaaataccaccttattccaactgaggtgtttttaaaatatttctcatttcatccaccacggatttcaggggaacagaataattcagatttttgagaacccttatttatattgtatggaagaaaagataattgtatcagagttttgatgcatgggcccactaacgagcaaagtatattattattattattattattattattgttgttgttgttgtttaaattcaacattttaactcttacttaacagaagtatttatctcaatattttttcctactgttaatttgtcccatctctcttgcttttcgatattcatttgcattctgtaaatttgagaaacatatgatgaatcttcctgtgtagcctcttaaaaatcaggagacctgagtctgggcccatgttctgtatgtaacttacagcctatgtggccttgaatataaaactaacctttctttttttccatcagttcaaaaatacacattttcacatctggacagataaatggcataaagaaagtgggctttggagacagatatctggtcagcaaattgaaacacctcaaatagaacaaaatacatagtagcaatccaaaaatattaatcattattaactctaaattaatattagagtaaaaatgggcagagcctttatatgtaatttttatagatatgaggaagttaagaattagattatcttcatagatctgatttgaattttatttctcttttcattgaatcactttgttttcatcatgcaaataatacatatttttactggcttcacagctgctggtaaaaactaatgatatatgatctgaatgtaaaatgtaagcttatttcattattatacaattttgcttttttcatcctcctcaccacctatatattgtgtgtgtttgggtgtgttcatcggggaaagaggaaaagttgtagaatttatgacttttcatagcatttttatgtcctggatatgacatgctggttattggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccaactacttgggaggctgaggcaggagaatggcgtgaacccgggaggcggagcttgcagtgagccgagatcccgccactgcactccagcctgggcgacagagcgagactttgtctcaaaaaaaaaaaaaaaaaaaaaaaagaataattagatattaaagaaagatggagagatacaagaaagagagaaaaaaatctgttcaaaatgccttgcatgtatgaactgctctgagcctgtaagagtgaagcagaggattcctgcttaaatcatttcaaggtcattgggttggaagcccatatggaccaattagttttaaacagtgaaaaaacaatgttttccaggcgtagactctacctcttgccctggtcagctgtctccagaaagcctgatgtgtgtcacaggggtaactcctaaaagaacatccatcgctcggcacaaattaatcacaactgctggatgcagaaagacctcatccatactgatggtattagcagcatgcctggttatgtgagatggatacataatcccagacaggaccaaacattattccagtactgttcttcttagtgctgagcaggatcttaaagcgttttgtgccatgggctaatttgacattctgctgccaaatgaaaagttaaatgcataaggtaaactatgtaatattactaagaaaatctagcatattatctaaatagagatatcaatatattaaaaatcaaatataagttttttaatcaatgcattatatgacattacctccctatgggtttattaattagcataatttcacattagtaattgacataaataatatttcaacaaatcttcaatataaataatatgaaggaaaatatattgtaatatttcttggtgaaaagtcagcaatccctaccaatatcactgtagtttgttacctacctttttaacagatgaaaatgttaaattactattagaaggaagtgaaaaattgtcttctggagaccaaatttctttcctcacgttttaacagttagagatctctagctgagctacttacaaagtactgtcactatctatctagaaaatcacaccagagtttaatatcaaatattttattttcattttaattgatttaaaaatacaacttttctcccaatggggaaaacataacaaaaattaaagatagaatttgaattcattttaataaatgtatatgctattaaattatatccatgttttctcataaaagttggaggagattttccagaagtcaattgtgatgaaatcttcctttaaattaaaccttccaatacacatataataaaatatatattttttaaaaaacagaaaatctatggttagtattttcctatgtgcagcatgaccatgtagagattttgtatgaaaatgtgttagaaacagaaatttttatcaacttcttaaacttaatgggagaaaaaaaagaaaatttatacataagaatattaattttacttgaaaaacatttctagttaaataatattgcaattcacagtttctacaacattacaatgaaatttattatttctgtcctttttaagaagcttttggggacggtcagtgggcaataaatataactttattaattttatatagaattacgaattatttgggaattgtctacgtttctttgagctgcaataacaaaacaccataaactggatggcttataaacaaggaacatttatttctcacagtcgtggaggctggacattcgactcttgtaaatttggtttctagtgagggcccacttcctcacagagggtggttccaccttcttacttgttctcacgtggtgggaggcggggaaaaggagccctctagacccttttctataagggcattcaccccattaatgagggctctgccctcaccaccttatcaccttccaaatgccacacctcttaataccatcacctttggggttaaaatttcaacttacgaatttggggggtacaacagcagagaccatagcagagatttaaacattagtgtaaaatgagaagacacagaagagacaaagtcgatacgatagttctttatttgtgttactttttttcttttatttaaatattttatcagcggtacactcaagtatctccatttgaattttctgactaaatgtatttaaacacaattacctctcctactgcattcaataaaaattacaataatttggctgggcgcggtggctcacgcctgtaatcccagcactttgggaggctgaggcgggcggatcacgaggtcaggagatcgagagcatcctggctaacacggtgaaaccctgtctctactaaaaatacaaaacattagccatgcgtggtggtgggcgcctgtagtcccagctacttgggaggctgaggcaggagaatggcgtgaactcaggaggaagagctggcagtgagccgagttcactccactgcactccagcctgggcgacagagcaagactctgtctcaaaaaataaaaacataaaataaaataataataatttattacagtgaatttttaaaatatacactgagttttaaaacagaagactgaagcaattaagcctcactggattttcatttcctcatttatattttcaaatggccctttaacgtattttttccttatgtgatgatattagttaaaaagagaaccctatatattgcatgaaaagtgaaactccaaaaagatagcacgacatatactttctaaatattttcttttcttttcaattttaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgtaagttaaatacatattttgctcttgtttgtgtaacaaatctcatatttccattaatgggaaatatgacaaagatatggctacataagctagagaagagagaattaagtcactgtaagtgagttttagtgttataatttaattccaaaacaaggatattttaaaaagtatctttgaattcaataactattccttttcagcttgcagatattcagtatatgtaagaaaatgaatgttttacttgatgtttatttaatgacgagggcaatatttttattaacatatgttgagaactgttttatataattattgataaagcaaaaataatggtgttactacatgagtaaaaaatcatgaaagcacccctagattgtgattctcagagacttttcttcaagtctgagggcatcgttattaaaatatatttgaggcagctgacccattcatacttctgccagtgactatgtggatgcttacgcttcactccacaaatcattgtcttttgtttttcttgtactcacactatctacatgagtgggaaatggtccaggctgagcaaatcagaacactttacctccttagccagagtgaatgttataaagggacagaaaatctataccaggctagccagaatcctcccaggaatttacaatggagaacagaagggctgaaagactttggtatcatgtattagagaagtggaaatgaatctgaaacctttgtagccacatttgctgacatcatgagaaagccaattatcagtgggagagaatgaagcctgagagatacacacagaaaagagagtcccattgagtgcctgtcttttaagttttaagttccccagaggtattctaattcccaaagattttcctttgagtttgtgaactaccacagtatcctcactgcataaatatgtatacatatgttttgtgtatatatatagatagatagatagatagacatatacacaggtatacatacacatacagatatagatagatagatagatagatagatagatagatagatagagatatatacacaggtatacatacacacacacacacacacatatatataaaacagcaagtaaatacaactgtgtttggattataagcataactatatgtaaaagatagttggatttcttacttgctgttatataattcttgattcattcatttctcccttaacagtgcttgctctcagatagatggatttttttgtgatgatggaattactgtgtaactgtactgtccaacatagtagccactagtcttatacagctattgagtacttaaaatttaactggactaaaaacataacttttaaattttgcttaatattaatgaaattaaatataaatacatgtcactcataaggcagcagagctctagaatgttccctaatatctcattacacatagctttataatcacttcaggaaattaggaaggcactttcagattttttttctctttctaaataaattttgtaacactccacagaggctatgacaattcttgttggcactccacctcttcccaccagatgctttattttattcttttgtttctctttgctttgttttctttttccattctagcttttttttttttttcaatctttcctggtctctcacatttagtgtcttcttaaaccacaagttttaacaatatctgtcattgagttctcagtacatgtcaaacaatacagtaaattcttcttgcattaattcccttaaatctcacaacaaacatgatagatgcaattatccctatttcagaaagggatattaaagctagtttaaatgccttaccatgatcacagtgttagtaaacagtagaaatggaccttaagccaaggtttatggaaaacaaagttctcaattttaagcactctatattttatatactttgatcatagtctgactataatgatagctgaagaatgctctaggttcttttcctagaaaagtgaacacattaatctatacacagtttcatatgccagtcaagagaatttagggattctctgatgtatagtgggtttcatgagtcacaggaaaaaagtctctactgaatccccactagaaaacacctagagtcaccttaataacttcaatccaggctgagcaaatgtattttgtagatctactaatgtcccacaaattttagtgcggattttgcttttcaattgaatacatactcatattttaagtagtgactaatcaatttgaaagtgtatgatagcttaggtcataccttaatagaactggtggttagaaaaatctaaatctaaagttaggtagttttaagtttacacaatagcaaaatttatgtatttataccttctcagtgtgttcatattatctattggttacacactaagccctatgcttgcctatgtgaccccgtacttgtctggattgtctgttcacttttaaattacaaatgttaaaattgtgttccaaggaactttgtaaaagacagtagtactcacagggcattgatgaaataaagtggagagagctcaggggtctaaaacctttgagaaacactacttataattcaactcttggagatgtacagtaccagttagtctatgaaatgctctgaagtgtttttggcagtttgggctttggatttagacagatcttggcttgactcctggttctgtcatgtaatagctgtataacattgtgagtttcatactcatcaggtgccccctcttgtccagtcatctatatggtagcaatcattgctgccttggtatgtgtctttagttgggactggtaggaaagggcatggagagaaaatttccctgagatgatgccatgtacatggagggtggcatgcttcataacttttataaaagtgtcaagtaattaatcagcaaaactgatcatttgtttattacttagactcaccccctttctaaaataatctatggtgagtgactgtcattaggtgtccagagagtgaacaagtatgcctagtcttctagtaataaaatttttaaaaatatcatatgtagtttctatatataaaatataaataagctcatagaatattagaaatagtttaaacttccagtactgtatgaaatcctctcctaaaacccatttcccagaaattgatagatgttttattgtgctatgcaacctagaatcctagaagtcttgcttgatttttatgttttctttattcgccacaactaagaaatcttccagatcttcctattttgtcccctaattatttatttaatctcttttcttctctctatccttataaccaccaccctattggtctgttattagaattacttcctgatgttcttggtctcttgatttcttactcaagtctatcttctgcagggccattagagtgatttattcaaaagctcaaatctaacatctaactacatccttccttcctctctccctctctccctctcctttctttctctttttccttccttccttctttcctttctttctttctctttctttttctttctttctttctttttctttctttctttctctttctctttctttctttcttttttttttttctttcttccttccttcctttgtttctttcttctttccttctgcctgcctgccttcctgccttccttccttctctccgttcattatttttttctttctctctcccttcctttccttccccccgtcccttccttcccctccttctccttctttcttttcttttttttctttcccttgcttttctttcttttgagagagtttctctctgtcacccaggctggagtgcagcgtcacaatccaggctcactgcaacctctgcctccctggctcaagtgattctcccacaacagcctcctaagtagctgggattacaggcttgtaccaccatgcctagctaattttttttttttttttttttgcattttttgtagagacagtgtttcaccatgttggccaggttggtctggaactcctgacctcaagtgatacacccaccttgctcgggtttacaggcatgagccactgcgtctggcccacatttctatttgatatacttttatgacacctattcctctagagaagaaaatttaagctcacacaattttctgtatcttgatacctgaacatttttgtggcctgagttttggaaacttcctaattcacctataacatttggcaactgcttgtcgtttctttcatgtgccaagctacatcttgtctaatgtttgctcattacatgttctaggctttgaaatctttcatctgttgcacaggctggcttggataacttatactcagtgtttagagctcacctcaggcattccttcattcgagaatctttccacggtattcattatccaattttagttgcatgcctccctcagtgcatttctctaattctatacttccaacttgaaaataatgtctttctccctcatgagtttacatctgttgagaataggtcctatatcttagcaacttttgtatgctgaagaactaacacagtttccagcacttaatagggtttgggaactcttcaataaactcataaattcagtcactattgaatgaattaggttatctaacagatgcttcaaagatgctaatgatgttgcattaagtatttcacaagatggcctatcccatgtttgaacaactctaattcttagaaagctgtttttcatactgagttgaaaccagttttcttttaattcatctattattccttaaatcttccatttgccagcacacaaaataaatctatgaaatagtcattcatatattagaagatggatttatgtccttctgatacatctgttttttatagaccgagcaccatttatttttataaagtaaattagttcatttctgggattttcaaaagatctgtattatgaaaagaaaactttaaagccattttagtttatgggcatgaattttacttcaaggtaaatcatgccactcttggctgggtgtggtggctcactcataatctcagcattttgggagagtgaggctggaggatggcttgaggccaggagttccagaccagccttggctacatatggagatgcagtctctacaaaaataaacaaaaaacttagccaggcatggtggttcatgcttgtagtctcactaattgaaaggctgaggcagaaggatcccttgagcccactggttcgaggctgcagtgagccatgattgcaccactgcactgcaggctagatgacaaattgggaccctaattcaacaaaatgaaacaaaatcctgttgcttttgagtgtcagaattagtgacaatcatcattatagggataaactctttgagagagacagtgtgccacctcatacaatatcagcatagtattagagattaagcctcaagcataaaagtggaagttgtcattgcagggcttggctctcaagagttgcttcaagcatagctattccagatggtaaatgccaagaaggggacaagtttggatccatttgcgtaaaatttaagttgtgtttctccctttaatttagtggaaagtgaagccacattttaagaaacaatagccaggaatgtgagttgtgatagtattcacagtgtagattttaagtcagaaagaattccaagggccacagtaatactgaaaagaaaggaaaagaaatatttgcaccagtgttctttttattgctatatagatgtagacatatacccatacacacacacacacacacacacacacacacacacacatacacatgcatgtatacatatatgaaccatatcagtttatacattatgccttttagagtacttgtaccacatcataatttcaaaataacccataatataagtagaataggtaaggcacaaggtgttaagaggcatgtctgagaccaccaggttttcagtgtcagagatgctaaaaattgattattgaatgctgatcataaaaaatgacaaagaataataatcaataaagattactcatttggcttgtaaaaagatacttatttataacttcatgtaaatttgtttctctgcttaacgttattttactatgaagaggtatctttgatatttaattcaatatactcataaagcagttaagtatttatatgcttcataaatatcgttattccattatatgtgggtcacaatgctaataaaaaaattgtatactctgaaaaaaattgtcagtctagtgtgctggaagtggtttgctttttcttcatatgtgcggttgtgatcatttacatttacaatatttatttcatgtttaatttgcgtataggttccacccagtggagttcctgtaggtactaggtgttaagcttgtgattgttcttttgttaattgctgtggtttatttccttgttcttttttttcttcactaaaacacgtaggtattacttcattatcccttataaggatatctacaaatactttatataaatttaaatatacttacttcattggtttaaaatttaaaaatattttaaagttaaaaaaggtaaaaatatttacataatctattgtttatagtactatgaaattttgtaaaatccaaatttaattgtcaactgaggcaaagactgcttaattattaatgttttctcagtccacaacaaacattggtaatttatcatggcattttttctaaaacattgtaagtttgaaattgaatttttttgaactaaatactcaggcaactactaccaagtaattaaaactggctgaggagataacatttttttgtcatttttctcttatgctttgtcatttatatgtatgctcttgtatatgcatacatatatatgtgcacatatgtctatacatgtctgtgttgtatgtgcctatatatgtgcatgcatatggtcttgtgtgtttgtgatatcctatatttattcccattagaaaccccaagttggtgtttaaacagtagactctcatctttgaacatagttttatatgatagaatgcttgtttattttatattcatatgtttgtttacctgtgtgttttcatatgcatttacttttgcatttttttctgtttttatgtgtgcatgtcagagcttattttaccatctcaaaatataatatgcagataagtgaattaatatatcatacttttggtatatactgactggatattttagggtaaaataaatattacctaatgtcagaggaaaattaacggtttttaatcaactctctgtgtacctattgatttaacacttaaattcattttaaataaacttatagacacaacagctacctaaagtctgctacccctattggaatattaagccagagcattatttgtccatgtacatcctagtctatgaaacttataagctattaactctaacatgattaaaagagttgcaaatatacaagtgttgactcaagttactctttaggaattgcaaaattcaaatatatttgtgaaattcaaactgtatcggaatgcagcttgacaagaaggaatttaagtttataaagagatttagagaaggatatttgacttcaaatgcacattgtttcttaccaaacctttgatacacctttcttgtgaagggtagcaaaaccttgaactgtaaatattgtcaatcaaaacaataggttagttggtactgatatgtatctattaacattttatgttgatattacttaaaattttcataaaactcataaaatgatatgctgtaatatttggaacataaatatatacacaacatttgaaacttgcactatctttaaaaatgaatataaattattaaacattgagtgacaatttgttgaacatttccaaatctggcttcctaaatttttttacttaaattaatacgaggatatttaccagtagcatttatgtacaagattattattttaaatatacataaatgtaaatgttatattttgatcagagattaactaaacaaaacagaatgagctataatatgccatgtatagtgctagctttctgtgatagattatcttcttcacaaaaagcaaatacactgtagttctgggaaatgttatctttctccagctagttattataaaagcactcaagaaactgagacagttaaattaacaaaagatctttaatgtttctgtttatccaatataaggaagtctatttatggagtattgatgtgtgcattatcttcaaacgaaaagcatttgacaaacaaaacctagaggttttcttgaaagtggtaaaaagtaagtgctctttgtgacacaaacatattatactacagtcacatttggacacactagttgacaactcaatacttattgaaatattgcattatcgaaatacttgacacacaaaaatgcttaaaaatgtgaagatatgagtgaatatacctaacaaatttattaacagaggttacggttgaaaggaagaaaataaattgagagaattaaggtataaaggaagtagagaatgatgagatttgaacaaaaggaacaaagtaaatatttggtaaacaaggtacatagcaaaacttcctcagcttgcatttagggtttaaaggtccgaataaattaaggcatgccagatggcaccattgttggtgcatttagagaagtgtatatgtgcttaaaagcccagtgattaggtaaatccaggatgaacacaaaacaaatggcagacattcatacttagagtttctttgactgaaactgcatgttaactaaaacttttttatcaactctaataattgaatttaatcacaattcactctaaagtgtaaaataagaatgcttaaaatatcattcagaatagacatatgcattttctaattgacttttaaaaatacataatttatttttaaaactaacatgttagattttttagaatatcccgctttctagttatctgagtaattgggttcatgacactgaaatggaaacaactgaagtgcctgtttgaaaatatcagagtgtgaagcctcttgaactttttctcaatatttttgatcattttataataaatacgccagttggaattattatgtgtagtattactttcttattgttccaggataaatgtagcacagtgaccttaagtcaaaatcctgaacatagaagctactacagaatgagatattatgaatacataacttgttttaggttcaaatgaaaccatttatttcaaggttatttgaaatctacacatatcacaatgtttaaaagatgggcagattcaagtatattgtggatcaaatcatgttcacattttattatagtagtgtgcattacaacttttgtattttacatagaaattttgaaattatgagttctattattttcaaattaaacacatttaacaattttctattctttgctcttgcctcagtccttgacatcagacttaaagaagtgttttatgatattaaatccatttcatatcatgctatgcatactttaaaagatagtataatctagaacaacaccttacctccctgtatcactcctttctctctttttcaaagccttcataatagtccactctctgaatattccttttttcttcgctccacctgcctttctttcctactatgcagacatcagtgctagccttcttactttatattgctgttctttctctaaattagagtatgttgtcttctgtttcaggggtggcaatgaaattgcaaagggtcttcaatgctaagttgattgtctctcagacttgaattttgaaatcccttcctttttaagtatatatcattttttctagacttttctatcagacacatttgctaaatttatgcatattttaaatcaaattatctgaaatattttaattaaagtaaacatgtttccatttggaaaattttacagcattaaaataagaaagagtaagcatgatatttataggtaatgaataatacataaccaattttatttctattttgcattataagtaagaacaagatagtaatatgtatatatgcagtttattactataaatgaagtaattataaagtcttattgctaaaattttgaaatgcaattttcttttcttgcttttatttcttatttctccagtccaatgctattttggaaaatattgataacaaataatcagtaagaatatatttaattgggagtttttatattctttctgtttttctattatttttccttttttcccacattgattatacctgtttgtatttcagtattttgtattccacgatataggtcaccatcttttgaatagtttagatcatttgagtaaatatctagttaaatatcttttatcgttagaaattcttaatactttcacgtggatttttgctataaatttcaaacattaacttctaggtaatgaactaatagctacattatttattcaacgtttgaaacgatgtcattttttttcaaagacaaaagacccagagcttcacctttttctgaatgactacacctcagtcttcaccgtcacacagactggtattactcgctacctcaccttacttcaaccagtggacagggaagaacagcaaacttacaccttttcggtaaagagcttttgtgtaaatatacatatgtatgtatgaatgtatgtatgtatgtttgtatggaactgaaagagatgtctggttaaaactgaaaaaatcaatgacttgggggaaaaatacattattttcaataccagagagaagatcaatgaaaaattatttacatgtattgctctttttttgtaatttgtgtagctatattaacattcttcctcacagaagaaaaaacttttcaaaaaaaaaagaaagtgagaatttcagtctttactaaacagtcataattgtcttaaattgaggtataaagaattatttcctaaccttttttgttgttgttcttgcattttttatttagtcataaggttgagccagtgattctcaagagggaataaattttccctccagtgaacatttagcaacatctggaggcatttttgtttgtcacaattgtgaaggggtagttactataggcatctagtaggtagacataaaggatgctgctaattgtaatacagagaacagcccctcacaataaagagttatctgtcccaaggtgtcaatagcactgaggtagataaatcatgggttaggctaatcaagggggaaaaaaagtaaaggttattaaagttgtgattgtaaatatttatcatgagatagggaaatacacacacacacataaacatacacacacatgcacacaaacacgtaaataacaagtatagtagggttgacagttggataaagaaaaaatgtaacttctaattatatcccaatttttgaatcagtcacaggagaaagatgagctaagagaaagcacaagttaaacaagatatgtagaaattatttctggagaagcctacatagaaaaagatcagaacttccaggaaagtttatgtgattgttaaaagttagatacaaagtggatttagacaaagatggtggtgctgtagcactgatttggcaggaattgttaaaatcttgataatgtacattatcaacattgataaagtataacatacattatcaacattgataaagtataaaatatcacaattaaatgataccacttagtcctttgaaaattgccattgggtgaattactgtgatacaaagtacatctaggaagtctaccttcctgatggtataaacacattgactgtacaaggaactattgtatacaaaatatgtaaatgcaaataatattttccaattaagtttttaaggattaaattgtagttaaccctaagagtcagcaatgttattggcccactttaaatgatattttgcatatctgattatttaaaatatgcctggagttgaataccttaaaacaaaatcttcaatacttgcttcttaccatattagaacacttttaatatatgtaatattacgtctctattacgtccttttatcaacaaaatatttttgcaccctttcaaattgtaagattacctgtaagaaacttgttaaactgtaagagcaaactctgtactacttatatttgcagaacatctctactaagtgtatttttctcctcccaaagataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtaactactcacataatataagtgtacactcaaagctgttatttacatgtgcattatacgatatgctcatgaagaaattacttaagaaacagaaattgatttcacacttattgtatagcataattagtttaaatagctttaaatttctgttacttttcaaataaaagcatatccgccaggcatggtggctcacgcctgtaatcccagcactttgggaagccaaggcaagtggatcacctgaggtcgggagttcgagaccagcctgaccaacgctgtctctactaaaaatacaaaattagccgggtatggtggcgcatgcctgtaatcccagctactcaggaggctgaggcaggagaatcgcttgaacctgggaggccaaggttgcggtgagctgagatcatgccatcacactccagcctgggcaacaagagcaaaactccatctcaaaaaaaaacaaaaacaaaaacaaaaaaccaaaaacaaataaaagcatatctatatggactctaaaggagacttaactggttattagaggtaaacatagctatttgtagtaagtgaataaatgcttggttgttactttaaaaaaaaaagcatagctatttgaccagtttatattttattaaaatactgaatatattaaatcttcaaattacttttcactactgtagaaattgattaaatttcacttggagataaatacaaaaaactgccttagtaaattgatgcataatcccactagatattggttacctagataaaatataatcattacagcagagaaaatttaagttagatagtaaatggtaactttgaaaacatgtaagtcaggcaacatctttattcctgatttatcttatttttaccattatctgtgcttattacacttaaataagttatttcaaacacacacacacacacacacacacacacacactttttttctctcttttcctctctcatcaaggtcatagcccatatctgaaattaacctattttcttctttcccttactccaaatggaaaactcaggaggttagcaactttggctgtcttgtttgccactgtaatgccagcacatggcagacatattagccatgcagtaaatatttattccaaggataaatcatcaccaactttgcattaattgttaattaaaattagaaatcattcaatgcagctgggcatggcggctcacacctgtaatcctagcactttgggaggccgaggcgagcggattgcctgagctaaggagctcgagaccagcctgggcaatatggtgaaaccccacctctactaaaataaaaatttttaaaaaaattagccggacgtggcggcatgcgcctgtagtcccagctactcgggaggctgaggcaggagaattgcttgaacccaggaggtggagattgcagtgaaccaagatggcgccactgcactccagcctggggacagagagagactccgtcttaaaaagaaaaacacaaaaaacaaacaaacaagcaaaatgtgaaagaaaaaagaaatcattcaatgctattattttttatttatgaattaagatatgctttcttgagttctatagaaggggtgacatgatagcctggggactgggaattcaccggaatgtttattctatgtgtaaatagcttctgctgtgtatttggtaaagagagaaaaaacgtttcaaactgctatggtaaattttttaatatattggtatggtacttgtcacattaataaaatgaatgtgttttaaagcatttgatttcagggcaaaactgtaactagtttatttctgtatctgtggcatctgtatctatagttcatggcatatagtagatgtttaatacggtagctgctgatggcaacaaaagacactggggactactatggagggagagagggagaagagacaattgaaaaattaactattgtgtactatactcagtatctgggtgacagaatcaatcataccccaaacctcaacatcatgcaatatacccaggtaataaacttgcgtatgtaccccctgaatctgaaataaaagttaaaattataaaataaaataaatatagtgtagctacttaataaatgcttatttgaagatgaaagaaaggaagacccttagacaagtaatattgaatgaataaagatatgagagaatgggaagctgtagatacatgactattagttccagtcaattgatggaccatgagagctacatttttctttgctaaatcaccttttcacaggtagaaaaatcatagtttacataaataaatgaatgacaattattgtcatgttcttatttaattagagctgattttcatctctataatgacataattggaaatgaaagtaagtttacacagaaaaacagccagcagggaactacaaagtgtaagtaagaaaatcatagcaattatatggagaaactgtatctcaaaaatgtttgccttaggggatcaaaggcttatttcctcatttgaagtctacaaaagttaatttcccttatgtatctctttgtaaaacagatatttccttgcctttcaagacttttatatattttcctgaactatgcagattatgaagatagactgttgtttgtgtcagcatgcccacaattttaaaaattatttaagtcaacaaattaagctttataattagtattttaatgttatttctggtatgtggtagaagaatggtctcgctataaaacatcctccaagaacctagacataaactagttctcattgagagaatatttttaaaacaaagaaacttgatacagaactctgatctacatataccctttaagagtcatgacataggtccctatgctacacctcatcacaaccctgcctttccccattgacctgacacaggatacatcagtttactttgtggttagtaaactgatgtcaaagactgaaagtgtcagaaacaaaagtgacaatgagcactttaaaggaaagagacacttgggcaacaggttttaattattgtcattttcaatgtagccatgagactcttttagcctgatgtgagtgcatactcaattttttaagtacagtatatttttcttattaagtatctaccctgtctgcaaggagcaaatgagttggttataaagttttaaccagatccttgttataagttctcagttataaattgagcttctgactttatatatgtctcttacacttgattttttcaaaaagcctggagtgattctcatgcacatgggtcatgaacaacacttagaggagtgatgccttaaagcaccaacatcatcttccgtaaccggagctgaagtataatcacattattagcacatattttgtttaagggaaaattactgcatgagataatttcatttttcattccatgcagaccgttttatcagatgtcaatgcaatcgtataggttgaaactaataaatactatgctccactaataccaatccacacattgctagttttcttgaaaagacaattactccctatacaggatacagattttaatattttgaagatgtcaatttaaatactagtagctagctatccaattaatgctccataaacactattcgcaaacatctgcaattctcttaaactgtgattctcaatgataattgactattagcattctgcctgaggaacttttaaagtattgatgccagcacttcattctaagatgtttgtatttaaatgatttggccacccataacggactcacttagacagattttatttaagaaattgaaacagttctaatatgcagccaattttgagagttacagttttaaacaacaatattttaaaagtaccactgaataattgtacttctttttttttaaattttattttattattattatactttaagttttagggtacatgtgcacaatgtgcaggttagttacatatgtatacatgtgccatgctggtgtgctgcacccaataactcgtcatttagcattaggtatatctcctaatgctatccctgccccctccccccaccccacaacagtccccagagtgtgatgttccccttcctgtgtccatgtgttctcattgttcaattcccacctatgagtgagaacatgcggtgtttggttttttgtccttgtgatagtttactgagaatgatgattcccaatttcatctatgtccctacaaaggacatgaacttatcctttttttatggctgcatagtattccatggtgtatatgtgccacattttcttaatccagtctatcgttgttggacatttgggttggttccaagtctttgctatggtgaatagtgccgcaataaacatacgtgtgtatgtgtctttatagcagcctgatttatagtcctttgggtatatatccagtaatgggatggctgggtcaaatggtatttctagttctagatccctgaggaatcaccacactgacttccacaatggttgaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcacatgttttttggctgcataaatgtcttcttttgagaagtgtctgttcatgttctttgcccactttttgatggggttgtttttttcttgtaaatttgtttgagttcattgtagattctggtacttcttaagtcattaagatggaatcccacataaagttgagtcctctgatcctcaccccacttcttttcattgttcttttgttttttagttctccttcccttcttctgtgatgcttcttactcttctttcctgtcttagactgcactccttccaatttctgtgctccaccaattattctatttttttgatgcaataatctctctccagtgactaatcccttccctttgcccaattaacattattaacatccccaggttctggtctaatccctactcccagatataattcttcatgcttctatcccactctgattattttccttatcgacaaaaatgtatcaatctaagtgcctgcatacatatattgatctatatctatctctatatttctatctgtatttatctatcttgtatagaatatactctgggtttcactcacatcacaccactaaaatcatataaaattagatatcccatcagtctatttctacatgtcaaagtcaaaagtccttaatctttttgaaactctcaactatacccttttatgaaaaacttccctggttcccatcctacttctctgttggctgagagatgttactggccccttgttcaattatcaccctttaaaaattaacgttcttcaaatacgtatatatacttcttctctttttcatctgttctcaagttttcaatcatcacctctatatatacttgtctcccaaagttaaatgccctgtaatgacctctttcccaagcagcaagctgacattccagatatcagctggacatgacaaagtagatcttttacaagcacttcaaattgcacatatccaaaaatacattaactaatcaattatctttattttaataaacaaacacagacactcaaaaacatgcatctagtcgtgttggaggcagctatatcatgatgcacaccattaatctttaggttccacaggcagcaggataggcaccttgcagtcttgtttgttttccctctgctttacctgcatacatccaaattattgttcagtttaggcaatttctattttagaatgtatttgtagatcatcatttcatcttttttgttaaagattttttttgagcagttttaggtacacaccaaaattgagaggaagatacagtgatttcccatatactcactgtccccacagatgcatacctgccccaatattaacaccccataccaaagtgatacatttgccacaattaatgaacttacattcgcacattgttatcatccaaagtctgtagtttgcattaggattcactctcggtgcttcattttatggttttgtactaatgacatatatccaccattatagaaccacacagaagagtttcactgctctaaaaatcctgtgctctgcctatgcttccctcccccttgcttgcttccttcccctgacaatcattgatctttctacagtctccatgattttgccttttccagaatagcatgtgtttagaatcatatagtatgtagccttgtcagactggcttatttcacttagtaatacgtatttaaaattcctccatgtcttttcatgacataatagcccatatcttttcagggctgtataatattccattatctagatgtaacacagtttatttattcattcttccatgaaataatattttggttgctttcaagttttggccattattaataaagctgctataatcatccatgctaagtttttttttttacatggacataaattttcaaatccttttggtaaataccaaggagtgggattgctggatcatatagaatgaatatggatatctttgttagaaactgagaagctgtcttctaaggtgactgtaccaatttgcattcccatttccaccaccaattccttttccatgcctatgtgctgccataatttaggctactacagtaaactatgttgggcaatctggctatttcaatggatttcctaccacactgtttcagatgattattctgaaactgagtcagaacagatcctcaccctcctggaaaacctaccaatggaaggaagaaagctccacacatacagtcaaggacatctatgtaatactcttaaatatatttgtttcatctcctgctacatcccttcatgttatgaatccgagaataatatatagggttttgttttacttgtttttagcatggaatattcttcttattctgtaactattgagagctctctcaggttgaaggtttgatccaagttgtatctttaaaaaagaaaatctttaacacacagtacaattgttacctctttaataaaggctatattttcctagcaagtcaaaattaattgcttccacgtaccagctatcaactgtatctcccacatgttttattgtggcttgcgttaaggctaacttttacgtgtctgtctcccctactgatctgtaagttcctttaagacaaaaacttttaatgatctaaccacgagtggtcagtataatgacttacacacagtaggaattcagttaatgtccatagaatttaattccctcgactaatgtaccctcaatgagtttagaaaacacctaattttagatatatgttctatttggcgtaagaattctatcacacactaagtatcacctcacatagtcctttcccgagatgatctctaacttcacagctttagccaagctaccccttcctgctcttaaattggaaatattttaatttcttagttattctatatcataggtaattattcataggtagttattctatatcataggtatacctatatcataggtaattatcatacctatatcataggtagttattctatatcataggtaatatatcataggaaaaaactttgaacataattatttttatagcctaattttatagaaaaatgtgagttaatataatgacagatgattgttccaaattaacgagggttttaagtgacagagatgaagtagaatccaatttaaagacaatagaattgggaggcaggctagctagttgcatttctttctgccactttgtaccattacatgacataaccttttgtacctcagttttccaatctttaaaatggtgataataatagtaccaacctcaaaagagtgttgtgattattaaactaactatataaactactatcacatgcatgcttagcaaatgctgcatgtggtaacttgctattattactgtaccattctcataaattatgtaaagcacttatgattattaatatttgttgctaccttatctgtatatacttctgagtgtcctgtgttatttagtgctctgtggaggacacgtacataacatataaaattacatattaaattctgtttttgtaatttcaaatattcaagtttaagataaaactacatcgtattttaatgtctcttgacaatttatttcacacaagattgggagggttcagagtggtatggccatagacgacaatttctttcaaataatgattttgttttctttggtttgtgtgtataatgtcatgattaaagtttgagggttatatttacttaaggtcttgagggggttcagtatttcagcaaataccggataaagtcttcatgagcaaagcttacaaaaatgtggacctatttttacattagtacacaattttaatttatttttgatatttgaagcattttatttttttctaaagaccactccatttcttggctaaacctatttgtattagaattgaaatatatacaccaacatgtaattctgaacttatacaggttattcactcatgcttaggactttaattgaattccaagtttgattacactatcagcattttttcaaatggatgatattccccaatctaagaaactagcaacacctcaggaggctgaagcgggagaatctcttggaggttgcagtgagccaagatcgcgccattgcactcccggctgggtgacggaacgagactctgtctcaaaaaaaaaaaaaaaaaaaaagaaaagaaaaagaaaaaagaaagaaggaaaagaaaatagcaacaccttccatttgattggaaaaagttattcttgaaacatactcatttactcccatctccaatctattaccacctcctaccaattttttctcatatacttatttaatgcatctacctgtttttctttttttcttttttttgctctgtcgcccaggttggagtgcagtggtgcgatctcagctcactgcaagctccgcctcccgagttcacgccattctcctgtctcagcctcctgagtagctgggactacaggagcccaccaccatgcccggcaattttttttttgtatttttattagagacggggtttcaccgtgttagccaggatggtctggttctcctgacctcgtgatctgcctgcctcggcctcccaaagtgctgggattacaggtgtgagccaccacgcccggccttaatttttctttcactgccaccatcaactttcacctaaacctgtgaaatgtccttctatgagtattatttatgtctcctctttccctcttcttcattcattagccagtgggctatattacatttgaaatcactcaaataattagcatgcttgaccccttcaatggttttctactgctataaaaatgaagcccataatcgatatcctgtattactggattagcgttcaatttcttcacttagcattttatctttctcttatttgttatgatgctcccacagtgatgagataactttcattcatatgctttccgtcttttaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaatggataaaaagaactaatagatgtaggtaaaatatgtattaggaatttatttatgagtcatgggaaataacttatatttcaggttaattcatttttaaattttttacaaagtaaaatattttaaactacagttatattagtatccctataacgtagtacttccaaacttgattattcagaagaatcacttcaaaaagactcttgagatgctaaactgactgaaaacataagtcaatcatatatgctgttaaagaggcaaagttgaataattaacacatttatttgaaaatgatttattgtgtagagcatttaaagtattgcgcacgatgccaaatcataagaaataaagaaactatcaacatatagtttatgaccttaagtaattactagactactaatgaagaaaggcaaattatattttggttttataatacatgacaaatatgacttagatcatcaaattaaacattattaagtgtttagcacatatttcagtatctcttaaaaccttagggcttatgtagtttaggctgaggtttcccatttgataaatttgaagaaatactaatgctagcattatagtaatcacaattccttgcattttgaatttgtgtaactgaaaacagaatatttagattttatattatttttcagacgttatcccctttccttgatatacttaacagtgtagctttttaaagaaaactcatttgtaaacacaattatttacttttatatttctgtatcatgttttttggttgtcatagtgaaagttgtccaatttcatggtccggtttcaataattaatgcttaggtgcttgcattttttatgaagcttctgcttatttgtatgtgattgtttttacaatcatgtaaattgtgtatttttaattttgactatattcacgctcatacttatggttctatatattgctggtttactagatatttgacttgaaatatgatattgctctagaagaaacaaaatgtacaatatattttatactattttctttagtatatgtccaataaatgaaacatttctttgatcaattttagcttttattcacctattgtttccaaaaaagagctcattttcttttcagctttcactggtagtaaattttgttattttcatgcgcgtgaagagaccaccaaacaggctttgtgtgagcaacatggctgtttatttcacccgggtgcaggcgggctgagtccgaaaagagagtcagctaagggagataagggtggggccgttttataggatttgggtaggtaaaggaaaattacattcaaagggggtttgttctctggcgggcaggagtcgggggtcgcaaggtgctcagtgggggtgtttctgagccaggatgagccaggaaaaggactttcacaaggtaaagtcatcacttaaggcaaggactggccatttacacttcttttgtggtggaatgtcatcagttaaggtggggcagggcatattcacttcttttgtgattcttcagttacttcaggccatctgggcgtataagtgcaagtcacaggggatgcgatggcttggcttgagctcagaggcctgacattcctggcttcttatattaataagaaaaataaaacaaaatagtgttgaagtgttggggcggcgaaaatttttggggggtggtatggagagagaatgggcgatgtttctcagggctgcttcaagcaggattaggggcggcgtgggaacctagactgggagagattaagctgaagggaggccttgtggtaaggggtgatattgtggggatgttagaagaaacatttgtcatatagaatgattggtgatggcctggatacggttttggatgaattgagaaactaaatggaataacagaaggagaaaaacaggtataaaaggtctaagaattgggacaactcaggatatctgattagagagtgcctaaggagattcagcatagtcctgccagcaaagattatttatttacttcaagagttaagagtggcagtttggggatagcaccaggagatatcagctgtgatggcttggaaaaacagtgtaaaccggcagtgtaaacaagagcagggcatgtacgagtagttgagaacggtgaataggagtatgactagacagaagatagtagggatgacaagttttttggggggcacagtcttaagttgctctggtgtctggaatgagactggggcttaataaaaaggagcatctataccgctcaaatgggctgtacccctgtagcattctgaggacaggcctgaattctgagaagggaaagtggtaaaagtattgtccagtcctttttaagttggtggctgagcttggtgaggtgtatttttaaaagacctttagtccattctacttttcttgaagacggaggaccgtaagggatataaaggtttcactgaatattaagagcctgaaaaactgcttggctgatttgactaataaaggctcgtccgttatcagactgtattgaggtgggaaggctaaactgaggaattatgtctgacagaagggaagaaatgcctgcggtggccttctcagaccctgtaggaaaggcctctacctatccagtgaaagtatctacctagactaagaggtattttagttatctgactcagggcatgttgagtaaagctaatttgccagtcctgggtggggcaaatcctcgaacttgatgtgtagggaagggagggggcctgaataatccctgaggagtagtagaatagcagatggaacactgagaagttatttccttgaggatagatttccacgatggaaaggaaatgagaggttctaagaggcgggctagtggcttgtactatagcataacctgcctttgctggtgtgtggggattaggcctggtggaaccgccatcaataaatcaagcgtgatcagggtgaggaacaggaaagaaggaaatttggggaaatggggtgaatgtcaggtggatcagagggatacagtcatgggggtcaggtgtggtatcaggaataatgtgggaggccggattgaagtctgggtcaagaacgacggtaattgtgggagactcaacaaagagtgagtatagctgaaggagctgggaagcagaaagtatatgcatcaggtatgaggaagaaaataggttttggaagttatgagaactgtagagagtgagttgagcatagtttgtgattttgagggcctctaaaagtattaatgcagtggcagccactgcacgcagacatgagggctagactaaaacagtaaggtcaagttgtttgggcagaaaggctacagggtgtggtcctggctcttgtgtaagaattctgaccacactaaccatgcctaggaaagaaaggagttgttgttttgtagaagttgctgtggtttgagagatcagtcggacacgattggcagggagagcacgtgtgtttttatgagaattatgctgagataggtaacagatgaggaagaaatttgggcttgattgaagtaatgggggctgcctgtgaagctttgtggcagtacagcctaggtaatttgctgagcttgatgggtgtcagggtcagtccaagtgaaagcgaagagaggctgggattaagggtgcaaaggaatagtaaagaaagcatgtttgagatctagaacagaataatgggttatagaggcaggtactgaggataggagagtatatgggtttggcagcacggggtggataggcaaaacaatttggttgataaggcgcagattctgaactaacttgtaaggcttatctggttttaggacaggtgaaatgggggaattgtaaggagagtttataggctttaaaaggccatgctgtagcaggcaagtgataacaggctttaatctttttaaagcgtgctgcgggatgggatgtcggcgttgagtggggtaagggtgattaggttttaatgagatggtaaggggtgcatgattggtcgccaaggagggagtagaggtatcttatacttgtaggttaaggtggggggatacaagaggagtatgcaaaggaggctttggattgggaagaagggcggcaatgagatatagctgtagtccaggaatagtcagggaagcagataatttagttaaagtgtcacagcctaataagggaactgggcaggtggggataactaaaaaggagtgcttaaaagagtatggtctaagttggcaacagagttggggagttttcagaggtttagaagcctggccgtcaatacccacaacagttatggaggcaagggaaacaggcccttgaaaagaaggtaatgtggagtgggtagcctccgtattgattaagaaggggacgggcttaccttccactgtgagagttacccgaagctcggcgtccgtgattgtctagggggcttccgaggcgatcaagcagtgtcagtcttcagccgctaagccgagaagatctgggaaggagtcagtcagccttgggccagagttccaggggctctgggagtggctgccaggtgagttgaacagtccgattttcagtggggtcccacacagatgggacgcggcttaggaggaatcccgggctgcaggcattccttggcccagtggccagatttcctgcatgtgtagcaagctcctgtgggaggaggttctggaggaacgcctggccgctgcggttcaggcatttggaagttcttttgtgctggagatgtggctggggtttgtctcacagtggaggcaaggaattgcaacatttttctattattgtacaccttgaaggcgaggttaattaaatcctgttgtggggtttgagggccggaatttaatttttggagttttatttaatgtcaggagcagattgggtaataaaatgtattttgagaataagacggccttttgaccttttagggtctagggctgtaaagtgtctcagggttgctgccaaacacgtcatgaactgggctggatttttatatttgatgaaaaagagcctaaacgctatctgatttgggataaagaaaaaggagcattaaccttgactatgcctttggctccagccacctttttaagagtaaattgctgggcaggtgggggagggctagtcacggaacgaaactgtaagcccgaccaggtgtgaggaggggaggcgataaaaagattatagggtggaggagcagaggctgaggaagaattgggacctagctcggcctggcgaggagcagcctggggaggaagggagaggtcagatgggtctgtagaaaaggaagattagaaagactcagcgatgcttggggttggtactgaggggacaggcgggagggaaagaaggaagatttgggacgagttgcattgggcacagagactaggaagggactgatgtgtaaaagaatgcctggacgtcaggcacctcagaccgtttgcctattttacgacaagaattatttagatcttgcaggatggaaaaattcaaagtgccattttctggctatttggaactactgtcgagtttgtattggggtcaagcggcattgcagaagaaaataaggcatttaggttttaggtcaggtgtgagttgaagaggttttaagtttttgagaacacaggccaagggagtagaaggaggaatggagggtggaaggttgcctatagtcaaggaagcaagcctagagaaaagagagagtagggaaacagagggaaggggttcgggggttcttaccttccagaaaagtgggaaaaggggttggggcacagagataagaggtcggggcacagaaataagggatggggcacagaaataaggggtcggggcacggaaataaggggttggggcatggaaataagggattggggcacagagatacgaggttggggtgcggaaataagggattggggcgcagagataagaggttggggtgcggaaataagagattgggggttcttgccctgtagaaaagcgggacttgctgctaagggtgaaagaggaggggttgaggggtacttgcccctctcccagaaaagcagagaagggttagagacaaggagagaaggggttgaggtacttgccccttccccagaaaagcaggacttgccgctaagggtgaaggaccaaggcaggcgtccctgtgtggtctgacacccttgaaacgtgggtgtataatcaggcgtccctgcaatgattaaacaccaagggaaggctgccttccctgtccgtgaccggcgccggagttttgggtccacggataaaatgtgtctcctttgtctctcccagaaaatgaaaggaattgaaattaagagaagggagagattgaagagtggaaaggagaaagtggttgagggacagtgagagaggttggagaagagagtaagaagaggccgcttacctgatttgaaattggtgagatgttccttgggctggtcggtctgaggacctgaggtcataggtggatctttctcagggagcaaagaacaggaggacaggggattgatctcccaagggaggtcccccgatccgagtcacggcaccaaatttcatgcgcgtccatgtgaagagaccatcaaacaggctttgtgtgagcaacatggctgtttatttcacccaggtgcaggcgggctgagtccgaaaagagagtcagcgaagggagataagggtgaggccgttttataggatttggataggtaaaggaaaattacagtcaaagggggtttgttctctggcgggcaggagtggggttcgcaaggtgctcagtggaggtgctttttgagccaggatgagcgaggaaaaggactttcacaaggtaatgtcatcacttaaggcaaggactggccatttacacttcttttgtggtggaatgtcatcagttaaggtggggcagggcatattcacttcttttgtgattcttcagttacttcaggccatctgggcgtataagtgcaagtcacaggggatgcgatggcttggcttgggctcagaggcctgacagttataatgtccaagcatagtcatctgagtaaaataaaaatagttgggtattgagatatttcaaatacaggagatcttaggggaaaaaacaaacatttaaatagagcagtagggatttcttaaaaccctagtaaacttgctcatccagtttggcaaaggaaacaaacaaacaaacaaaagcactattgtgcaagtcctaatatatgtatgctacatgttgtattactttcttggctagattataatttaatctacacagatttttaggtgattcgtactaaactaagtgctctgaaaaatacgtagaacgagtaaggcacagccctaatcctcaaggagttgactatattttgcaagaaataatccttcttcacagtgaaataatcagaaaacatcacaattattgagttgttaaatttgatgagaaagactaagagcactaacgagaattcatcaaaagtgagtggggatgatgatctgttagagtactcagataggcaagtgaagataatatgatgttgaagatgaaatgatacggccaaaggcatagtaatttcatgaggcattaaagatacaaatttaactggcattggagagaagaggaactgaatgctcaaagatttgcttttcttttactaagtcaaatatatgttggtttattctcccagcccctttgtcatgacaggcttttctgtacttttgtaaagtatttttatgtttctgtaacagcatttcatttaaagataggtttctctctcatctcctttcctagagcaccttctgtttgacagaagttattgtttctgtttcttttccactcttcatttttcggagtcagacatttggtacaaattaaggtctgaataaatggatccaattatttataaattaatttaagatggctaccttgcatgtagagtagtttagatttggcattgtatacaacgtgagatttcttgaagaagtatgaaagactgggtccttaaatcgatgggttaaagctaatgagatggaaattaatggaagccaactttgaggaaatctttttttgagagtgtaagttgggcatgagagaatttgatagcattagagcacttaaggttccagtttccagtctcagagtttgagtaattagaaccaatgaacctttacaaaaggatcatgaagttgctgcagaaaagaaacaagccctttaaatagtcaggctgtgaaaagaaatgctttaaagtcatcttcttgttgttttatttcttgcctttttttgggaagaaaaatgcatagatgggagattcatcttcggtgacaattattcatataagtatttaatgatcatgttattattaatgttatcaatatctttttccaaattatacaaccaaagtgataaatttgccagccacctaccctactgaggtgcccatcatcttggattattctaggatatgcgtaagagaagggggaaaactgggagcctgttatgctttttggctttaaagcatcacttgttcacattaaggccacagagaataaatctgaaaataaatacatttgcaatccccaatttgcttggccagcaggagttattgaagaacttcctgaatgttattgacacatgaagaaatcaacaaacataaaagcaaacccattatatcatttttccatcagaaatcacactgaatagtgaatttccagtgatagtttaatgagcagcagccttaggttcagactgaatgccaacctggagagacccagtagaccttacacagctccaagttgatttagctttaattaaggataccaggcaggcaacaatatagcttctatggcaatagcatagtagaagtcttgtaactttagatataatatcttatgacttctaagtcatctgcactcattatgtgttacccacttgctacacatttctgaggaatcttcttaaaatttttgttacactaacttctataatatctagtgcattaaaaatagatgttaaaacactggctatcaccagagcatatttcatacactaagaagttggaattccctctacaaagcaaattaacaaccatagatagattcacttaactgttctgatatttctttaacatttgaaagacaatttttcccccttatcctctattacttctgcctttttataagtgttgatacattcaactgggtatattagtttacacacgtaaattcaattctttctctggcaaatccttctacataaggattacctagttgtaagttttatgttgcccatccaaataatctttctgtcctagagatcagtatgcactcagattttatttttatctaactacataaatgaatttaaaaatcccttatcacacgatagagctgaggcagagagatgaaatatttaacacaatacactttaatatttccaaattattttctcaactttcctagcaaaaaatagacttttcctacatatcatacattttacattaccagagtagtcattagatactctttctccgacaattctgcatctggtctgatagcataactataaaccatcccctaggaataaactttcactagcgaaagcttctgcatatgaatgcagcacaccagtcacttttctttaataaagcaatgcattgattcttagtctgtccaaacttcgccaaaggtaccatgaagaagatgtttgtttcctagttcatagaaatatgactgtaatagaagattgataatgcccatacttacaaatgacatcttggtatagtttagattgtccgtagttcccagagatatgtccctcctgacttgatcttctagtatagccaactagaaccatttaaatacatcagaatttattataattgttatttcagtaatcattgattactctgtaatcattcctgagtaatgccaagttattgaaaaagaatgttccctactctgcttatttaggttaatatgtttgcctaaaagccatctctacttgattcagtaaactaatttattgaacttcaaatccctcttagttctttatgtccagtgttgattaaggtgactcaaggattgttcctcggtttggtttggctctgtgtccccacccaaatctcaccttgagttgtgaaccttagtattggagtaggggcctagtggaaggtaattggattatggaggcaaatttctcccatgctattctcatgatagtgagtgacttctcatgagagctgatggtttaaaagtatatggcacttctcctctcgctctctctctctctcctgctgccatgtgaacaaggtgcttccttctcctttgccttctgtaatgattgtaagtttcctgaggcctcccagtcatgcttcctgttaagcctgtggaactgtgagtcaattaaaactcgtttcttcataaattacccagtctgagttagttccttatagcagtgtgaaaatagactgatacatttcctctaagtatatatgatatgaatacgattcaagtatattgtgtgcatacagaagtattgtttctcccagaagcttgtagattaggcatattctacttctaggtgaagttcaacctgagtgtgcaaaaggatccttataattgcccttgagaatttctaggaacaaatcatcaggatatggggtcaccatataactttactgttcaccttcttgtttacaatactgattccataaacgtttgtttatatttcatcccacacttaaacacatctggtgaggcaaaaaagaaaaatcgactctgtcatactaggaaaccaccgaagaatgccttaagtgatgtcatttttatacatatctatacatgtataagctatggctgccagccactgcatatcagataaggtcaaagttagaatttaactcaaggcttcaaatgtaaaattaggataaatataaccaacgaaaaaggcccaagtgatacaatcctatctcatattctggcatgtcataaggagacattaaccccaaatgatcccagtagagttctcaagtatatcttgtaccttgatttctgccaaatctgtgcaattctccagcattggccattaatcattaccacatctgaagggagctgctaagaagattatactcttgctataaaatgttctctcagaggaaaatatgaaggtatcttatcttgaaatctttgtttgtgtgctctccattctatattccacaatttcaccttctcttctactgattacttttctcaacacagacagcctttcatagttggattagctgattacattctgcttttcttccatgggtctggcttttctttgcttgccagagctttcatacctgtccattcataggaggaagaagtagttttacaaaggtagcatggagttcatggagttgatagtaaagtctctgaaggcagaggaacatacagtggtttaaaagagaaagaaagaaacaaataatcaagatctaaactttgtgaggtgcataagaaggcaggaagaaggaagaaagttactcaaatgatgaaacaatacatgaacaagtagcctgaagggcattctataatgtagcagaaaaaaatggataaatatcattaaaaaggtcagatgtgtgggtggaattatctttgttattttcgataactttattaaggtataatttacatgtcctcatgtatgtatattaccaaaacatcaagggtttcatctaggtcctgctgcttgcttcacaaaatgccaatcagtgagacaacaaatattgccagagaagaaaactttaatcaggtgctgcagctgaggagaatgggagataaagtctcaaatccatctccccaaatgattaaaattaggggtttatatagcagggaaaaaatacttgtgcaaaaacaaatattagggtagggtaaggaagaggaattggtaaactggaatcataatccatggatgagaggtctggcatctcattttctggatacagttatctggtgagtttcagttccttggtttctaggagggttgagggttagtgtcctgaggaagaaactcccatgagacaaatgtaagtttcaagcttcaagacagggtatggtggggtgggggtggggggtcaatttctgtgtttattcaaagaccagtaaacatcagttccatgaaagagttgggctggttttagtaaatttagacagttgtgcaacaatgaccacaatctagttctatacatttctttcacccccaaaatttccatcaccccaaaactttactcatgaccacttgtagtcaatgctcactcccattttcagctgtagacaccccctgttttggtttctgcctctaaaagttttccttgtctaggaattaaaaaatatggagtcccatagtatgtatcttttacttttattttacctggctttttaaatagcataatgtttatgtagctcatctatgctgtggcatgaatcaatgctatatatctgtttctttgagttacttaatagaatccatcttgtgaaaacacattctgcttatctgtttaccagttgatgggcatttcagttgtttccagtttaatgtgactgtgaatattctatataagtcactttttggaaatgtaaatatatatacacacacatatatatacacatatatgtttatttttctgtttgttatatatagatatcttacgaaaagtgctagattacatggtaaatatatactttttaaataaactgtcaaactgctttttaataacagtggcttgtaccattttaccacccactacatcctctctgatagtattgtcagttcatttgttaaagccattatacagatgcttattagtatctcattgtgattttgtgttcccttaatgacaaattaatttgagatacttccatgtgcttattagccatttattgatcttctttggtgaaatatctattcaaatctttcactcatttaaaaaatttgtgtttgttttcttagtactgactggtaagtattctctataaattataaatacaagtcctttatcagatatatgatctgcaaatattttgcaaatacataatctgtattttatgtatcatgttcttatgtttttggtagagaaaaagcttttaatttttaggaagtttattttttattgtatcatacttttactgtcatatttaagaaaatttgccaaccaaattcacaaagattttctcctatattatcttctcctagtattcatagtgtagctttcacctttaggtctgtgatgcattttgagttaattttacatatgctgtgaggtaaatctctcagttcatgtttatttttacagtattcttcccttgtcctcagttttgctttccatggtttctattacttttggtcaactatattctgagaacattaaatggaaaattctagaaatcaacaattccaaagttttaaattttgtgccattttcagtagtgtgatgaaatcttgaggtgtcctactctgtccccagcttgttggggggggcatgaatcatccttttgtccagcatctccaggacatctatgctccctgcccatgagtcacttagaagctatctctgttattagattacctgtggtggtacccttattttacataacaatggtcccaaagcacaggagtagtgattctggcaattcatatatatcaaagagaagctatgaaagtgcttcctttaagttaaaatgtgaaagttctcatcttaataatgaaaaaaattgtatgctgaggttgctcatatctatgtaagaatgaatcctctatccatgaaattatgaagaagaaaaaacaaagcaatactcatttaaatatttccctgaaatcgagtctgtcctctcttgatggaaatatttaccagctaatttatctgtatttttttacttattgagtaattcaatattatttctatacagggacaattctaccactttcaagcaatatctttgcctattgtaatgaataattatatattacattattgtattaatgattacatggtatctcaaaccaaaatctcgaagcacaataatcctagaaaaataatcaaaaagcaaaccaagaagagtagttaagcatcaaaactattttatatatttagggttcttacggttgaaagacataatttcaaaataaattagcatttaaaatatgtaatttttaatctatcagaaagtggtgaatttggtttcaggcataagcagaaaccatgtcatgagcgatattttctgcttatttcttgacatgtcttcttctgtatgggtctcagtcttaggtacatccaatgaagactggaaagccagcagaaacaccagatataaatttaccagtttagccctagaggaagaaaaaaacactcttttacagtagttctaggagtcaccttgactataccaacttgaataacttgacatgtttttttgccaattgctccccaaaggaaaataagggacttttactggaagcaagagccaaggatgcccaagaggcaaaaacatcaaatgatcaacacattcatgcattatcaattaagccataattcactttttttttttttttgagacagactctcactctgtcacccaggctggagtgcagtggcacaatctcggctcactgcaagcttcacatcctgggttcatgccattctcctgcctcagcctcccaaaaacactgggactacatgtgctcgccaccacgcctggctaatatttttgtatttttagtagagatggggtttcaccgtgttagccaggatgatttcaaactcctgacctcgtgatctgcccacctcagcctcccaaagtgctggaattacaagcgtgagccacagcttccggcccataattcacttctaataaaaaatatatttattcatataaaataccgtgtttacactcttgcattacaatttatattcttgcatatggtttatatcaactgtggctttctgtgtcatttttgagactccaatttgaatgtttttgttcagcttatgcacaattcaatcatctttatatttgtccttttatatcaagctgtattttttttatcagaaccaggaaagagcaattaaagagagtagtaaactgcagccaaaatttaaaaggaaacattaggagcaacttagattattttgtggtcacatgggtgattgatggtgatatggtttggctatgtccccacccaaatctcattttgaattcccaagtattgtgggagggatctggtgggaggtaattgaatcatgggggcaagattttcccttgctgttctcatgatagtgaataagtctcccacaatctgatagctttaaaaatggaagtttccctgcgcaagctctcctctcttatctgctaccaccttctgccatgattgtgagacctccccgccatatagaactgtaatttcaatacctgttttcttttgtaaattgcccagtctcgggtatgtctatatcagcaatgtgaaaattaactaatacagtaaattgataccagtagagtggggtgatgctgaaaacatacctgaaaatgtggaagcaattttagaactgagtaacaggcagaggttggagcagtctggagtgttagaaaaagacaggaagatgtgggaaaatttggaacttcctagagacttgtcaaatggctttgtccaaaatgctgatagtgatgtggacaataaagtccagcctgaggtggtctcagagggagatgaggaacttcttgggaactggagcaaaggtgaatcttgttatgttttagcaaagacactggtggcattttgcccctgctctagagatttgtggaactttgaacttgagagagatgatttgggatacctggcggaataaatttcttagcagcaaaacattcatgaggtgtcttgggtgctgttaagtgcattcagttttataatggaaacagaacataaaagtttggaaaatttgcagcctgacaacacaatataaaagaaaatcccattttctaaggagaagttaaagccacctgcaaaaatttgcataagtaacaagaagctgaatgttaatccccaagacaatggggaaaatatctccagggcatgtcagaggtcttcacagcagcctctctcatcacaggcccagaggcctatgaggaaaaaattgtttcatgggcaggcccagggtccctgttctgtgtgcagcctagggacttggtgtcctgtgtcccagccactccagccatggctgaaagggtccaacatagagctcaggctgtggcttcagaggtttcaagctccaagcctcagcagtttccacatggtgttgagcctgcaggtgcacagaagtcaagaattgaggtttgggaacctctgcctagatttcagaggatgtatggaaacacctggttgcccagacaaaagtttgctgaggggcagggccctcctggagaacctctgctagggcagtgcagaagggaaatgcagagtcagagccctcacacagagtccctactggggcactgaccagtggagctgtgagaagagtgccactgtcctccagagcccagaatggtagatccacctacagcttgtactatgcacctgcaaaagctacagacactcaatgccagcccataaacaaagttgggggggaggctgtcccctgcaaagccaaagggacagagctgcctatgagcatggaaacccacctcttacatcagcatgacctggatgtgagacatgaagtcaaaagagatcattttggagctttaatatttgactgccccactggatttcggacttgcttggggcctgtagcccctttgttttggccagttcctcccatttggaaaggctgtatttacccaatgcctgtatctccattgtatgtaggaagtaactaacttgcttttgatttgacaggctcgtaggtggaagggacttttgactgtggacttttgagttaatgctgaaatgagttaagactttggaagactgttgagaaagcatgattggttttgaaatgtgagaacattagatttgggaggggccagggttggaatgatatggtttggatgtattcccactcagatctcatcttgaattcccacgtgttgtgggaggacccagtgggaggtaattgaatcattggggcaagtctttcctgtgctgttcttgtgatagtgagcaagtctcatgagatctgatggttttaaaaaggggagcttccctgcacaagctctcttctcttgtctgccgccacataagatgcacctttcaccttctgccatgattatgaggcttccctacccacgtggaattccacgtggcattccaataaaccttccctttgtaaattacccagtctcaggtatgtctttataagcagcatgaaaacagactaatacagatggggacatttggaatatgcacatgttgaaacactgagaggaaggaattatgaaagggtagggctaaagttcctgaatagaactataaaacatcatcgaaaagaaataaaaaaaacaaatagctcacaatttcttaccttttagatatcacaatgtttcaataaacactttaaagttatagtattgtttttactttcatctgaaacttgtaagcaaaatattggcctccccatgtaaataaatgcccttttcatttaggaagcagatttccctgctaaattagaaatgagcttcatatatttccatctcatagacactatctactggtcacagagtcattgaactataattgaattaaattcttgccataggttagctccaaaattagcaactacaactccattcaacatcatctaatagacttcagaaggggacatctactgtgtaatgtcgttgaggttttggattttttttttttttttttttaagagtctcactctgttgccaggctggagtgcagtggcatgatctcaggtcactgcaacctctgcctctcaggttcaagcaattctcctgctaatgttgaggtttaaaaaaaaaaaggtcttgagttttcgggatcttacatggaagacactattatgatttgggtattcagaatcagtgtctcagcttatttttctgacggtggactacgattaatttccttaaaatatctttgttagcatacatgcaaacaaattatattgactcataacccattattttattatttagtagtaaaagactgaaaaatagtgttatctaggtaacttaaacatagaatccttattttgtgtacttgttaagctttctacctcctaataatttctgcagagctaattgtgttccctgaataccttagctcaactgtggttgactatctctgcaatttagtgggtgtttctgtctcctgtgttttgcagtactatttggtatttctagcatctcccaggtgggtaccttcttcaatgtaattatcatccagcttatcctcccttccaacatcatttatgaaaatgttaaataagaccagctataatgctgacatccctgaagcacactccttaacaccttttcttaacttgatgcattgccatttatcattacattcctttagccaatttaagtcccaggaagaatgttaatattgaatccaatttgtgctaaattttaattaagatttcctgagacattttaagtgatttaagtataatcaaaattgatatctcctctgttatccccatcctctaattttctaattttatccatacacaaaacagaattagtttgtctggcttgaatagctctctataaatatatgccattcattttgactgtttctgcaaatgtttctcctttgcctttaggaatatgtctgtcaggcttatacaagtcgcagaatcatgtcataaaatgcctttccttccagcaaccacatctgtccacccccaaatagccagtctcaggacttagttgcattaatgtcatttcctttttcattctcaattattttttgctgctatgtctatggacattatcactctaagcatgacatataataaaaaatagaatatgcataatataaccccttcagcacagtacagtgtataaagtactttgtttacatttattgaggatattaaacatgaacttttgaatgggaaattagttaatatgatgtttctgaaattgaattcaagtttcaaggtaaatgtgtatgtttacatttgatcaaggaaggtataccagcatctttactgtattttcaaaggagtctgcaaactataaaaactactatttttagaagtaatgtattgaaaatataaatataagtaaataaaacatttctacaggtaggttaatttactacaattacatgtgttttctttattccacagaaaacttttaattatattccctcatgtgtaaattgagaccactttctttcattcttcactttttgtatgatgaatacagaaaatactattgatgtatgtaaaatgcttactataagatttctgctagaatccctttatattctttttcccctttaatttatatttatcagcaagtcaaggagccacttttaatataataaatcactgttgctttaatgttgcttgatgaagttaatcattgttatcttttcatataatatcccaaataaagtcttttagataccagttccttcaaaatgattatagatatatgtaaattggctatacagatgtttacatgcttaatttcaagggctccgaatagattttctttccccaaagaaacatttcttgggctatgttacccttgatattctacaatgggagatgcatttgtttgattgttgacacattaatactctacgacttatcagtcctttataaatcagggtgtgcaagttaataacctttcctagagcaattgtaaacaaaaaggacacaaagatgagagtgtctgggagacagggaggagaacattatggaaggaaaaatgagagtaaaaggaaggttgggagtaacaaaggccgactatgcctatttcattttttccaggttcagtctgttttaatatgagtttatgtgtcaagaatgcaaggcaagacaggaaaaataaatttcctatagggatattagattttctgttagggctttcctctttttccctttattaaattaaaataaagataagccttcaagatccaaagtttatttcttaatcactctcacaaaaaacaaaatcactcttatttttgtgattgctttagtattgtaacaggacacagtagcctcagttaaaaaaacaaaaaacaaaaaacagtatatatgtcaaggaaactttcctgtgtttttttctttgaaagcaagcttcttttgttgggggaaaaaacgacatggtggtgaaaagttgagacccaagaggatttatgttgtgattttcaattccagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggtaatttatattagaaccaatgcagtcttttcatcgggcccgtttaaccctgtaattaaatttaagaagcgcggcaagtattcttttatcctataaacatctaaattagatcagaaaatcagagagaccagattctcaggaactgcatgcatattctgatttggttaaattttgggaagaggacaatatcagaggcatatttcaaatttattatggaaaagtaaggctgcagacagagaaaggctcttttcttcaaagaaattaacagatgtgtcagtggcatgtaatgtctcagggtttcaaagtcacttctgagtgtataggtaattaaaatagttatgtaaaataatacatgtatttaaatatgtgtatacacacacagactcgcacacagacacacacacacacacacacagcaagctaaaagatttcctgctattacaattgcatctttctagtctcccacctgagaaatcccttttgttaatttattgtttatttccagattttcagtatcattccaagaaaatatgaataaatattaatatattccttcactttgctggggtttttttccattcacaatgaatgtatcctggagtcctctccatgtagatactagataaatccttcagattatttttttcacagttatgtaatattccttaataagtataaaactatggaagaagtctattattgataaacatattccttaataagtataaaactgtagaagaagtctattattgataaacttttcgatttatcctcttttattgacaatggagaaatatttaacactcaacatgcatcagtttgaatatgtgcaagtatatcagttttttatattggtatgttaagcccagattacagttattctacgttttctactagtgtttatgtggattcatattgtatatttaaatctttattgtatttgagatgtatcttagtacacagtaggaggtattaatgcagccatagttctttccagtcaaatactctgtggtccccacacaatacattgtgatattcatccaatgatgaacaaatttgagatgttgcatttattatatcatatattttcttatgtgttttgattttgatctaaatgttctattcaattctattatttatattttataacctattaccacacaattttaatgattaagcttacatagtatgctctatcctctggtgctactaacttacctcaatgctgttttccctccaaaatgttccctctccttctgttaagttttctctttgactttaaataagctagttcagtgtttttgttgttaactgtgtttttattaggaacacaagagatttatatattaattacttaggaatatattatatatgtttgatgttgaatctttctatccaagaacattttgcatttgcatttgtccatgcatttttttgtgttttttagcaggctttttgtttttctttttatgtaagttctgtacatttcttacttgatctatttctacatcttttgtttttattgtaaataggctttttttcttttacattttttccccctagcccaggtctaactctgtctcccagtctagagtgtagcggcacaatcccggctaatggaagcctcaaactctgggctcatgcaatctgcccacctcagcctcactagtagtggggactacaggttcaggccaccaatcctagctaattaaaaacaaatttgtagaatcagaattttgctatgttgcccaggctcgtctcaagctcttggcctctactgatcctcccacttcagcctcccaaagtgctgggattactggcatcagccacgacgcctggcctccattttctttctttactttcatttcctattatacttccaataaaaatgcttgtctcgtttgtgacttgaatgagactgcctcagtgtttccccattagattggtctatggttttaaaaactattaatatgttaaaaaaatactcatctatttctattttattgactttttaaaatagtaatggtgcttttctcagatcaaataaatagctaccatatatgaggacagtaatgacttttcttcttgagttgatgatataatgactgatcttactatagctcctattttgcatccatggcttagatggatctattttgcatccatggtgtagattctattaggacataatttttttctcttgaaataagctgatattatatgcttgctgttattttatttaataaaattagtctgtacttttctttttgagaaatcctatcaagattatgtatagttgtcataatacttcataaaagaaacaaataaaaacacaagaaatcccccaaaataattaataactataatatcagacatgaatgtattataaacatatataaaacaaataaatgagactgaatttggttctctggaaagaaacaacaaaaataaagacataattaattggataaaatactatctaacctaatcaagaaaaaaagaacaagtaaaactgtatacaataaaatctaatgaagaaactacatataaatagaaaaaaagtaggattcagagacaactttgcttaaatgtatgcaaaatttgaaaacagaaatggatgattcttctaaaagatacagtttactaatattagttcaaaaaaaaaaggaagtctcaagaatcttacgagatcaaacttgtcagataactcaatactacaccaggtgtaggaaacttgatggactgtaactaaactttgcagggtgtgtgatcatcattaatcacagagatacggttggtggagtattagattctcatttacatttttaaactagatttcctcctcctcaatagtttgttttcctttgaatctcgtgtcaaaaaataattataacgcccattacccctccttgctgtcatcgacagatgataggtctcttcccaataaattttcttctttctaacctcatatcctattgtcatctacatactggaagtcacacttggaagagtttacttcctacatgcctgacattcatttcaacagtactcctgtcaaacttattggtgactttatatccaataagaggtttaaggcgtctcccatcttgcagtcactctgaccaaacacccttagagtcatcctcaatgcccctcttcctccccaactccacacataacctggagcaactcctctgtgttctactctaaaaatgtattcagaaagcaacaactgctgccactttggttattagcattccagtccaagccactgcaatctctagtctagagtgttgaaaacttcttccaattacaagtcttcctgtgctctcttcaatctcttctcaacacaatagcctgggtgatcctggtaacatggaaaacatctcaatccattactcaagctttccagtgctttcacacctcactctgagtaaaaggcaaatcattaaaataaattcaaaagggctcagtgaaatttgtcagctatcactacaggtaggacactccctcatgtcaacagtttatacatttcatctcctactcaactctgcttttcttagtccattccagttgtggcaccagtctcctctctatctctgaggatcatagctacctatatgcttttgagcttgattttcatcttctctcagcctggatggatcttttctcagatttctcaatggcctcatttccttcaggtgtctgtgataggaaaagtttcctttcagcccaacaaaccatttattacatactaccatttactacattctggaaaacaaagataactacagtaccatcatttgaaagcccccaaaatacagtaaagtatataaagaatataaattaaattgagtttagcatagcaattttgagattaaggtaaattctgggctttctggggttattgatggggaacttacgataatgaaggagtaccaagaagtcatcccacaataagaggatgaggttgaccaaatgaaaaagaagtatgtgaccctatttgcacagcctcaaaggtctgaaatagcttcttgtttatagataattattagtcagtgttactggggcataaactgattcaaggtggggctggaaaattaaaaggccatgccacagaaaatttaattttcttttataagaaacttagacttatctagtcaataggaggaattcttggaaagacttttaaattagaaagtcaagtgagaaaacatgtttttgtaaaatccatctgattgtctctgtgggaggcagattttaggggagcagaggcacaagagtctacaggaaatactgctaatgttttgaactgggtatgttaggaagaatagagaaatagatttgtcaaaaataagataaaatatttcccagggttttgcttaaggtgacgtcatgttgatgtcaataggggtgcacatggcttgggtgaggacatcaatttaattttggacacatttagttggatgtggccaaacttaatatatccaaaaagcaaatatacacttggccctccatatccacggcttccacatcagtagattcaactaagtgcaacaattgaaaatatttggggagaacattacatctgtactgaacatgcgcagactttttttgtcattattctctaaactacagtataacaactattagcattaatattttatatgtattacaagtaatctcgagatgatttaaagtgtatgagacaatatgcatagattatatacaaatactgtctcattttctatcagggccttgattatctgcagattttagtatccttatgggctctggaaccaatcccacatggatgctgagggaggactctgtatgcctgaacctgataaacagctaagggctccttcttagaagaaatatatagaatacttttatacattgagtagttacagaatctacaataagagccaagtaaggtttgagtgcgttttaaataatagcttcatctgtgctaggttattctgaagaggaattaaagatgattgataatacttattgagcatacactaggaccagataccttgctagctcctttatatatataatttctaatattaacaatagcatcatgacttttgcataatttagttttgcacaccagaaatctgaggctgaaataggataattgacttggctcagcagtcccctttcccacttccactcccctagtaaacaagtagtaggaccataacttgaactcagagttgttagatttaaagctttttcctccactgtttcatatctataatctttgtagttactgttgtggaggaaaactataattgtttagtagcaatgataataatgctatttataagaacaaagtcaccttttgtttttttattttgattttattaaagtcttttaatattcaagacttttaatttattagtcttgaatattaaaataaaaccaaccacaagttggtattatatatacatatttttcattgaagattgtgttgtgctaaataaatctggtctgatctatatgtggccaatatattacatttgaagtgttttaaatcactttattgattatttaatgaatgagatcttatattcctctttttgctcagtttctatttgtaagacatatcattgattttcctggataatatattgtctataattatcaatacaataaatgttttttacttaagtaaaattgtattccacgccagaaaacaaagtgccatcttcagattctgagtatacacgtcttttctgtgacatcagaaatttagttgacctagcttcacatttattttcattaaataatgtcttggatactaaaaactcaccttagaatgtttggtgaaatatcaagtgggacctgcagagaataaaatccatatacttccattctacctgctgagataatgtcatgttcactgtaggataatcatatttgctattttctggagaggagttaatccttcaaattgaattgatgaatgaactgaaaagttatgaggctttgctttcagacttcttttataaggaagattatatttaaagattatgaacaaatatatatattatatatttgtatatatacacattatatatacactatatatatacattatatatatatacactatatatatacattatatatatatacactatatatatacattatatatatatacactatatatatacactatatatatatgtatacacacactatatatatagtgattttttttacagatcgacccagccagcaaccatggcatgtaagctaactaaataataacatcaaaaaatgacagcaggcttcagaatttagacagttttctatattattattttaaaattgacagctttcatccataaatgtagtaatattgactgaaaataagtccaatatgaatgaaatacgtatgtctgtgttattctaatttagtaaaccagctaaagattcagagagtgagagaaggaatagtacatagtttagtgttttgttttacttttttttgagactttgataagcatacagaagaaataaaaaccaaaagcttttaaaaaacacttaagttattttgggatattctttagtcgtgtatattggttaacttatacttacgttatccaattaaattaagtaaatatttacttcatcctaacatgaataaagcactactgtttgataattagataataagagacactctctctccccaaatagcttctaataaaattacgataaaaatgactgatgcatgggctaacatacgttttaaattcccattcttttcataaaatgcaaggctatgtttaattaatatgagatgaaataatttactttgaaatacaattattttcccattgtgattatacattctttttaaaatacaattttctctttaaaagatcattttactagtgacaaatgtacatgctaagtttatcattagtaaaaaatgatgaggctatttatttattcatttatttttataaaaattgtctaagttcccacaaatattagtctcttggggaggtactagaaatataaaacaagtaaaatgagatctctgcccacatgggattcagatgcaggcacaggtaaatctagacagatagcagtagataaatacaagtgcagttttacctgggcaagaatgataatggaatatcccagcagaggaaacaagaagatcaaaagaaacaaaacaaagtagtgtgttaaagaactgtgaatgacttggcacttttggttataatcactaatctgcttaaactttaccagctgagcctcattgtcaagatgaagtttatatcaacagatatagcccatgagtcccacctctgtaccttaactcttactactgctttacttacacccttctctttagttccacaaaacatacatttcttttctttaatcttctgtaaattgacatgtgagttttcctctgtctattaatgttctgtggtatttatatataaatacatcttctatcttaaaactctgccctgtaacttctccagaaaagttttctctgtcctcctatattggttttcaatgtgaagtttttgctcttgtagatttctatatgtatttcaaaaataatagaatacaatctgtgaacatcaaactgtaaacatagcttttctagcacaatattggtagaagacaaaggaaaacaaaaacagtaattaatctgtctgaaatctaccagaaaaagcaatataaatatctgtaaccttcatcttagaaataagctagaaatgcagaattacaaatagactccttgtagcacatattgacatatataatagaaaataataataagataatacaatcctctataagctagcaacattatctcattactactaattactattgtcatatgaaaaagttgtctttttataattatatcattcccaaacttaaagtatcttaagtctattttccaaccctcttctttattcatattttatgttattcttacaataagtgttatagatgaagtttgattcacagtattaataatttaaaattgtgacttcatagtctgaacctcagacttgaaataatttatggcttcctgtaaggtaacatcctttattacaaaccaaaaatgttttatattcacacatagataagtaaaaattctccagtttattttacatatttgttcttgtaggacgtagggagaaatggaaagcagattttgaattcagaagccttgtattttagtttatctgctgttgctaattaatgttataatcttgattcagtcagcaaatcttttccatttttaaaatcctcttttgtaaaatgagacttaaattacattgttttaaggatctttttcaattataagattattacgaaaacaccaaggtttcggtctaggtcctgctgctaaccatgcagaaagccaatcactgacacagcaattataggcaaggaagaaggctttaattgggtgctgccgctgaggcgatgggagatcagtctcaagtccatcctcccgaccaactaaaattatgggaatatatagcagggaaaaaaatgtaacaatgtgtaaaaaaacaagaactagggaggggcaagaaagcaatcatgatgaatgaggggtctagcatctcattatctgaatatggtgatctggtgcgtttcatttctttaatacttttttgagaggctgcaagtggttttctgaggaaggaactcacataaaacagaaaacaattcacaaaagtttcaagctttaagaccagaagggtcaatttctatgtttatcgaaaaagtgatctatgggactgtttggtcggtttcagtcccccctttctatttatcaattttcaatcatggggaaactggttgtcagtctttctggctgcttaatactgaggaggggcatcgtgggcagcgtcatactacaggtgatttcacggccacccagaaatcaaaggctaatctaatagtatcattttcttctgaaacacagcattttctcttcagccccccaacttccaacaaaggcaagtcatagcaggacaaatctacttgcaaaagaagcttcaggcccatatacttagcctgattaaccacccaaagtgcaacaaggttcattgtttatataggacctacactggcttttctggaacctttcccaagcccatttcagttcaaagccctaagaaaataaccacttcctccaattgtgtcccattatacaagaaaacaagttgtcattaaatgtatgcaaactaacacacatgaattaagaatataattccggagaaaataggcagagaaaaaatatgcctcaagttctgtttacaaaagtatactctacttaatatacttaaagcataacttaaagcttataagtagatctaaaaaattatccagactctgaaaaacaaaacaaaaaaatcagcaatattccaaagataaaagccacaaaaattatttcagtccttcattagtttagtccatgcaatcaattattgctctgcttcatgttgggttaacaatctttatgaacacatcagcctttcaattagtgccctggaattttcctctctaacctaatggcacaatctccaaagttatcagtaacctgcattgaaaagttcttttcacgaacaccaaagaagcaatccctagactgtagctgattataagtcactttttgagaaggatcaaagcaaaacaataattgtagatgacaaaagtcttaagagagtcatagttaaaggcacagtagataaagaaatttggttatttctgtggcatacaacaatgtaacataataatcataattattactgacaacttatattaagacatatcagaattacaggaatctcatataatcctcaaacacattttaacaacccatccatataaatatcacccaaaggaaacttagcaccacctcagatttgacaatatctcctgcataattctaacataacaactaagcctaataagccttacatgtctctcttgaacttcagggcaactaatatccaaaaaggttggtttgagttcacaaagactgaatttagaacttgaaattttgctgttggaaattctgtcgagtatcaaaggtttaagacactcgatatcacaaaataggatcacaggtcactataaaatattcatttatttagccaaaataataaaacaaaaacatttaccttttgatagagaggagactctgtttcttaagcaataagacctaatacttaagatagcatgaggccaacttattctgtctctcccctctcctttttttccctgcagtttcctcttacatgaaatttttgttcaaaagagaaaacaaaattgtatctttgtatggtatattattaatgttaaatctaattttaataaaaccttataaacaaatctatctaattttaatcagtttgacaaagttcttatagccttttacgattatctattaaagagcagatcaatgcaccaagaaaaccctgttattctgacacataggcccagacactgaccttgcatcattgtgcttttgacattaacgtttaatttacagaaactctgaactgagtttgtccctcaaaattgtccctcaccatctcacacacctacagtttccacaatagttcctgggtctagagggattgaatagttttaatttctggccctgtgtctcatgaaagcagttcattttgattgtcaccttctcctgtgtctgaagatgaggctttgactggtatcaatgctcaaaatttaacagaagtcagtgctttcttcagactgaggattcaaagacctgtaacttaacagcacaaggattagttaataggatatttatactacagaaagcctattattctaaaatgtcacaaattaaaacacagtggcttggagcttagcagatactacttatagcacttctgaccacggtgttaaagtagttaggttactcattccatatgtctaattgctagcattttagtgacagaactgtgaccaaaagcatcaaagttttgataggtcctttgacaaacttttgaaagcaagacaactaatgttgtttttttttccattattgaaaaatggcaaatgcaaatatcagctttggaaattcagaataaggataagcaatctcatttcacttaaatactatacaacaaagcaaggacaaagtgaaaaccacataataatctctcttcagctacttaaaagagcatcatcacacatttctaagatttacttctagatacagtacttacaactgattaagtaactttcacaccaaactcttcaaaccagtgcaacacttgtgcatattttgttttcaagtaccacatgaatgcccatcagagataaatggatttggatcaaaaattacaacaaagtgtcacaatttttaaagcaattactacctaattcaattgagtgtcacttaatgttaatagtggtaaacacaatgaaagtagtttcagagaaatcccaatcaataaaatttttcttaaaaaaacagcccagtctttcctgaacattaaaacttttaacccatatcacagtttttcttcactaaaggaaaggatctgaaccaactgaaattattgattgaattgaattacattggaaataaacatcatttaaacacttctattctcatctacttttccaaattacaaaatatataatgtactatttgtgtttagaactcataaaaataagtcttttataagatttttgccaagaaccttaaaattatcatagctatcaatatactcagaggtaagaaaaaccaatcaaatttaaatggctgctgtccttcatcaatgttttgaagcttgacaaaggtagtttaggaactttcaataaacagaacaaatggtgaattgttggaaatacatagaaaacaaaatgactattcatagaaccaaataaaagctttccattagaaactaaaaagcatcaatagttttatatattatatatatgtatacaaatatatatacatatatgtatacctatgtgtatatgtatacatataaatatgtgtatgtgtatatatttgtatatttaagtagaacaaatagcaaataaatgaaaattagaagcaaaaataggtcaggcatggtggctcatgcctgtaatcccaacagttggggaggcagaggagaggggatcacgagttcaggagattgagactatcatggccaacatggtgaaactcaatctctactaaaatacaaaaaattagccaggtgttgtggcacatgcctgtagtcccagctgaggactgaggctgaggcaggggaattgcttgaacctgggaggtggaggttgcagtgagccaagattgtgccactgtactccagcctggtgacaacggagagtggatcacgaggtcaggagattgagaccatcatgaccaacatggtgaagccccatctctactaaaatacaaaaaattagccaggtgaggtggcagcacctgtagtcccagctgaggactgaggctgaggaaggggaatcacttgaacccgggaggcaggggttgcagtgagctgagatcactccactgcactccatcctggcaacagagcaagaccctgtctcaagaaaaaaaaaaaagcagaaataaacagtagtccaaccctcaatttatcttctactcaattaactttggctttacagtgttacccagagccaaaaaaaattaacctgatggatattttattcctgattcagttttttgatatttactgtctttaagtccagcagtaccactatacattttctgtaactaagaaattcactttaggtatgtgatgcagaatagcaaatatactatgaaatttggctccatgttacatccagctttgggcttaactatatttaaaaaattgccaaactgctaatgtatttctttacaataatttatattttacattcattaagatatgagctttaactatgaacaatgctaattagccaaagcattcctattttatcaagttttaaaggatattttattatctaagctttttcaactttgtattttctttgtacaggcatgaagatagacacacagagaaacaggaaaaatggcatatgacttacacagaccatccatgacatgcttggacttttgttttgtcttagattttctttctgttctttttttaataaccagttattttaattttggacaaacattcaccatacaaaatcttttcttataaaaattgttatttttttcattatcaccttcctaaaatatattttcgtatctataactttttacacatctctttcttctacttattggttttcttctgccttgtttcataactaaccatttcaagcccataattttaattagcctttagataacttctgaactagacaaacagattcgttttctcaataaaaacacatcttctttagaattcttagtagccttaaattttagtgaacaaaactttagtgaacatctgagaagcaagaaattctgagctgactatcagatattagcattttacagatgagaaccattccacaatttttagaaatatgtttccccataactttttcttaattggaaatgacccagacacccaatgagcaccaaaaacaatttaaaaattttatattacacaaaaagtgtacctacaacatttattcaatttacaagtacttgattatttcattttaatagtttatccagatttcttctgaaaactgaaatattagacaccatcatttaaagttagctttttccttgttcattacttttttttttaatagctgatgaatgtcaggtcctcaactaaatcttaaaattaaagatatgggtatttttgccattaactcacaagaatcaactaacaacattacattagtctcatttgtcaaagaaggtacacaaaccaagatcattttatgttagctgggtttatagttctataaccttctatgccaaaccatgacacctcaatcatatctagcagagacatatataaaactcagcaaaaatgtatgctgacaattctaaaggcatttttatttttattttatcaaaaatgttaaagccagcttgcttattgtggttgacttaactcatttgaacttgaaaaatactttgggcttacttatgtgtattcttttatttataaaccaatttggtagacaaaaaaaaacgtaatacatgaacatacataaaccattaagacgcatataaacacacataaagatccaatctattttacctcaaaattatagccatgatatagcaatagaaactcactggtttacatagccacactttcttgacctcagtaggtaatccattgaaggctgtgaatcaaaattttgggtagaatagttttcatggcaatttgctttttaaaggctaaacctccccagactccaaagaacactggaaccaaacagcatcacaagagaacatcacatactgaccaggcctgaccatggttagagcagtagcacaaaagtctggatacatggaactctgtcatgctttcccattcaatagcaaactccagattccaaagaatattggagccaaacagtgtttcagaaaatattagcttactgaattctactttgctatgactatatcaaacacacacaatcgccaacacaatcctactgctgaaacaataaacgagccctaagagcatccaaactgaaacagtcggggtgcttcttctttctactggttgggcttgaccaacccacaaagaaaaattccttaggaatttctcaaattgagaggagccaatcccactgtctagtcccacaaaagatacacacttgctcacacacacacacacctcacaattacaaacaagcccccaagagtgttcatactgaaacccccaaaaagtgtccatactaacacaggatgcttcccactttcagtcatttgggcttgttcaactgacaaataaaaatttctttaaaaaattctcaaactgagaggaggggatcatgctgtccaggcccacaaagaacctgacactcacctatccgggtgcagatgtcaaatttcaaatgctgttctgactagacaatcaggaatgtagttgggggtagctgctgtggggccagaaaaaaaccaaaacacctccagtgaaaattgggtgagcaactgcttaggaggccttctaagactcttggctcaaggcagccaagacacaagcaatgtgttcttggtcaggtaacgaaaatctgtcacaggaacaccaggggttcagtttagattctgcagctggtcatacaaaaagccaatcactgaacaacaattgtcaaagaagaagattttaatctggtgctgcagctaaggaaattggtgacaatctcaaatccaactcactgactgactacagttagtgtttacatagcagggaagaaatgtaacaatatgtaagaaaacaggaactagggaggggctaggaagcaatcataatgaatgacgggtctggcatctcatcggatgtggtgatctggtgagtttcagttctttgataccttttttgggaggcctgaaggttgtttcctgaggaaggagctcagataaaacaaatgttaagtttcaagctttaagaccagaagggtcaatttctatgtttatcaaaaaaaagtatatatgtatttatatttatggaactattgggtaggtttcaagagtatataagaaatatattacctcttttgtgctactttgacctttattaccaggtgaaatataataaagctttatgagattcgtttttagaaatggagatttatctgcatcatactggctatattacaaaaataaaatttttcttatatagatgctcagttttatgcatttagcgataaaatatgaatacaaaatgcttgcgtaaagtgttatttatatagtgactgccctattttattaagtgcttaaatgatgctgttgaaatactactatttattacagcataaatactattattttattgttaatactatgggtatttaattttagaaaagctaactctgacactgtgctgacatcagggataaaaaggagatagcattttaaaaggcagtaaccctcaagaagcctggtggttatttaaacacattatagggacatgccaggatgttgaagatgaaaaatacaagaccttaatatatgatctcctccaaataactaacattcaagaccaagggggtgggggaacacaattagcaattctagcttttgaattattgtggaaaggaacagaggaagcaaaggagtaaggacggatcaaggagacggtcatgttgggctaaaatttgtctctgtgttttgtctgagactagagtcctctttgtttcagcattttaaagttttcgactctgtgacaagtatccaagtaactcatacgagtttaaggtccttattgtagcattgtctcactttaaccctctacaatgggaagataatgaaagggaaaggaataaagaaatacaaaaagtataataagtgtagtttaactatactttcacaagctttaagacactgatattcttgtaaaacctttataaagtattcttgaccagtaaactgaagatctaaagaatatcgaagcagaaagggcctagcttttgaaagaaagcttcgaatctgcagtacagatatgttccaggtcaaaaaaaaaaaaatgttaaacagtgaggaagtctcttggatccagggttattgaagacgttaagtgactttgtagagtttttctcctgaggtaatttaaaaaaaacaggtgagtctacatattgtacttttcatgagattctgaagcagtggtcttcaaagtctagtttctataagtagaactttggaaatttgtgaaaattgtagattcttgtatcctaccctaaagattatgatacaacatgctcaaattctaacaccaacataccccatgctcaggaggggtgaaggagtatcaagcctttgtaggaatttagccaagtgaaaggattcaattaaaatatctacagtattataaaggatgtagctaaggaaaatgcaagatcgtttgcactattcatagagtggaataagaaaccttaagccttattttgagtaatttattaaaataagttataaaagtatgtttcatatatatgtatacatgtacttacatatacaaatatataaacttatttcatctttatgctgaccttagatgttattattattcccacttattatgtggaaataatgaagctgaaagaaataatttgctctagatcattgagggcagcgtcaaaattctaactcaggaatatctggttacaaattctgtgttcaacatcactcacctacttttattaccaataacgttgtaggacttgttatgcatagagaatgtgctatcagagaaaagaaggagattcataaaatgttttaaaaacttgatcaacaacagaccctaaaagaagccaagatcttcaagggtaatatcagggaaaatgttttacatcttggggctgcttctggagtcagatcaccacctggaaggatgttaggtctacctcagaatgacgattcttttgttctcacaacacggaagtgggaatctttgcagtatacaatacattttgtaacttcccattgtttcatgtttacattaataattataagtatataagcaacatttcatcatcagtttgaacccatttaagaaatataatctgattaactgtattggcaaattttgatactaaatagataaaatcagaggcagaaatgaatacagatattttaactatgaaagtttaaaatattttaatttaaagtgagattactttagaacaatatcatgataaatgtaagcatgaaatttttttttttttttgagacagagtctcgccctgtcacccaggctggagtgcaatggcacgatctcgggtcactacaacctccgtctcccgggttcaagcaattctcccttctgcctcagactcctgagtagctgggattacaggccaccatgcctggctaatttttgtgttttttagtcgagatggggtttctccatgttggtcatgctggtcttgaactcctgaccttgtgatcgctcaccttggcctccaaaagtgctaagattacaggcatgagccaccgcacccaaccatgaaatttttaaaagtcactgtagcttttatgcttactattctattggtatctatctactgatgatatgctcagaaacaacttgaatttaggtatattataaagtgacaagctataaaacgaaattttagtgcctatgatctgaatttcttttttttttttttctttttttgagacggagtcttgctctgttgcccaggctggagtgcagtggcgcaatcttggctcactgcaagctcggcctcctgggttcacaccattctcctgcctcagcctcccaagtagctgggaccccaggcgcccgcaaccacgccaagctaattttttgtatttttagtagagaccggctttcaccatgttagccaggatggtctcgatctcctgaccgcatgatccacctgcctcggcctcccaaagtgctgggattacaggtgtgagccaccgtgcccagcctgaatttctttcaaaaggttttgaaaagtagaatgttgtagttaataaactcagacaaatatttttggtgaccatgtcttttaattgaagcatcttataaagagtttgggactactttaaggagattctaggccaggtgtggtgctcatacctgttatcccagcactttgggaggttgaggagggtggatcacctgaggtcaggagttcgagaccagcctggccaacatggcacaacccatctccactgaaaatacaaaaattagccagatattttgacacaggcctgtaatcccagctacttgggaggctgaggcaggagaatcacttgaacccgggaggtgggggttgcaatgagcaaagatcatgccactgcactccagcctgggctggagagcaactctccgtctcaaataaataaataaataaataaataaagattctcatccccaaatagaaattataacaaatgtgttttgaactaaatcatgactttgttaaattcaaagcatacatcttaggcagtggtggtatgtttgtacaaaatgttatatgtatgtgtgtgtgtatatgtgtgtgtatatatgtgtatatatgtgtgtgtgtgtgtgtgtatgtatacatatatatgttttttcacgatagagggctaaccttatgtattttcagatctcattgatatatttcagctaatgtttccaccttacaaaccttgactaacatgcttcttcagtttttgttttataaaacaaattcaaagttcagagatatcaaagaagttgactatgtcaatgctaattttttttccttgtaatgataaggtatcttgtccttcaagaaaagctcctgtcattataagggctttattaaatctaattcctagcttatcatatattgctttttagagaagattttaaaacgtatttagttttgtttgcaactattttacgtaggattctttatgatcctgactcctcacatgcacttacattaagccattgatgtcagcaacagaactgataaaacgcagcccataatttgttttgtgagttattgtaatcaatactccctctgctggtttaacagcaaaaaagccccaaggacagcttttattaccagatgtttatagaatgattttgctattagagaagcattaaaaacaaagtcagaagtcaaggcaagttaatttattagctttatttgtatagctattccattttaattcatactattaatctaagtaggaaaaacagatactggagtcaattacttttactaagataatttcataaaaccattatactttggtggtagttttttctatcctttcattttgattgtattatttttcataaaatttggaaattttttctcctgtaaacccaacaactgaataaacaatgcagtctaacattaaatgtgatgcagattcgtaaccatcttcttttcctctctttctctgcaggaactccatctgcactgtgtatattgaagtgcttccaccaaataatcaaagccctcctcgcttcccacagctgatgtatagccttgaaattagtgaagccatgagggttggtgctgttttattaaatctacaggtatgttccttggtgtgtgtgtgtgtgtgtgtgtataaattctaaagtgacaagcttggcatttaatgagtttatatttgtgtatggagggagaaacctcacatgcttgcctccactctagtgaatgaaaattccatctggaaaggaaagcaagggtaatatggatggagggtttccacagctaatctattctattgatcgccacaattgaagaactaacgtttggcaggcagggattagctgcaatcattacaggagagaatgaagggattggaaacacatacttgaatattttatactttggatccaaagagtctgcagctgactattattttctgtcttgtatgccttttgtccagctggatttatttttgatgcagtcttgtgtaggggaattaactttgtactcaaaggctgatggtaggcattctaattctgagacaaaccccacttcattttatggccataggcaaatcttgtaattgctgtggtttttattcctttagaagaagggggtagttttagctgatatttttatttgtagctagagattcatgagcatatgtgttacttgcaagatgatagcttggtgttcactgtttatatatttctgaccaaagtatctttggccaggaaaagctctatctttgactgaatatgcagcttcaagttgggctaaatacggtgttgatatattttcactttgctatgccaatcataagaatcataagatgacgtactattttctatatgaatgttcagagaacagagtttatcttctggtgttatgtggtaattgcagaagttgctgatatgagaattcatgaagctggccttaaagcctaggggagattttaacatgactaacccaggaaaatcccagcatcaatctttaccatcagctgacgtgacataaggcacagctacatctcgcttaaatcccattcgaatattaacaccctgtcacttaaattcggatgatataaaagtgaagatttcatagaatgtttgtattgaaaatgatgcaaaaataacacatcaatcttatttttgagatgtggaaagctaaccccatagaaagtaactgctgcttaaaatcagttgattgagttttcatcacttctaaaacagggctatttctgttatatcctactgattactgatagctgctgaaattttcttggcattaccaagtactactttgtgtctctactctaatatttattctgttgcttttctccaggtacttagagaaagtttgctttaattgatcatttaatattgaaacaaaattatatgaaggtagagatattagtaatatggaaatttggaggattttcatgaaataattaaaagaaagggaataaaacctacagtctctttaggaggaaaaaaaagtcaaagtattgtaatgataaagaatagaaaaaatcaaatattaagatagttcatttaatggagtaataagatctttgtctttacattcatgggaactcatttattgaagcaagaaaaaaataagagaaagaaaaggaaaacaaaataaattttacatgtgtaagattcaggtcaagaaattatacattttatatttaaatatttgtcaagtatgtgcctttatgtaatttaactttctatgaagtaagacataattttacttgtaaagtggctcaggtttcattttaataaaatccaggaagatctaggaaacatattatagttcaataattctacctgtgagttaaagatgaaaagaagttggcctttttcatatttcaaatttctctggtacaaaggctgaaaaaatacttgaaatgacatttctattcaccctttgtgcttctggtagaaggaaaagaaaggatgccaactgtagtggcagtctctattagaaagaacaagggtaataccatgaaggtacttttcataggccactaaccacccacttttgttcatgatcaactgagactacatttaaactagtgacctaaaagttgaaaagctcccgtcaaattactcttcaaaagtcttctaataacaagatgcattggaggtaccctggctgcctccatcctcatccttttcacactctagcactacctacagctgacgcactgctcaatttggaagacagaatttgaggggaaatatagttttgaagatagcagcaaattggcttcaaactaatctgttttgatggagatcaaagtcgtttcttttcaggcaacaattcttgtttcccctcctcccacttccccttttaagaacgggccttttatggtatccaaaagttgtttgagaagcagtgattttcctcagtgcatgaatgcagttttgcctgacggctgtattgatggcattcacttgaggaaaatagggctctgctttctcaaacctgttatgctaataagggtcagttataggtagatttttttcctccagcgttctcaccggccagtgaaacttgtcacagtcaaatgctggagccagaccgcgccgaaatcgtgagagccagtcatgtgcatctcttcctgactctgtgcagctatgtcatgttaccagctaaacattgctatggtgggcatatttatgccacagaaatcatcaaatacaacaaatcagtgcctttcacttcaaagtttttttgttaagcattcatcagcacaccacccaatatagagctaatttcctcgagtatttacatcaacagagtatgttcactcaagcagcttcctccctctttgtctgtctgaattttttatctatttttatcatactaaagatgaggcaagggtactaaataaaactatgttttatactcaaatattcaagtatttcttttcttcacaaaagcgttgtttccttccaaattaccctttcatgtaactcacattccatttggcccaccccaccaccatttgcatatttctccttttttaaacacaaaatttccatgtatcatctctgccgtctcatcccataaaatagtaacacagttgacccttgcacaacccaagtttgaaatgcacagatccatttatatgcagattttttgagagatataatataaatcctgcctatttggagagccaaccttttgtatacaaagggttccataagacccactgtgggacttcagtatgtgtggattttttatatactcagaagtctggaaccagtcccctgtttaccgccagggagctataattaacacttagtgtggcacttaatatgcggtcaggcacatcttatttactttaaattctttacttatggtatcattaaggatagttagctcatattatggacacatacacaaactcaaaatctcagtgatttaaaacaaataatatatatttcttactcacactatatgtccatcatggatcatctccagttctgcttttcatcgtttctacttcccttcagaatagtggagcagcttctatctagggaaatgtttttctaataacaaacaaacaaaagtataaatttaaaaaatgggttagttcaatagagtttgataaatcagtgttcaacaagttatcttaattcaaattattactttttactataatatgtattgatcgtttatttgagtttatttctaattttttacttacaaaccgagatatgttactgaatgtcagctgcgttaactttcttttaagaggctatatttctttgacatatgtataacgcatcatttcacttggtcattaacctgaccctaacaaacaggtcgatcttattatcattattatcgggaaaatgaaaagaatgagactcagaaatggaaaggtttatgagccacattagtttttctccctttgattaataaatcagtgctctatccattacatcacattcttttagattaggctgtagagaactattatattttattttatctgtttttggagggatgggaatgttttgtattacattagttctgtattttccaaaggttaattttgtgatgttatattggggtaaatgtactaatgtttaaaatatatacaatttattttaaggctcttatgaagaaacactttagagaaatatgaattgactattttcctcacttggagattatagaatagaatacagataagaacctgaataaagcacaattgagcaaaagttattcatttctcagattttatctcaaaaagttcctgattctgagtacaatactccaaaaaatccaagtaagagaggtctcaaatagtactagataacattattttataaataggtgaggttgaaattgttgctagtccagtgttattacaaaaaaagtctggcaaggattgagagaagaaaatcccaaagaaattcacacaaaacagggaagatcaccattcaatactctaatcaaatagctgcttagatttgagtcagtacaactaaaacaagggagagaacattggagagaaatgtggtggtggagtgggcagttggcaagaaagcatcaactgtccccttgaagatcttgcccagtattgtaggtgagatcagtcctgcctggatccgtaaatctcagagtttgtgcttctaattataaataaaataaaggatactgaagcatgtgaagaagagaggtatgcatatcaagatgtaacacagactaccacctggacattagctaaaagatacgttagaattccatacagtgccactagatcacaggattgttgcttgatattgagcctcttaatggtggaatttattgggggtccttcctctagcacagtaatcctagaacaacctcaatacagataattcatctaacgaatacatttttctttcttcatcctctctatcccagcaccagagggaaaataaaaggaaaaaagacaagaacatgtgtgagattatcacatccacccaccctgttcccagtccttagaaataaaattagttttaaaataatgaagaaaataatttaaaaataatgagtaaggcatcatattaattaaaatgagacagttttgcaaaataacaattatagacataaattgagacatcattgatgaagccagctacacagcagaaatgaagatgatcaatataaaagcctgaaaagatcttgggaagaataaaactgtttcattttattcttaaggagctgatattccttattcaaactgagtataatataatgcaggcttggacttttgtatttacagcaaaagcaagaaaaaggaaaagatttggaaactttatgaaggtactataagagttaacaattaaaaattaaacaaaatactcagctggcccttcctcactccatttctagactcttaattggatattttcctacattatatgttgagcaaaggtataaagtatattattctcaaggccttgatatttgttccaacatggcttatttacgataaaattcttagttcctttaacacttctacaaatagtcaaaatatgcagttatcagcagtgagtgtgtgcctgattgaaaagaacaatcacttacgaactagtgttgaatcaaatgatccattcacctactgctggcgaggtcatcccaagagaaattcaaccacaatttgccaaatggataacaaatgtatacatggggaatggaataaaagtatgaccctttttgcaatggaataaaagtatgaccccctttgcacttaatgtgttcctttaggagtgaaggattgggatttaggagaagataaaagctggcaattttcctttgacttaaaatgtttttcttactgttctctcttttttttgtttttggctgctactttcttatttatgttaacctgtggacttacatctgaaaatgagtggtagtgaaaacaataatttacttgaaatatgtccgtattgcttttaaaataacaaagaacatttacagtgaagcacagattgaccaaatacagttcctgggttaaatggcctatgttttgagagacaagtaagatagaatattttttgtattttaaaaggtttgtaagaaacatataaacaaacaaaaatatggaaccaaaaacaaaaattaaagaataatatgcagagtctatatgtgaaccacaaaacctacaatttttacatttgaccttttactttttttgtgaaaggtcagatgtactgacctttgaatgattgataatcattcaaaaataaacaaagtgtccattatatttatgttaagtataaagccaactttaaaatagaaaatatatttttaaaagtgtttatacccctataatgtagcattagtttattatattaaattaattaagggatcatacatttaaccatgtcaaagatgtatctcacattagctagctaaaaatacaagcaggattacttgtcaagaatatattcaataaatatttattaaaataatggggactatcttatctttcgtatttaaggtacataaggaggcaggataagtggttggttaataggagggaggttgattgtcttcagtgtagggaagaggagattaaatgagatagcaggtaaattgcaaagagtttgaaatgtagaaaaaagtgtttgagaggctgaggggttggattaccttaggtcaggagtttcagacccatctggccaatatggtgaatccctgtctctactaaaaatacaaaaattacctgggtgtgttggtgcatgcttgtaatcccagatacttgggaggcaaaggcaggagaatcagttgcacctgggaggcggagcttgcagtgagctgagatcatgccactgcacaccagcctgggccacagagcgagattcggtctcaaaaaaaaaaaaaaaatggtaattctttttattccaattttctaaaaggaatctgttttcctgttaactcataaactcataaaagattttagggtgaacaagaaggtactgggcatttgaaataatgaataaaaaaatgaaatgtaaaagaggagaatggatacattccaagaaattccactttattattttactagctattctattgagaaaaaagggtcaattgcaatttaaagaacaaactgacactttggatgctgaagatatagatggctaagagatcaatattaataataatagcatcaatacctaattttaattgatgctatcataagccaggaactacactaagcacttgaaaacttctccatttttaatactcccaacaaagcagaagtaacttttcctatgtcaaagagaatcctgttgcagatgtgggattagaatgcaagctgttctaccctacactctctgtactattattctatgctgtcttctctaaggaatgaaatttccttattcccttcagctttgcttagacttgcccacaatcccttcaatagcaaagtacatctacctataaggtgaatcattgtttctctttcaaacatctacttgataagccttgatttaattttttgtggttgcttcatgattcttaacaaaagtaaaataaaattattatacagaaagtgtccactgacacccagaacatacaaattttgctactgctttaaaacttctggttccacctcccagtgaggtgactcgctctgatgctttgattctctttccttttcctggctttttcttgttggaaactgcaataacaggtataacagctcagagacaaatagcaggagaaaatagaaaatgacgagaaacagaccaagaagttgaatgttgacacctccagttacctgaagggaaaaaaaaaaccacacatttgactaatgaacgaattgggtgtaagtctaaaaaggtgttttgtcagcttgcagcatgtgttttcttttaatctttatccattcttctcatttttgaatagtttcaagaagccatggaatttaatgtctgggcctcaaggaattattatttttagccctgaggaaaaatttctgctgccttgatctcactacagaattgatcttgttccaaaacagtttgaattaaatgcaagctgtcttacagcatgaccctctgaattaacaggtcctgtcagaggtattgatttgtttttctgatatctttgaaaggttctagaaatttcagggtttttacttctctttcccttttttgatgaatatttcttgtaaaataggatgcatttttgctctgaagatgatacaggagtttatgattcatgaatgtttcacagctggttcaggtacagtgtgcgtgaatcataggcactgcatcgtaaaatttataatgtcacgtgtattacaaggattactttggatatttgcaatttgctcttttgcaatcaaagatgcttttatttttttcagattcattatgtttatttcatggcaatgccctttttcatcttgttcatctggcaaattcctacatatcttttattattgtagttgtaataaaaatatggaacacgatacttaccattataaccatctttggcattaagtacattcacatttttgtgcaacatcatcaccgtctgtttccagaactttctcatcctcccaaactgaaactccgtactcagtaaacactaactccccaaacaccagcccacagctcctggcacccaccatgtaactttctgtctctattaatttgactgttatagctaccttatataagtggaatcatatagcatgtgtccttttgtgtctgacttatttcatttagcaaaatgtattgtttgtttttcttttaattttgccattctttatttttccgtttttatttagattcaaagggtacatgtacacgtttattatatgggtatgtcacatgatgctgatgtttggggtacaattaatcctgtcaccaaggtagttagcacagcacccaacagttggtttttccagccttgctacgctccctctcagccagccccctctagtactccccagtgtcttttgttcccaagtttatgtctacatgtatgcaccatttagttctcacttataagtgagaatatgtaatatttgttgttctatttctgtgttaattcaattaggatgatggcctccagctgtatccaggttgctaagaaggacacaatttccttttttagggctatgtagtattccgtagtgtatatgtgccacattttctttatatgctccaccaccgatgggcacctaggttgattccatgtccttgctatcatgaagagtactgctgtgagcatacaagtgcctgtgtcttttcagtcaatttattttcttttgggtggcattgctgggtcagatggtagttctatttttagttctttgagaaatctccaaactgatttccactgtggctgaactaatctacattcccaccaagagtatataagtattctattttctctgcagcctcccatcatctgttgttgttttacttttaaataatagccaccctgactggtgtgagtaggtatctcatagtggttttgacttgcatttctctgatgattagtgatattaagcatttttttcatatatttcttggctacttgtatccctttctgttgagaagtgcctattaatgtcttttactcattttttgatggaattttttgtttttgcttgtttaattctttaagctacttgtagattgtgaatataagacatttgttggatgcgtattttgggaatattctctcctgttctgtaggttatctgttcactctgtcgatggtttcttttgctgtgcagaagctctttagtttaattaggtccaacttatcaatgatcatttttgttgcaattgctttcgaggacttaatcataaatcctttgccaaaggtgatgtccagaatagtgtttcctaggttttcttctaggattcttatagttttagttcttacattaaaatatttaagccatcttgagttaatttttgtatgtagtaaaaggtaggtatccagtttcattcttctgcatatagctcaccagctatccaagctccatttattgaatagggagtcctttccacagtgcttatttttgtcaagggttcccttttttttttttttagcagtgttttgtagttcttcctgcagagatcttttacctccttggttagatttatgcctaggtattttacttcttttgtggctgttgtaaattgaattgtgttcttgatttggctcttagttattggtgtatagaactcctacagatttttgttcattgattgtatcctagtaccttgctaaaattgttgatcagttctaataacttattgagagagtctttagggttttctaggtataaaatcatatcaccagtgaaggcagatagtctgatttttttttcttttttttttgctatttggatgcttttgtttcttcctcttgcctccagcaaatatatgaaaaaaaaagtttaacatctggctagcacttccagtgttgtcctgaataggagtggtgagacaagatctctctgtcttgatccacttccaagaggaatgcttgcagttctgatcattcaatatgatgctggctatgggtttgttgtagatagcttttattattttgagatatgtacctctgatgcctagtttcttgagggattttaccatgaagggatgttgaattatgttgaaagctttttccgcgtctctcgaggtgatcatatggttttagtttaaattgtgttcatgtgatcggatcacatttactgatttgtatatgttgaaatatgatgaaacaaccttgaatctcaggaattaaccctacctgatcatcgtaaattaaatatttgatgtgttgttgaatttgacgtgtaagtattttgttgagaatttttgtgtctgtgttcttcagaggcatgggccagtagtttcattgtgtgtgtgtgtgtgtctgtctctgtgtgtgtgtgtgtgtgtgtgtgtgtgtgtatgtgtctttgcccggtttagatattaggtgatgctggcttcatagaatcagttaggaatcacccctccttgattttttggaatagttttaatagaattactatcagctcttctttggacctctggtagaactcagctgttaatctatctggactggggcttattattactgttttttggttgttaggtttcttattactgattcactttttgaactcaatattggtttcatcagtgtttcaatttcttcccgattcaatcttgagaggttgtgtgtttccaggaatttttccatttcctctagattttctagtatgtgtgcatagaaatgttcatagttgtctatgagggagttttgtatttctgtgtgatcggctgtgacattacaccacttttgtcatttctgattgtgcctacttgaatttttcttttcttctctttattaatctaactaacagtctattgatcttgtttatcctgtcaaagaaccaactatgaaactatggtttcatttatcctttgtgtggaattttgggtctcaatttcatttggttcaactctaattagagttgtcttattttccttctagctttgggattagtttgttcttgtttatctacttcctctagtataatgttagatcattaatttgagatctttctaactttttgaggtaggcatttatcactataaatgttcttcttaacactgattttgcaacatcccagagattttttatgttgtgtttctgttttgatttatttcaaataattttttatgtttctggcttgatattgttgtttacttaaaagtcactcaggagcaagctgtttaatttccatgtaatcatggggttttgagaaatattattggtattgctttctattttcattccactggggtccaagaatatgggtgctgtgatttcttttttttttttcatttgctgagacttgctttatgactcagcgtgtggtaaatcttggagtatattccctgtgcagttgagaagaatgtatattctgtggtgcatgggtggagtattctgtagatgcatattggatccagttgctcaagtgttgagtttaagtccagaatttctttgttagttttctgccttgacaatctgtttaatgctgtcagtggggtcttgatctccctcactgttattgtgtggctaagtctttgtataggtctagagtactggttttgtgaatctagactctacaatgtggggtgtgtttatgttctagatagttaaatcttctttttgaattgaaccctttatcattatgtagttcctttctttctttcttcttttttgtttttagtgttgttagtttaatctctgttttatctgatatgagaatagtaatccctgttcttttccttttctgtttgcatagtagatcttactccatctctttactttgagcatcattactttacttcatgtatcattacatataaggtgggtctcttggagacagcagccatatggatcttggttttgttttgtttttaatccaacttgccactctgtgccttttaagggtggcatttaggccatttatgtaccaggttaatattgatatgtgaaattttgattctatcattaagttgttagctggtaactttgtagtttctattttgttgttgctttatagggtctgtgggctatgtacttaagtatgtttttgtggtagcagatatggttcttggttcccatgtttagaactactttaggatttctttgaaggctttctagtggtaacaaatattcttagtacgtgcttgtcaggaaaatattttacttctcatttgcttaagatgcttaatttgatggaatatgaaattcttggttggaatttgctttctttaagcatgctgaaaatagatccccaggctcccctggcttgtaagtcttctgatcagaagtctgcttcagcctgatggggttacctttgtaggtgatctttcctttttctctatctgcctttaagtaggagttgaacaatgataacacatggacacagggaggggaacatcacacaccagggcctgtcagggagtggggagctaggggagggataacattaggagatatacctaatgtagatcgcgggtggatgagtgcagcaaaccaccatggcacatgtatacctatgtaacaaacctgcatgttctgcacatgtatcccagaacttaaagtataataataataatttaaaaaaacaatgaaattcgctattttgagcttactgctaaaaaaaaaaattttcttaagtattgatgttggacagtcacgtggctgtatgccctagtgaagtcattttatatagtatctcacagatgttctcttgatttcttgtttctggatgtctacctttctggcaagatcagggaaattttcttgaatttttccctcaaatgtaatttccaggttgttttctttttctctttctctctcagaaatgccaataattaataggtttgattgttttacataatcctttatttcttgaagacattgtacattttaaaaaattcttttttctttatttttgtctgactgggttacttcagaaggcttatcttcaagctcttaaattcttttatctgatagatccagtctattaataaagcttttgatatattttaacatttttcaagagtttttttgattccagaagctgtaattgattactttttaagacgtttatctttttctttaattcctgaattgctttagaatttttttgtgtgttaattttcaagtttgttttggatcttattgaatttttttgcaatccatgttttatattatttatctgtcatttctgagtttccattttggttagggaccattgcttaaaatctagtggaatcctttggtggtatcactacattcagattttcatgatgccagaattcttgcactgatgttttcttatctggagacactaggatttttaatttctgtaactttttcatgcaggtgggatattttctttgttctttctttctttttatcaactggacaccatcgtgggagctgtttgctggtgttttcctctccaggatctggggtattcttcataattccattggattcccgtttttcttcttaaagttcacagagttcatttttatgatttattttgctattttcaagtggctgaggcgcaccaaagtctctaattcatcattttgacaaaaaaaaataaaaataaaactttcctaggttttcttctaggaattatagttttagtttttagtttaagtatttaatgtatcttgggttaatttattttttttaatatttatttatttatttatttttgacacagagtctcactctgttgcccaggctagagtgcagtggcacaatctcgactcactgccagttctgcctcctgggttcatgccattctcctgactcagcctcccaagtagctggaactacaggcacctgccaccacgcctggctaattttttgtatttttagtagagacggggtttcactgtgttagccaggacggtctccatctcctgacctcgtgatccgccctccttggcctctcaaagtgctgggattacaggcgtgagccaccacacccagccgggttacttttttttatatgatgaaaactaggaatccagtttcattcttctatgtatggctagccagctgatttaatagggagtttttcctcattgcctatttttgtgtactttgtcaatgatcagatggctgcagatgtgtggctttatttatgtgttctccaatatattccattagtatatgggtttgtttttctaccagtagcatgttgttttggttactgtagacttgtagtataatttgaatgcaggtagtgtgatggcttcagctttgttctttggcttaagattgctttgactatttgggctctttttcactgccacttaagtttggaatagtattttctagttctatgaataatgacattggtagctttatagtaatagcctgggggcccagctgtcagttcggcagatcagaatgagaatttagggtgctgcttttgggcctgcccctggctgcccatggaccaatcagcatgtacttcctcccctatgaggcccattaaaacccccagactcagccagactccagcaaatgacataacaacttgcctgcagataggagctacccaccctgggtctcctctccacgagggcttcacagacaatgagatgaccttcctgcagaagggagccacccactgtggatctcctctccactgacaagctggacctgggactacctgcctgaggaaaggagctacacactttgggtctcctgagaactgttctgccactcagtgaaactcctctctgccttgctcaccctccatttgtctatgtacctcattcttcctagatgtaggaaaaaaactcaggacctgctggttgggcaggactaaaagaagagctgtaacacaaacaggacggaaacaggcaccccatccccgacaccacaatgcagacaacaggaaggagagaagagctgtggccctttatggaacccagatctaagggctccccaaaccagggctgtgacaccctccttggggttctgcagttcctggcatctccaagcttccacaagccaccatattcccctcatccagatgcaggtgcctgcatctggtccaaccacaggcttacatggaccttcctcctatactggcacctggagctgcctgccctcttgtagcagccagtgtgcctggctgtgctcagtgactggaccccacattcactcaccttcacacccctttgccactctgcttttggctcacacttggcagatgtgggatctgggccagtagcacaaaccgagcacagcttgtcaggctgcataggtggaacaagcccagcagtcacaggcaatcctcaggtagaaggtgccattggccgcagaagtttccagctggcgaagcaacaccaaagctcctgtgatacttgtacttcagtaattaaaaataagcactcctcatttctgtataaaccatttctttcacttgcatgctagatcagtgcttcttaaagtttctgttataaagggtgcatttaaatgaattactagaaaaatgaaatacaaaagatgtaaaatgaaagccattttaactgttagattcaacatatataaaattactgtcaaatcactttaaaattttctaaacacaactcagtatttaatgtctcatcatgatccataatcactttgcagaatgacactggttattggacctcactagcacttaggactggaaatgtaattggcaaggcccaatgcaaatctaaaacacacaccttctaattgtgggctctttactctgactctgatctgattgaattctactgattccatgtatgtctactctgaaggatgttgcttcataatttccctatgtgcttcttacatcataagcatccattgctctacctgatcatttccatcagcatgcaatactgccattatatcttgcaattgaacacaaagcaacaacaacaaaatttctcttggtcccgtaaaccttctagcaatttatccatttctgtgcttcccttcactgtggaaacttctcaaatatattgtttatactggcctgaagaaagttgtggttattctcctttccaggattatctgttgactccattgtaaccaggatttcagtcacattaatccactcaaatggctttttttttttttttttgcattttcagtgcccattccattgacaacttaatttctcatcttactcaacccatcctcatgatgtgacagaattgatagtttcttctttatttaaaaatttaattagttgacctacagtgtaccccaatctcctgggactttttccatactcccaggctgctctatttttgttttctttgatacttcttccccttaacttccctgacttttaaaaattgaaacacccttctttcaactttaacctcttcttttcctatttccattcactccaaagattatttcaacagatctaatgagtttaagtggtatatgctcataacttctaattcaaatgtctagtttagctctctgtctcaaaactatagatccatgtcaatctgtaacaacagtatttccctttggttactaaagaaacatcttttgtaggttgggttttctgggaagcagactttgaaattaagattcaattacaggatctttattagggagtgtttggggtatcaactcctattgaagggaggggaagaaagcagtattgtatgtatggagaagttaaacttcagtgcagtccaagtaaagctttcagctgcctacagggaaaattatggatgtgatatggtccttcagggttgtaaggctgtgacaaggagataggctgtttatatgtctgcatcaatattcattagacgcaggttgcctcagaaagctgcttgaccttgggctttcctcagatgaggcattctctgaataggactgatagctgaagcctttcagtgtgcaacatttctaatgtataagggaataatcccgtcattccttgaaggaggatgtgtgaagcatatcatggtgttttttatcagagcatctcaaaattagtatttcccatgctcaatgcttgacacttactttccattatcttaatgaaaacaggtggtccttctgcattttccctacccagtaaatggcaactttatccttccaaattcttgggccaaaaccctttaagtgaaccctgacctttctctttatccacaggcccccttgtcaccaatgaatcaataaatttggttggtccaaagatatttacatgattctacaatttctcaccattcccactgctttcaccctaatcctagccaccatcacctacctcctacttagattattgcaatagcttccctactggactgctccagcccaccgccctgcccttttgtggtcagttgcaggcaacagaataatactttttaaaaaaattacctaaaatgacttcacatttttgttaaattcctgacatggcttctcagattacctaagataaaaacaaatgttgtactgatagctacctgacctcatctcctacttctcatcctttcactgattccactctagccttactgacctcctggaacactgagtgattcctacctctggaaccgttcacttgctatttccactacctgaaaggctccttgttcagatattctcatgacttagtttttcccttcctgcagactttgcttacatttccttggagtgaagtggtcttacctacccaccttataaaaaataataatattccaacatgctgtgctttctgttaactttatcctctttgctgtaatcctatatgcacttgtgcttattttgtgttatattgtcatgccaagtattatattaggtccataatcaccgagagtttgttttatttgctattatatccctagtaactacaacagtgcctggaatatactatgtaatcaataaaaaattgttgactatcatgtggatctgattttaagaaaggctgcaactgaggtttcaaatggtgccttggtgtgttgctttctactgtcttcttattggttagctctgtgtagacttcattttcaagcagcctctgtaatgaagacagttatgataaccatcttgttttttactaactctgtaatgaggacttagtgttatgtagccttgagatgacatctaggaaatggcggattcagggttttctaaaataaaaagaaacccaagtgatgaagtataataaatacactatagaaattcaaaaaataaaaaaatatttaaaaagcagacagaatattgatatggtttggttttgtgtccccacccaaatctcaccttgaattgtaataatccccacgtgttgtgggagggaccaggtggcaggtaatggaatcatgtgggcgagattttcctatgccattctcatgatagtgaataaatctcacaagatctgatggttttataaagggaaattcccctgcacatgctctctctcttgcctgccactgtgtaagacatgcctttctcctcctctgccttccaccatgattgtgaggcctccatagccatgtggaggcctttttttctttataaattacacagtttggggtctttaatagcagtgtgaaaaaaactaatacaaatataattaatagtaaaggaatacattttaagaagatatgttttagacttttctccagagaattgttgctgtcccaacagttgtctttacaaataatgattgctattctttctaaattaagatgtgcgtgtgtgtgtgtgtgtgtgtctgtgttgggagaaggaccggtagagaagtgcagaacacagtataaagaacaagatttatttaaaagactgttatggggactctgggactctccctttgagaaagtgtgcatatgaggacacggtacaaattaacaaactcaagccacatttcttcacactacagatattgcccagagcacattcacactgttctaagatggagagactgctgtagtgaggccactgagtgtacatgttttgctgcctcagagaatgatgtagagttggaaagtgaggagagtcaagatgaatgcttaaacgtgctgaattagttattgtttatctggagtaaacaaaacatcttcggtaatatagtatctgcctctgtactacaaatataataaaatatatcccctcaactataaatttgttttatatgtacactattatacaaatgcctattgttattgttatacatatttgaatttgaatttggagaaatgcctacacatgtccagttcctaggaccaaacttcccggaaattctctttttccctggcaattgtcagctcctaaaactgctttaggcaccacaaaatatgctaatatcagatgtaatctctgtgatatcaggatttagagtgctagaaaggttttgcagtttatttcattccccagtaagcttaaatcattttcagatttgaaataccaaacttttctcaagagactgaaaacttcagtctacgtaactaatcagcaatagtgctctcctttgaagtttcaaacatccatgagacttcttgaactgtaatgaactgttaccccaggtttcatatccccaagattattgtgagtttagattagctttaaatatattattatttaaaattgtgtggattttcactctgaatttttttcttatatgtaaaaatgtgtgacctctattgggaacattttgagagacatgggaaatgatgcattagaaattaaatagtatttatgtctccacctgcctgaaaaccaaatcctcagagcaggggaggactgtagaaatcagtgaatgtgttttgagatgagtaacaagtggttggttacaataactctgacttcaggaagcatatgtctcagcttttatgagatagtctcaatttcaaaaactatgtgttgttttaattggactctatgacagataatgcattttgagattgataaaagcaatggatctctgtcagatacaattttgcccccaccccccacctggagacaactggcaatatctgcagacatttttgtttatcatgactggggactagatcatactgacaactaagggatagaggtcagagatgctactgaacaccctaaatgcacaggaaatcccctctccaacaaagaattttccagttcaaaaatgtcattggtaccaaactgaggaaccccgacttagaggaatatggtcgccagaggaatgaggtagaatagaagatctttattttatttatttatttatttattttgagacagagtctcactctgtcactcagtggagtgcagtagccatgatctcgactcactgcaacctccacctcctgggttcaagtgattctcctgcttcagcctcccgagtagctgggattacaggcgcccaccaccacgctaagctaagttttgtttttttttttttttgtatttttggtagagatggggtttcactatgttgggcaggatggtcttgaactcctgacctcaagtgatctacctgccttggcctcccaaactgctgggactacaggcgtgagccaccacgcctggccaagatctttatctttaatagaattttataggcaatcactagggaattatatgtcataataaaggtgtattttggagttctggggaagagacacttcaaatagacctttattccctattatctgctgtgcttttagatttctatcatgtctcttttaaagccaagaaacactctttccagtttcctaagtgataatcaactgatactgcatgttctctgttagtctatctttatggaaatggtagagacctacttttattcattccttcttataaatgacctatcagcaaaagtttatgactatagtagaaagtgaaaacttccatttgcttcaggccaaaagcccattgtatgacccaaagaaaagcttacaatttctaaacctgtttgaattggagaatttttgttgtttcttggttattttttttttcctttctaattgaacagagttaaactattctgtttttctaaagttaaatgaaaaaagactaatttgaattctgggtttgaatgtagactatttgcttgggcaactatttaatagcttctggtattttaatagcagtaatcactattacctttagtaacttggcaataaatgattctcactgtgttgttttgtaaataaacctcagagtttattgcatgtcttgaagctatttattgcttcacatgctgtcagctattgttgattaaagtgtaagtatataaaggctgtaatttttctgagattttgataaatagaaaggaacaaaaaccatgttagtgaagtatactcaataaactgctaataagtatcagttgtctagtgagaacaatgggagactcaactgatcctgcaaagtccctatggtgtttctatacttaactaccaagaattagttgatttggagctaagaaaacaatgtattttaaattgaaaagtaaagaatatttacattggaagagttattaagaaaactgaaaaattcaattatatgtctcgtggtttcaaatacttttttaaaaaccatagattcattaaatccaaaaccagtttttaaaagaaaataagggaaaaaatgtcatcttcgtctctgattttcccagtcatacacttgtctcacccacacataagaacaaagctttttttaaagaaagctccaggttaaaaaacataaatttcagacacaaagacacaattatctagcaatagaagtggactgagccattccttacctccctcctccaaaataaaggtagttcattcggattttgataaataaatggttagaaagcacagcaaaacttgattgctgctacagttgtcctaatttaaccactgtgtgctgagtgatttggaatcagaagctgtcttcatgagtaaagatgaaaaattcacagtgtaatgccccaaatagcaggctaaaaagacctgtttatacttatttttcctttgtttacttatatatatacctatgagttcacactaaaacttcaattccaatctgatcccataccatttactctagttttttttttttttttaatctttccacacttttgtctctattctctgataggaaacctgcttcttaccttcattgtatttatgtactaagtaaatgtcactgggttaaaccaatctcctgcctatgaccccatacaaatggtctcctcactccactcatgctttgacaccacacgcctggctgccactggcgcagcacagatgcagccctcaccccaccgacaaccacgcagacaaacttattaccaagttcaaagtccaacacttcacactacatgccacaaataccataccccaaactattgccttcttcattccacttgtacttgtatttttaaattttctttcatttttaatttttgtgggtacatatattttggggtgatattgagatattttgatacaggaatgcagtgcataatagtcacatcaggataatggggtatccatcacctcaagcatctatcctttatgttacaaaaaaactgattatactatttttgttatttaacacatacaattaaattgctttttactgtagtcactttgttgtcctaacaaatactaagtcttattcattctttttaactatgttttgtacccattaactatccccacttcccccataaacctgcattacgcttccctgcctttgggaaccatccctctactctctatcttcatgaattcaatagttttatttttcagctcacatgaataaatgagatcatgcaaagtttgtctttctgtgcctggcttatttcccttaattttcttatttcccttaatttgatgatgtccagatcaatcatgtttttgaaaatgacagaatgtcactttttatggctgaataatgctccattgtggatgcatacacaatttaccatgacagattcagagtttgatgcctttgattttcttttatatactgggagataagtgtctagttttattcttcagtgtatggatatccagttttcccaggaccatttattgagcttattttgcttccaaatattggccattgtgaatagtgctgcaataaacacggagtgcagatagctctgccatattttgattttcatccttctgtgtttatacctagaagtgagatttctggatcatatgatgcttctatttatagttttgtgaggaatttcaaatactgttgccaatagtagttgtactgatttacatttatacgaacagcatgcaagagttttctcaagcagaaggagtctctcccatagccaccacagctggactgagtctcatctgaagccagcaagtctcataaatctcaccacagtgtactacctgggtatcactgctggttattcagggaccaaggttttttgtttatttgtttgtttgtttgtttgttgcgtcagttgatgggtcctaccaggactgggttcttctcttcaaggcagaggtttctatttttgcccaggatgtgtctagaaatgtcagccatgaggtagaacctgaaatgggagcctcatgactgactagtgtcctatcctactgtggcttacctggtattcaagatgtaagacaatgttccctttacaattccctcttctctcctcagcagaagtaaagagtatccccctgacctgtgagttgtgctgcctggggttgagggaggggttgcacaagcactcccttagctgctccagccattgtcaccgtaggtcacatgccatcctagtccagtgggtctaagcccagctcagcactagtacttgcataggagttgcagtctttgtggcctagactgcatttcaagtttacctagaaccccagagccctttagcctgtggtgggaaggctggctggaacttaagtttcaactgctggtttgggttattctcctctggataggattggtttatatactccttctgtgagccggcatcagctgaattcattctggttttgctttctgctgtgacagaacagtgctgagttcaatgcaaagcctcacaattgctgcactctccctctctcaagtgcacagatcctctcttcttgccatgtgtcttctgccaggggatgggggaggggtggcatcagcaattcaagactttctttcctatcctcatcagtgactctttcagtgatatgtatttacagccaggtactgtgagtgctcacctgacattttcttgttatgaaagttgtttgtttcaggggatgattactgggggaccatcttgctccactctctccactcttgctttgacatcccactgtagactgctgtcctactgacacccttcccatgcagacaccatgattaccctcattattccctaactcaacacatatgagagtctacacaaatgcccttgtaaccatctttgggctttgaaatcacaccaaatcatcattcccattctgacccagtcctaaacattctgcttacctgctttgggttctgacctcccattccagacatcttgaatgacctccttttcctctcttgggtttgatgaccccatgccaggctgctgtggcaacccttttccaaggttttgacaccgtttactttctgaaaccccacccaggctctgattctttacattgatcacttccacaacaccccacccagcccagatagcctgatatcactcagtctaggacaccccaaattacactgctgctgtcccccacttcatgggcatgccctactcaccctcattagactcttaacaattcttgctggcccttcactgccagtccatttggctccccaaaacatttcatcttccaaacatggccacatttgcctcccaccctctcagatgcctttctcatttgactaaggctctaatacttcctgctgtgcacgttgctgccacaaatactactgcatgttcctccccctctggggttctgattctctctaccagaccacagcccatacccgcaataggagcaaacggttatcatactaagcgttgtaatggtttatgaaattacttattcaagaagaaaatcaggaaggaagaagtcaggaagcatacatatatttatgacactaaagagatgcaaacattcaaagtctctacagcagattttcaagccatactttggatcacaaaatcaatttttggtgttaatattatctcttgttaatgaaatcaagtagtatataagagaacagaacataacaaaatagaaaattctatcaatgctattgattctattaataaaatattaatacgtgaaaattaataccatgtataaacatttggttactggttctaggagatagacagctgagatagatgagaaagaaggaagaaggaaggaagataggcaaggtatccaagttcatagagtcaaatatatcttcatatcaccagattcaatatttcttgaataaactgatctcttgacctggattatatgtgtatttgacaaaataatcttccaatgttttaactgtttattttttacacttaagccttcaagctatataacatgtatttttgtgtatataatgaaatttgaaatcaatttcaatttcttctgtctgaataaacaccaaacagcatcatatatgaaggactttgctttttcctaactagttgtactgtcaactctcttttttgtgtgtgaaattttcttatgtgtgtggatccacacttcatattgtacgaacctaattgtctaatcctataccacttgaagcaagtctgttttttatgctcgttatacttttgtggcttcagtaacaggaggaatgctttccatatccattctatttagctgtttcttgattttgggctttataaagaccagactcactcctataggatccacctatgttaacatttcccttaggaagatacctgtgtgttaagacatcccatgacctgacactttctgtgtttctctctggtccctgtctgtaagccacaagaagctcattagctccaggaaaacaaatagattgctactgagtgtggacagcaaggaagctgtgctaactccatcatctctgtggaataattcttgcttgttattagcagctatattaagatataattcatttaccctaaaatctaccaatttaaagtacacaatttaatgtttttagtatatattcacgtagttgttcaaccatcaccacagtcaattttagaatatttgtatcacaccataaaaaaagcctatactcctcatttactccagagtcaccagtcctaggcaactaccagtctgctttctgtgtctttaaatttgtctattctgacatgttgtttagatgtaatcatgcaatgtgtgatctattgtatctggttacttttgcttagtttaacgttttaatgcccatggtctagcatatattgatatttcattattttttatttctcaataatgtgcaattgtctgcatatactacactttatacattcatcagctgacggtcatggggattgtctctaatttttgactattatgaataatactgctattaatatttacatatatttttgtgtgtgaacataagttttcatttctcttgagcagaaacctaagaatggaattgctgtgttatatgatactgtgatggttaatactgagtgtcaacttaattggattgaaagatgcaaagtattgatcctgggtgtgtctgtgagggtgtttccaaaggtgattaacatttgagttagtgggctaggaaaggcagacccacccttaatctgggtgggcaccatctaatcagaaaataaagcaggcagaaaaatgtgaaaagactagactggcttagccttacagcctacatctttctcctgtgctggatgcttcctgcccttgaacattggactctaagttcttcagctttgggactcagactgaattccttgctcctcagcttgcagacagcctattgtgaaacctcatgattgtgtgagttaatactacttaataaactcctaaatatatcctattagttttgtgtatgtgtgtgtgtgtgtgtatatatatgtatgtgtgtgtgtatatatatatatatatatatatatatatatatatatatatctccatctatatgtctatatctatatctatatctcttgttagttctgtccctctagagaactctgactaatacagattttggtgccaggagtggttctagaggaactgaatattaaggatggagttctttcattggttttggggtttctggagttggctgtttaatatgattagatcaaaaaatgctaagtactttacttctaatagtatggtgaacaatgatagtccttgctctgaattatttagacagttatgcaaaataaatgcatttgacactcctgattcaccacttgtgagaggcaaagagtttagtgactctatacataatacctttgactatgaagttggttggttgctcctaagtttactggacaaagtgatgaaagaaaaggatgaactcagggattcttttttttttttttttttttttttgttgttgttgaggcagagtctcactctctcagccaggctggagtgcagtggcgcgatcttggctctctgcaagctccacctcctgggttcatgccgttctcctgcctcagcctcctgagtagctgggactacaggcgcccgccaccacgcccagctaattttttgtatttttagtagagacggggtttcactgtatcaaccaggatggtctcgatctcctgacctcgtaatctgcctgccttggcctcccaaagtgttgggattacaggcgtgagctaccgcgcccggctgaactcagggattctaactcctggcttcagaagcagatactgagcctcaaatctgctaagattttcccgagtgagagtcttagctcctgtagagaaagagctaaaattgtggaaaatcagacacaaactcttatcatgctagtggctgacctgcaacaacaggtgtaatcacagcctcgccaggtgtcccctgttaaagtgagggcattgattggaaaagaatgggaccctgcaacttggaatggggatgtgtgggaggaccctgataaggctggggacactgagcttgtaaactctgatgaaacttttttgtcagaagaaatggcttctccattcctagtcgtggaaacctcctctctctaatccatgctgccatcagcctttccacttttgtctgaggagagaaaccttgcactgcctgaagcaacagtgatggcctcccctaaggcagttgccaggaaaaataatgttgattctcctcaggagccagccccaacactcctgtttgcttctgaatctataactagactaaagtccttgtgggcccctagaggtaagttcagagtgtgacccatgaggaagtgtgctacacttgaaaagaactgctcgagtttattttgttttgttatgtttttttaatttatataagcagaaatctggagaacaggcatgggaatggatattatgggtatgggataatggtggaagaaacatagagttcaatcaggctgaatttattgatctgggcccaccaagtagggattctgcatttaatgttgcagcttcaggagttaaaaaaaggttataataatttatttgtctggttagctaaaatatggattaaaagagagccaactctgagcttgctggaaatgccggatctctcttggtttaatgcagagaaagggatctaaaggcttagggagtttgggatggtggagtggactagtcactttagacctactcatccctgctgggtgggtcctgaagatatacccttgaccagtgctttgcaaaagagatttatgagggcagcacctgcatctttgaagagccctataattgctcttctctgtatgtcagatcaaacagtgtgaaccacagtcactcaactacaaaatttaaatacaataggagtaattggatcccaaggtggcatgggccaagtggtggcgctcaaccatcaaaggcaaggtgggtgtagttaccataatggacagcagaggcaaagcagcatcagagtagtctgactcatgtaaggctctgacattggctaattaatcagggtgttcctagaagtgaaattaataggaagcctactgcattcctacttaatttaagcagaaaacttctatgtagaatggacaaaagactaatttgaattataaaaacagagaatcatgacccctcagtcaatttccagagttgagccagtttacagacccagaactccttgaatgaaggggaggccaggtccccttgaggaagaatcccattacactacccaccaatttatgctgttaatctttcttccatccttctccaaggaggcctcgggccttttaccaaggtcactgtgcactggggaaagggaaattatcagtcattttggggactgctggacactggctctgagctgacgttgattcttggggacccaaaactgtggtcctctagttaaagtaggggcttatagaggtcagataattaatggggtttcagctcggatctgtcttatagtggttatccagtgggtccttggactcatgctgtggtcatttccccagtgctggaatgaataattggcataggcatacttagaagctggcagaacccccacattggctccctgactggagggctcttatggtaggaaaggccaaatggaagccattagagcttcttctacctagaaaaatagtaaatcaaaaacagtatcacatccctggatggtttgcagagattaatgccactatgaaggacttgaaagctacaggggtggtaatcaccacatccctgttcaactctcctatttggcctgagcataaaacagatggatcttggagaatgacagtggactattgtaagcttaatgaagtggtgactccaattgcagcttccgtaccagatgtggtttcattgcttgagcaaattaacacatctcctggtacctgatatacagccattgacttggcaaatgcctttttctccattcctgtccataaggcccaccggaaacatcagacttctcagccactgcagcacattgctgggggtgataagaaattgtgtggcctgccttcatgggcagatagcctagtttcagactgaagctgtgaggaagaattcccatgttcttgactatgcctgcattatgctgtgctgaataggtttttggaaagggagaaagacaggctgttcttagtgaactcactaagaacagttttcacaattcttagtgagatttagtaggttttattgaataaatattttttccacttgccatatgtctttagaacagtatttagagactattttaaaactttatttatattactattatgattattaatattattttgagacaaggtctcactctgttgcccaggctggagtgtagtggtgtggtcatggctcactgcagcctccacctccagggctcaagttatcctcccacctcagcctcccaagtagctgagactacagttgcacaacaccacacacagctaattttcttatctttttttttcttggtatagatgagtttcaccatgttgcccacgctgtttttaaactcctatccacatataatcttctggtctcagtctcccaaaactctgggataacaggcatgagccactgcgcctagctgagactttaatttttaaggtttcttttttagcagttgtgattgttttactgggagatggtcagtgtagctcctcactttgtcattggagaagtgtctctgctgtatgctccaatcctgcttatttttactttttgatatatgtatcaactgaaaatatactaaggggttatgttagtgtttgatctattaatttgctcaaaataatacatgctaagtattagttgtgaattgtgtatttcactcatttgtcatttttttagctcaaagtgttgatggccaggtttataaacatttatttatgttcccctccccaccatccactgccaatatagttgaccaatgtattagtccattttcaagctgctgataaagacataccagagactgggcaatttacaaaagaaagaggttcaattggacttacagttcatgtagctggggaggcttcacaatcatggtggaaggtgaaaggcatgtctcacatggcggcagagaagtggagagaactggggcagggaaactaccatttttcaaaccatcagatttcatgagacttatttgctatcacaagaatagccatgggaatgacctgcccccaggattcaattgtctcctaccaggtctctcccacaacacgtgggaattaaagacgagatttgggtggggacacagacaagccatatcaaccaatatctacctatcttagacacattttcagaccttaactggagatctttctttctgtttatcagtatataaagtggacatgaagagcaagcagtgcttaaagtatacatgtaaccttgcagatgaaaatttttgtatctaagaataggaaaaaaaaaaatccccccccaccttaagtggttgccgggaatttgatgtactatctctgctaatatggtatcatatcacttactatatgttgctgagtattccagaagtgagagttttattgataacagagttgtagtctctttaagaaacactgctttacaaatcgattttttttgcctgaattctattgtgcattcttctttctaaatattaacatcaatagtaagagtttagtaaatgcatgctaagcactatgctgaattctagatatgaactctttcattctatcatcatgacagccttgtgccattttatctgagtatcagaatgatgtcactgagatataaataccttaaatcttgctcaaagaggatgtggcttataagtgaaagagtcccatttcattcctatttcttttcactccaaagcctaagattttaactattaaattaatttattgagcaatacttttttttttttttgagacggagtcttgctctgtcactcaggctggagtgcaatgatgtgatcttggctgactgtaacctctgcctcccgggttcaagcgattctcctgcctcagcctcctgagtagctgggattacaaatgcacaccactacgcccggcaaatttttgtgtttttagtagtgacaggtttcaccatgttggtcaggctggtctcaaactcctgacatcgtgatctgcccgccttgggctcccaaagtgctgggattacagtcatgagccaccatgcccgaccactgagcaataccttctatttgaatggaattctgaagtgtattaaatatctattacctcatctgattctatatctactacataaagtagatgcttgaagtattttttatttcattttatgatttagaatagatgtctagggatacatgctagttccctagaccctaggtggctaaaagtgagagaattaagactaggttcttaatcttgtagatactagacctggattacttttacaaatgcacagttaaccagcatatagtgaacactatttctcaatgtttatttcacaaagattaatattttctcaaggtaggggctatattgaatagttttatattatttctcatttctagcagtacatatattgtttataatgggcatcaaattaatgctttgtttttgtctatttaattcagaatattgtgtgattaatagttcctaaattggattacatatttttatctataagtagtgctgtgatgtgtggggcttaatggacaattgatctttgataactatgcttgttttatctgtttttttgttttttgttttatatatatatatatatattttttttttttttttgagatggagtctcgctctgtcgctgaggttggagtgcagtggagtgatcttggctcactgcaagctcctcctcctgggttcatacattctcctgcctcagcctcccgagtagctgggactacaggcgcccaccaccatgcctagctaattttttgtatttttagtagagatggggtttcaccatgttagccaggatggtctcgatctcccgacctcgtgatctgcctgccttggcctcccaaagtgctggcattacaggcgtgagccactgcgcccagcctgtgtctattgtttttaaggtgcactttctgtctacttctctcacagctgtcaagccattcactgtgtactgatttcattcactgtttgcctgtgtccggataactttattattttacatatctggtttttatctagtgaaggctgagaaatctaactagttagaaaagtgagtaggctctgaggaaagctttgagaaaaccttgaactaaattctaagagtttaagtaaattgcttcgtaggtgtccagtttttcatagttctaaaacaaagaacaaataaacttctatttatataaatctggacaagagctgtatcatgaagaaatttttttaatgacagaaatgttgattctgatttttttctatttggtttgtcattaaatgttgagggctgtaaactgaccaaagccaattgtctttccacaataattagattctaagtatcaatagccacgaataagtagtagtaaaagagggctaggattctctgtcacaaccttcatagaaaggttggaaaagtttgtctcaggccaaatactactatgcacagtatatttattagcaagtaagatttgtcctttcagaggcctgacaacatttttctttaagttcaatttaggcaaaccaaacactattctagagacagctctcagggtaatgttacagttagtattgggcaataaaaactaagaataattgggctaaattcatacttatggaatcatcttttcagcatcattccagatgacaaaagccttcctggtttcatatagtttattcatataacctcctttatcttgagccattcatgttagcaatgaatattcatgtccaatattcatgaaggtgatagcaaattttttaataattataaataaagataactgaaatatttatatcagtgtgcccagaacaaactgttccctaacagtcttttggaatgtgtttaacctaggacaggtattctgaaaatgtagaataggacacacacacacacacacacacacacacacacacacacacacaactttattttctctgtcaagtttggaagcaattaatagagacacacagagtatatacaataggtaaaaagcatgtggggtttctttttttgtttgttttgttttgttttactgtaaattcagttgcttcaagtaccagatacaattgaaatgctgtacttccttcagtatattaaagttaggctcccagtcataggaagtacaaaggaaggccctttatgatactgaggaagaatgtgcatatacagaacagagctctgactgagtttcctggacttagtttatccttgcagtctaataaatcagggagaagccagaatgtcccatgccctcccctcctgaggtgtgcattttcctgcctcccagtgaaaacaggagcagggagagacctgtgtccacttaataccttcctttttcatttttccaaaattctttcattcatttttctcattataatgtaatcattaaggcttataactttgcaaggaccaaatgacaagtaaatattaacttcttatggtgtcacaactaaaaatgctaggatataatagtaaataaaaaagacaaaatttctgcttttatgaaggttccattctaatagagaagaaaattaacaaaatatatgtgagttatgtggaattttagaagatgttatggggaaaatgaaagaaggaaagctagagaggaagtgcatgggaaaatacaatttgatagtgattatttcacaaagaaagtgaccttacagcaaatagttgaataaggtgagaggatgagccatggttgtatctgaggaaaagtatttcaggtgcaaaggtaagaccccgaagtttagacacacctgatatgtttaaggaagaagaaaaatactcctccttacagagtaaagtaaaagaaacagacagtagtagagatgaaatcattcagtaataggagagggatagatataattactctgcacgaaattaggtacagttaaaaatttgagtatagcagtgacataatcaaccaaatttaacaaaggataatcctggatgctgcattgaaaatggtctgtggaagaagcctgggaaaaattatggagagttgttgatatgctctgtcagcacattctaggcctggagtgatctttccagaaataatgagaagtcatttcaatctggttatattttggtggttaaaaactacatgatttgttaatgaattggatatagaaggggagatagaagttaagaataggtattaagatacagcttgagtaactggaaacattgatttgtcattagccaaaattaaaagactgttagagaaagagtaattcaatattggccatactgtatttgaaaagactttttgacatctgctatggactgaatgtttgtgttcccccaaaattcacatattgaagccaaaatccccaacgtgatggtatttagaagtaggacatttggtagttagagatacttaggctatgagagtggagtcctcatgaatggcattcagtgcccttatggggaatgaagaaaccagagctctctgtttctactatgtaagtgtagaatgagaagacagctgtctgcagaccacaaaaggtgcatgggatctgctagtgccatgatcttgaatctctcagccccagaactgaaatacaattttgaagtcattagcattttacatattatttgaaactttgatattggattaagttgacaatgacagcaatgacaggcaaagagagagactgacaatgagcaaaaaacaggaagtatgataaatagtgtagagtatgactttaacaatgaagagtagcagttaatgcagtataatgcttatggtataagaattaaagctgatgcatttccagaagaataatctggcagtgacattgagaaacaagaaggctactctgaggctcaccaatcaaaagggatactgggaaattagggttcttaagaagaacttggtgttggttcaagcaagcaggtgaagggaaactcgagataagtttaggacataggggactttgctagtgatagaaaatgagtttcaaaaggcatagaatatgaattatgattctatagtttgtaaactttggcaaattatttaatttttaagcttaagattttattatgtgtaaaatagggattgtagtgctctccagagaagattgttttgaggattaaatgagatgggatattaaaagtgcttaatacataatggtaaccattatttggatgcgtcattttgaatatttacattagttctaagtttattttgttgattgttccttgagccctagacaaaattagaattgcaggcttattttagaattgattaaatctctttgtattccaaggttacccattttgtacaacaaaatttttttaagactaagccttcatagagtatccctaaatctaacggaagtctaggtatttttcctattaaggacttcttaatttacagacacttctctggatgtgacaaataaatttatgctcacttccaaatgccatttattttcaacactaccagcagtgattctgctatgccttcttagcataaggcattttattttgcttcctgggcaaaagatcattaatccataccaatattgtaagaaaaagagctgttttatggctctcctgtgtgcagttttccaacattcttttatttttgagcatatttatatttttgtcattgtagatttagctacatttccaagtttcatatatgttatatgtatattctatataatattattcattttatattgtttggaatatttaatgaactgaccttttacttacacttacttcaaaataacattttatattatcattatgaatgacaaaataacagtacttgacatgaataaaatatattcattaatttttatttaaatattataacattttgttaaaggccaaaaaatgtaataccaggaatgaatgtatacattttttgaaacactgctgtactgaattgaaagctttatttgttgctctcaagtggtttaataacataaatcagaacttgtttgcctaagtgagaaaatcatccaaatccattgatttttatctattttagaatccctaagggcagttactttgtcttaatgtcctgtgaaatgtgtagaatcattccttgcacataaaatgcactctatcagacggtatttgatggctgtattcatctttaacatgaacagaagattagtttagagaaaatttgttttcttttccaaattttccatttgccagtgtctaagaacactgcttccttggataaatacttttgtttccctattggtgcttctgaaaaatcagggactctaagtcagatgctgcaagtaatctggttgagtggactggaaagagtaattgctttgatttttaaaggaatcatttgttcttcaggcaaaattaaaattatattaaattaaataaaaattaaaggaaagattggctttaatcttaaccatgttattaaccatatattagcaaaccagtggctaaagtgcattacttgccagctatccaaaatacacatcatttattcgtttaacctgaggtattaaagtggtcgaagtacactgaggagctcctcttccacatgctgcttgcctccagacctgacaacctcgttgttgttcttgaaactcaccaggcctgttttcacctcacggcctttatcacttgctctgccctcttcctggaatgttcttccccacgtgacttactctttcaccttttacaagcatttgccaaaatttcacattttcagtaagtctgtcatgatcacttctataagtgtaaatcctcaccctgctctccatatatgtcctttgtgaaatattttgtagttgagcaacgcgtataaagatctgaaaacaaaatattctaattaatttttaacttcattttcctccactaccatgtaaattgtataagggcaggatttttgtctgtgtggtttactgctgcagcctcagtgcctaacacagcgtagatgctcaataaatatttgttgaattaatgagtgattaagtagtagtagtagtattctcattttgtacttgagtgcattgtctgagaagagatagtatagctgaggctgaatccaggtagctggctccagaatctcccccgttaaactcaaaataagccccagaaagataactgctgtcatacttttctcaggctttgaagaagggactcggatatgacttgatttatcaaaaataagcacataaaatgttttttcactaaaaagaagcaatttatatctcttatattatggaaaatactgaataacactatgctcccattttcaagatgatacagttattactatctctagataaaaaagatgcatctttcaattaattaaagtacagagaaatctggttggaatgatggcagaaatagtaatataattgaagtcatatgcattttctatttaccagtaaagttactattaggtttaaatgagacaagacatgcaaaattttaatatagtttctgacacattataagcaattattttgagatggctggttagatttatatatagaaaacatttaaatattgctgatagaaatatgtttagggcacatatacacacataatcaaatcctaatacttgaagggtaaatgcttctgttgatatttccaatttttctttttatggattatttctcacctttggacattgacaaagaaagatgatattgtctatacaagtgctaactcatgtaatgcatagattgcagaactttgatacagattacaccatttccttttgctttcttggctgaaaaactataaatacttcctaattattataccaccctcgaccctggaacaccaataaaggattgtgtgaaaagataaaaatgaagaaaggaatcaaataagaattttcttttaaatcctaagtcttcaaagtttccaatatgggcataacctcacataagaatgaagtaggcaaattgttgacattcacaatccttaaaagactgaggtatttgagtggtcaaataaaactgaagaaatatttcaagctacctctgggattgaaaggaattaacataaaaataataaatataaatacagtgttctcatcttacataaaggatattaaatattagagtagatctgatataataaaagattcgatattaatctggtcttaaaattgtttacatgaagctatcttgtttcagaatgcatttcttctggcttttatgaaacacaagattataaaatgtttctcaagaaaaaaattaaaacagcaaccacatatcaataaacaaaccaaaagaacatgatcatatctataacaacataataagaaaaatttattgaccgagagaaaaacaacagaaaaagttcactgtaagctttttggggttaagatatagtctccagatataattctctgattcttcaaaatgttagctgagtatcattatttgtggttcctatctagcaaagaacagaatgcaagggaaaaatatcaagcgtctactatccattttattgagtgtattcttagaaatttgtttgcttcttttttttctactcctaggcttccattatgactaactcaatgaaatataaaattttggattttgactaacatgggatgtttcaaaaatattttaccctggctaatttattactttcttcttcatttactttttttgattccattttattttagtgtgtatggcatggggagggtggggagctgggggagaaagcaatagactttaccccaaagaaataaaagaattggcctggaaaaacaagtacttttgtctgctgaattgaaaattgactattgtgaggatacaagggaagaagcaacacgttagtaaaatagttactaccataatccatgaggaaggtggtggcagagaagaaattcagacacagccagatacagcagatattttaggtaaatctggtgggatctgctgatgggttgcattggaatgtaagagtgagccctcaaagtgtagctatgagccctgagaaagtaggaggatggagttgcaggtacttactgagatgatgaagcagtgaaaacaatagattattgtttgaatttcttttattttttgaggtacgtcaagatggaaaggagatctagatttggggcttttaaccttttaaattggggaggcttattattattcatctaatgtggatccatgtaggcaattggatacacatctgaaatccagaggaaagggctagcctagagatatgaccgtcttcagcagatagacagtatttatagctacactgttgaatgagttgactaaataagtgaagttcaaggaccaacctttggaacaatccaatataaaataagtcttataaaatgaggagaaatcagcaaaggaaaatgaggaactaccattgataatgtgaggattgaaagcaggacaatatgatgtcataggagccatgcgaaggaagtatatcacttttatgagagacagattaaataatcttgcaaagattttcttacagaacctagcacatagtcaatattcagtagtttattactgactgaaatattattttcagtttcccttgattctgtagtttttgtggtccaagagaggcttctggccatcaatccattgtggtagctgataaggacgttctgtgagcaggactgtgtaatccatgtcaaagccaactgatctaccactaagaacaatacgttcctgcctgtctggacagggaatttcacactcagcctcttatggctgggacagttattatgtagtcactgacagaaactcacatacttattcctctctcagaatcctgctgactccagggcagttcctgtctgtggagaggctggtgtttctgccaggctagtcacctaaaaataaaatacatctgaacctttatcagatatatccccccctgtagcatcatgcttaggcagatcattctgtcaactctctgatagcatccaaatttctttctttatccatgtcttttataagaggatcgaatgactcactggaaaaagaactgatttgatgttttttaaggtaaaactccagacctcagtgccataaaacaagagcatctttattttggtcaagagaaactcggaactcaaagtcaaactatatgttttcttctccgacttgggtgttgaagggaagaaaaaccaacaaaaaggttaatatttattgaaagcttacaatgtaccagatattagtctatgtgccttgatatatattatttcaattaaacctctcaacatctattaacatttgtattgttgtatagtcctcgttttagaaatggatacacagaaataatcacataggacaattggagcccggttttgaagtcatgctttgtggctataaattcaggatttttaaccagaaagttagactgatttgaattattgtcttgatatattctgaacagaaaaagaaaagaatatacattaaacactttatcgacactgtaaacatagtttagcactttttttttttttttttttgagacaagatcttgctctgttgcccaggctggagtgcagtggcatgatctcagctcattgaaacatctgcctcccgggttcaagcaattctcctgcctcagcctcccaagtagctggggttacaggtgtgcaccactgcacccgggtaacttcttgtgtttttggtagagacaggatttcaccatgttggccaggctagtcttgaactcctgatctcaggtaatccgcccaccttggcctcccaaagtgctaggattacaggcttgagccactgtgcccagccagcagcttttatttaaattataaacagacattgaaattaaattcattaattaagttaattaaataagtaaaccttgggaaaatgattatttccacatcaggtaggattacatattcagaaatggatcagatacgaaatgtttgattttacaccttgccattaggccatgctttaatctttattctttaacagtgtcatggacattctgtgctattagtttcaagcttttatattactctgtaatgagtgggcgccatatcaattacttgataattgaattatgttttctctctgaaggcaactgatcgagagggagactcaataacatatgccattgagaatggagatcctcagagagtttttaatctttcagaaacgtaagttaaaaatgatttcctactttaaaaaaatgtacagcaacgtactgttagtaagaaagcagacttctaatcagaggctttcagctgtttgtagttgtacttccctttctgttttctatgaatgctaatggtagctgggaggataattctgagcccagaaatattacccaggagactgtttatttttaacatttttactaggtaaaatctactgaggtggaaacatttcattggaaggcacaactgggattaattagatccttttaatgttgtcagctactgataatgacaaggacattactacaaagggttacttagcaccaaactgtgtattcaaagggaggcttgtaggcaagatgtgttacaaacacatccttcaatttcagattaacataggtatatttaagaaaaaaagcacaatgaaataaaatacgtgttcatgccaaacttctttgaggtctagatcagtgtcattctacttatctctctgaatacatctgagatattgctaatgataactattgagaaaactgggagcaggcattaaaaggaggcatttagggcttcagagagactgtatgcttcccttttgcaatagcaaggtagctgttctgctgtcacatgtggctggtttctaaagagcttggctcttccctgatatttcctgtgtacctgtgaatagttttactttcagaaggaatagaaatgtaaacttggccaatgattataaagttaaaactttgacaaatgaatacattgccacatcagactcaggaacatgtggggcataatgccaaaacaagagaaccatgtgctggtcaattagtcttcccagaaatacctgaaatttcacgttaaatagaattttacaaacatgagttagtaatgcctgggaaactatagacaagaacagtgttttccacagataagtaaacttctatttgaaaaataaaaagccttaactgttttcatttttatctcatagggatgtagaaatcaaaaattagctacaatttacaatcatcattaaagaaaataaaaatgttaaaaactttaagcaaggctgtgtagtattagcataaagatagatatataagcacctggacagacttaagaatccagaaataactctagtatttatggtcaattgattttcaaaaaggggtcaagataatccaatcaggaaagaactttgtttcaacaaatgaagctgggacaatatgcaagagaatgaatttcaatttttatctcacatcattcacaaaaatgaactcaaagtggatcataaattgcaatatatgagataaaactgcattccacatagaagaaaatacagaagtaaatcttcattatttggattagtcagtacattttgagatatgacacaaaatgcacaaagattaacgataaaattgataaattgggtctcgtcaatttttaaaaatgtatttcaaggagcaccatcctaaagtgagaaacaacctacaatcagagaaaatattttaaaataatgtatatggtgtgaaacatgtctcaagaatacataaagaactgttacaacttaataaagagaaataatctaattaaaatgggcaaaatatttgaatagatatttctttaaaaaaggatatgtgaatggccaacaagcacatggaaatatgatcacgatcactgttcatttgtcattagagaaatgcaatttaaaactgtaaagagatttgacttcatacatactttgtgtctgtagtgataaagaaaggcaaaaccaggtatgactaagaatgtggagatactgaaatctgcgtaaatttatgtggccatgtaaaatgtgcatgtgtgagttcgtttttgcactgctataaagaagtgcttgagactgagtattttgtaatgaaaagaggttgaattgcctcacggttctgcaggctatacaggaagcatgatgctggcacctgctctgcttctggggaagcctcaggaaacttaaaagtcatgactgaaggcaaagcggggagtcagcgcttcacatggcctgagcaggaggaagagagagggaggggaagtgccacgcacttttaaacaggcagatctcctgaactctatcaagagagcaggaccaaggagggtggtgctcaaccattcatgagaaactgcccccatgagccaatcaccttccagcaggtcctatctcctacattggtgacaatttgacaggagatttgggcaaggacatggattcaaactatgactacactttggagaactggccttttctccaaatggtaaacagaattaccgcataagccagcattctgctcatatgcaagagaaatgaagacgtgcatctacataatagtttgcacaaagaaagttcataaaagaattatttacaatggtacaaaagtggaaacaagtcaaatatccatctacagaggaaggaataaacaaaatgttgcctgtctgtaataatataatattactcatcaataaaaggtaatgaggtactgaaacatgctacaacatgtatgaaccttgaaaatattatgctaagtgaaataagtcagttgcaaaaagagcacgtattatattatttcatttctataaaattttcataataggcacatctataagataaaaagttgatcaatgattgcctgaaaatgaggagtgggagagaatggggagtgactgttaatagatatggtgttgaaaatgttctaaaattgattacagtgatgattgaacaactctgcgattatgctaaaaaccattgaattgtaccctttaaattggtggattttatgatatctgaattaaaatgttaacaaagctgtcaacaaaagaaaaagacaacaatgaagttttcacctgctctggtaagcaggaagcccaggtctcttaagaatttctattcctgtttttcccttgatgccaagagatttttcaattgctgattgtgaaatccagtgagctactagttttgccaaataaattatctaaatgcactgctttcctatatctctagtgctcctctcatctctgcatttggaatgaaaaagataatggctgggtcacagaggttcttaaaggtgtaaattatgtcaatgcaaaatccttttagtctaaattgaccatgattcttaatgttaaagctcttaggtcaacctggacagacatctccttaagacacaaactgcttccaggaaagctaaagcagaacatgtccctataatggttgtgtgatcccttttgatgatcattcttgattcagggtcctgtacactgggccctttgccttctatcctatggtcactttgtttccaccacctcaatgctgttgttctcattgatatttatagagtagcctgaaccactagcaatacatttcaatgcatttgaaatggagaacaataactgacatttcaactgccaccttctttgaaacttctgagattcatgttcaaaactttgcactaccacttctctataactttcaaggatatgaacaatccaggtactgctatagtttggatatttgacactccaaacctcattttgaaattcgatccctcatgttggagatggggcctaatgggatttgtttgggtcatggaggcagaccgcttatgaatggcttgttaccagaggtaatgaatgagttcttgctttattagttcccacaacaaatggttgtaaaaaaggagcctggcaccacccctcctttcttgcttcctttctcaccatgtgatctctgcacacaccagcaccccttcacctttggccatgagtggaagtactctcagcccctcaccagaagcagatgctggcagtatgcttcttatacagcctgtagaactgtgagacaaataaacttattttctttataaattacccagccataagtattcctttatagcaacacaaatggactaagacaggtacgctaaaaaaataaacaatgttctacctcatcagacacttcaatatatgctatttgggttatattttatatcttaaagcaaaatgaaaaaatatttacatgtctattgtatactttaaataccatattattttatgctataatgcaaattctctcaatacgcatcattataataccattactttcctttaatgaaataaaagtatgccaaaattttcttgtatttcttttaaaaaattagtagtaatgaataatcatcttaatgtcagtagggttttacaaagtactgaattattattttaataaattggcttagtcacacagccaagaaagaaactgggtctttaaagaaaaagccttggttttttaaaaatcacaaacattggtaatacaaatcattcagtgtcatgtattaagtggccatatctgtatgattctaatataatgcatttttctagtatcttttcatagtgtctgtcttgatagtggcatatgatttagcaaatattcactcagcaatcatccacaaataagtacacatttaaataagatatatggcaacttcccttataaatatgatggcctaatggtatagttatttattaagggaggttgaggaaatgccatctctcaaatatttatggattgttatcactgaagcatggggtctgtgatgccaacacttaaaatcagtgctaaataagagaatttcaaaaattatctccatctctggtccaaattctattaaaattttttttcttcacttgcattttaattttttctttggtgattaatttgttttgacattacatgtaatgctcaattatatttttcatatcagtttgaattttatgattatattgaaaattaaataatatataagaaagatatttattttattccctgacagctcagctctactttcaaaatattaaacccaaatcaaactatttctcacacttcactctactaccttagttcatgccaccatcatcttttccccaaactgctgtcaatacctagctccctttattagtaggtttttgttaattgctaattgctatttaatatgaaatgccatgtcaaacttgaagcaactgtacattttaaagtatactctaatctctttaaatatcattgtaaagcctgaaactcagtgcccaaaagcaatgtgataaatctgtcaaaggctcagacacctccaagtgtaaatgttcagtcacaagctgtagaatttttaacaaaattttaaataagcaaagcctatacatcatgaaatatgtgagataatagtttataatgatgctgcatcggtatttcctaataacggaattttgaaaaacagttacttatagaagcaggttttaaattcggtagcttgttttgtttggaagtagatatcctctgctactttctatttacatcattgaattttcttaagactgggtattactctgttgcccaggctagtctcaaaagtctaggcttacgtgatcctcccacctcagcctcccaagtagctgggactacaggtgataatttttatttttttattttttttattttttgagatggagtcttgttctgtctcccagactggagagctgtggtatggtctcggcttactgcaacctccgcctcctgggttcaagggattctcctccctcagcctctcaagtagctgggactacaggcacccaccaccacacccggctaattttttgtatttttagtagagatggggtttcactttcccatttgacagaagggaaaactgatggcacagagcttttaaataagctcccagggaacctgtaatcccagctactcaggaggctgaggcaggagaatcgcttgaacctgggaagtggaggttgcagtgagcggagatcatgccattgctctctagcctgggcaacagagagagactctgtctcaaaaaaataaaaaaaaaaaagtgcacattaaaaaaaaagagagagacagtgtttcactgtgttagccaggatggatggtctccatctcctgaccttgtgatcctcttgcctcagccacccaaagtactggaattacaggcgtgagccaccgcgcctggccaaatttttaaattatgtttgaacaccatttttatagttaggcaaaccctattttctataataattgagtatgccaagcataatatgtttcaggaacgtagcccaaaagcttggtgatggaaaatactctgcaatataatttatataattgaggcaaaattcacatagcacaaaattaaccattttaaagtgaacaattcagtgttgtttaggagattcagaactcatgcacctaccaactctgtctagttctaaaatagcttcatcactccaaatagaaacctgaacccatttagcaattgctccctattccttatttcccttagcccctggcaaacaccaatctgcgtactggcttcatcaagttacctactttgaatattctacagaaatggaatcatgcaatgtgtgactatttgtgtctagcttcttttttgtagcctaatgtttccaagattcgtctgtcttgcaacatgtgcaagtaggtccctacttttcatggctacgtaatattccattacatgcatatacaacaatttgtttacctattcataaattgatagacgtttaagctgtttttctacctttcggtattacaaataccgctgctgtgaacatatatgtacgtgtatttaagtacctgtgtttggcttttttaagtatatactgaatagatttgctagggaatagtgtaattatgtgtttttaaccatttgaggaactgtcaaatattttccacagtgattgaagcattttatattcccaccagaaatatatgaggattctgatttattcccatttttgccaacaattattttttgttgttgttgttagtaatggtggttgtttctttttttaaatataattatcatagtgagtgtgaagtgatacttggttgtgggttttgatttgcatttgcctgatgactaatgacatattttcatatgctttttgattatttgtatatcctgtatatcttctttggaaaaaatgtgtatttgagtcttttgcctatttttaaattgggatttctttttgatgttaagttatgtaatcctttatatattctggaaataagactcttaccagatatgtgatttgtaagtattttctccagttatatgcgttgttttttttactttctcgataatgtcccttgatgcacaaaaggtttttttttttttattttgacgaagttcagtatatctattttttcctttgcttcccgtgcatctggtgtcatatctaagaatccatggccaaatccaagattatgaatatttacctctagtttttatctaagagttgtttacaggtttcaattcttgtgtttagaaaaattgttgatccattttgaggtaatagctgtgtatgaagtgaagtagtctaacttaattcttttacgtatagatttccatttgttccagtgccgtttgttgacaagactattctttccttttgaatggtcttggcattcttgttgaaaatcagatgactgtagatgtgtgggtatatttatgaattctcaattatatttattattctgtattccccagtacacttttgagtgcctgaattttccatgaaactatttacccagactttcctggcaagtttttggcactctattatacgcctcaagtgtttgtgggctatcccctgccttacaatatttctgaggaatgcccactgcttttctgctttgagtgatttccaagtttgatgaaacaaagataagtgccatgaatcactccttcaggcagtctccagacagactagaatagacccccacagttctttatgaataaggatagctcgctccctccagaaacaaagaccatagtgtcacactgggaatgttcactgatgttttcaaggccactctgagccagtgagatggtaggataaagacaagtcaaaatgccacagagttcttctaccagatttgatttacctttttttaaaacaaattctgccttcatctggttgctataaacctgtgactgttttccagagtttcatcaaatttgctgttgaaggtccctgcttaattgtgattttttgacgttttgtggcgagaccatctcttggggctgtcttctccatttccactgacatcactcctgggaaatgtattttcaatcctgtataagtagcagtgttattgatgctttatcaattgaagaagcttatgtatttttaatatgtgaacttataaggtgtattgcattactaagtgtaccccaatgtatcctggcctgatagcctccatctagctggtaataagactttttgtgagctatttctcggatttaataaaaggatgcacaggtaaacccataaactagtctttcagctatgaatcccaaaatacactgcctgtgtttctccccttctgcattgcccaaatataccacacaactgcctacaacactgagtcgcaaggcccgcgtattacataaaaactacctctataataatcaccagaccatagacaattagctgtttgtgtttaaaatggccctaagtatgaatatactgtatactatattgttcacggcatatagtatttttggaataatacatatagtattatatatcctaaatagtatatatagagtatacatatatattccaaatactatatacagttgggaggcgatatagattatttataagaaaccattccttgtctcaaagaattctgaacatgctgaggaataatggatcttttctcttgaaataatcaaaaacaagatagatatttttcttcctggaatgaattaagcgaagttttgttatgttttgtttcctggaaggtaggaaatcaactcagttatcacgtgagttttgtaattcatcgtaaatatacaatatactttttagtaattttctaatttaatgtacaaggaggaatatagataattaactgagggaagaaacaaaatgaaaatggtaactcaattttctttctttctcttattataccatggctaggttttcagctttcctgtttcttaagatacttgtgaataagcctcagaagaaatacatgtcttacttttctcatttaatgtaattttaaaatgggattatctggaccttctgtactgtaggaagctggtccaaacttaattgttgtgaacatgctctgggaactggttttcaattattttgacaaaacatttttaaaatgtacaggaagcaaagtcagtttttcatgggcatgccatatgttcagaactttttaaaaagtccacgtcaaccattacaacataataagcaaattgagtaactgtgattcttattttgattcatcggctttgactctctgtactcaactaccatatgtgatatgaattgtttaaattttctttacaataaaagcacttaccttaaaatgaaagcattttatccattagaaacaatttatgttttggacttggtacatatattttaatgtgttattatattcagataaactcttctacacagtggatacttgttaggctcgattaaaatgtgtacaatatcagatgtaaaatttaagaaataaatgtagaacctacattagagagcaagccaaactgttataaaataaattacatgggtgaataaagtcttaaatatttggaaacatttattctgagcagtgaaaagataaggagtaggtattaaaaatattgtaagtgcaataattttcccaagtgctgttaatctcccattatacatcagttaaattaagaaacagctaaatttccaaagaataacaaaatactaaaattgttagtgtagccacaaaaggggttttaaacaaattataaaatgagaacatgaattctaatacaattatattttcttaaaaaatgtaaaatatgcagaatgattcctcttctgaaacaatcatatatttaaatgtggttataataaagtacaaaaagaaacattacaaaaaacataatttctgtaatttgaaaaaattctattttctaattttgtacaatgggtctctgttattttaaaagtaagaaaaaagaaaaacttttatccatagagtttgtcagagataacatttagatgggtttttgcattttcataatggacatacatatgacataaattgggaggtgatatacattagttataggaaaccattccttgtttcaaagaattctgagactgctaaggaataatgaagtcttttctcttgaaataatcgaaaacaagatagatactgttcttcttggaatgaattaagcacagttttgttatgttttgtttcctggaaggtaggaaatcagctcagtgtcagtttcatggatactgctaagaaatttgacagccttaaaagctgttttcaattttcagaatgaatcttagtattatacatctaaaatactcaagctgtgattactgagaggggaaaaaaagctatcaaaagtaattcactatactaagaagactctccttgtgacataatatctctttttgtcttatttgtttgtttgttttgtcactagcacggggattctaaccttagggaaagcactggacagggaaagcactgatcgctacattctgatcatcacagcttcagatggcaggccagatggggtgagtatgctccctgtgaaggggttttaaaaatagtattaaggcaactgagagagtcttaaacaatgtatcacagacatgaattaatgtttttcatctggagcaacttcttataattactagaagtgttgctcttttcttcaacaggctattaatacatgcacctatactctgaatttgctattgtgctgcaacctttgacttgacagaacagatacttgagatcagcattctcacctaacttgtagggaaaatgaaatctactttattctaacaggtattccattgtgtctgtcatttgcactgcaccatgaaatgtgttctggcagtttattatgttggaacctgttacacttagcgtcatttttttaagggtcagggaggaagagtggattttgtggataaatatctttaagcacttaggaaagtgatttgcttgtttccacaggcatttgtaagtagcagtaagaatcataagtaattcttggttatctaaataatttaaatgggcttataattccaaagaagataaattctatttcctttggacctaaaactcactttaaaaaaaaaaaattgttagacattctgaactgctttaaaatcacttgtctgtgttatttgaacgatctcattcacaactgccagcatcccgctttctatgtattgtaatattaccattgttaataattattttcaccatttctatgccatgtgttaggtgattctcttttttttttcaatcaggtgcttatgtgtcaactcagtgctattgtctagaaataatttcaaacccattacagattgataagcaaggctcactcaatttaaatatcaacatatctcctggctccttgaaatgatctatttaatctatatactacattggctgaaagtatacaataataatgtatttattattgtaataataaatgtaaaataaatgtatcttcacatttattttaggaggatttctgagattttattataataaaaatataaaattgatacctgaatagttttctcatcttaactaaaagtgagataaatagaaataattaaatttggtaattgcagtctgtccatagtaagctatttaacatttttcagacattacataaataaacatacttatacatataataaaatatacagaacagttgtagtaaacagtgaggataataggtacttagatgatagaaaagtaaataaaacctatggctaatttttatataagcaatccacctaattattattattattttttgagatggagtttcgctcttgttgcccaggctggagagcaatggaaacatctcggctcactgcaaactcagcctcccgggttcaagtgattctcctgcctcagcctcccaagtagctggaattacaggcatatgataccacgcctggctaatttttgtatttttagtagagacagggtttcaccgtgttggccaggctggactcgaactcctgacctcagatgatccaccctccttggcctcccaaagtgctggggttacaggcgtgagccactgcgcccagcctgccctaaattattacagtatgtctgtgttagatgtatgtaaagaagtcagtgagagtttctggaggaagtaattgaagaacttgacttatgatgaaagtttagagggtaactcggctaggcaataagtgagagaaaatattctaaggaggagaaggagaaattatttagcatagattaagaggtataattacagtgaagtgaaattaagaaagcattcaggtcaaccaataaaataggaaaaaaagaaaggataatacatagctttgaaatatgccacattataaatcagaaactaatggcagtaatattagctagaacattttaagtctgtccttaaagtttcttagacaaggaaacagatggaaggaaaatagtcacaatctactaataatacttttgactacttaaaaccaaaataagttctgggctaaaatcagtagttttgttctttctagttcattgttcagtaatttatttgtatattttaattctccttggacaggacacttagcatttctaggtcctcgtttcctcatataatcactcaggtttcattttgctttaaaattctgattttctgagtaaattttgtgttcatttgtaaagtttgtaatgagaatatcagtagagtagaaagcatttagatttcaaacaaaagtttattcagttaattccatcatttatataattttacggatatacttatatgtaggcatacacagtgggttcctgaagaaaaaaagtgattatataacaataatattctcacgtcttaatagcacttttcttatctaaatatttagtaattacagtaaaattaaccttttaaacttaagaatcatgtggtttaaaacagatatttaataaacacagacagatggatggaatttattgaaatgaaaatgttaacaagcaatttgtgtgaaacaaattgccaggatgagtttgaaaatttgatcatgagaatacacgttttctaccatctcaaaatggggatgatggagataagaggtcacattctattggtcattgtgagtttatttgtagacagtatggaggaagtttgatttgactgtccttttctaaattttctttgttaatgattgttgaaaaatctgtataagttgcatgtgtcatgtaatttattttttttttagctatcgggggtacagataaaactatactttttcgattctaatttttttttgaagattcagaacaagggtgtctacttttaccatttgtgttcaacatagtatcagaggtcctcaccagagctattaggcaaaaaaagaaagaaaagagagagagagaaagagagaaagatccaatttgaaaaggaagaagtaaagttatctctgtttagaggtgatatgagtttgcatatagaaaactttaatgattccatacacatgtttcatgtttgcacacacatacacaaatgttggaactaagaaattttgcaaagtatcagagtacaaaatcagcacacaaaatcatttgcattttcatagattgaaaatgaatgagttaattaagaaaacaattcaatttgcaatagtatccaaaagaataaaatactcaggaattaacttaaccagggagataaaagacttgtataatgaaaactacaaaacattttggaaagaaattaaataaaacataactaaattgaaaaatatcccatgttcatggatgggaagacttaatattgttaaaatgttaatactctcccaagcaatctacagatttactgcaatttctattaaaatcccaatgatgttatttgtagaaataatttttttaaaaaaacaaacttattctaaaacttatctttaaaatttcaagggaccccagatagccaaaaagaaaaataaataacaaagctggagaacttatacttcttgatttcaaactaactacaaagctacaatactcaaaacagagtagtactagcataaaaacagaaatacaggccaatgtaatttaatagaaaatccaaaaataaactttcacttaattggtcagataatttttaagatgggtgctatgatcattctacatgcaaacgaatgaagttggaccttatctaacatcatatgcaaaaacaaactcaaaagtgattcatgacctaaaatgaaaactgagtctatagaactcttagaagaaaacatagggcaaaagcatcatttcattgcatttgtcagggatttattggctatgaccccaaagacacagacaacaacaacaaaaaatagacaagttggaatttgtgattttgtaaaggggtgtcaaagacacagaataaaaaagcaacataaaaatgggagaaaatatttgcaaatcatatatatgataagtcattaatattcaaaatatatagatctttttttttattttttgagatggatttttgctctgtcacccaggctggagtgcagtggcgcgatctcggctcactgcaaactccgcctcccgggttcaggccattctcctgcctcagcctcccgagtaactgggactacaggcacctgccaccatgcctggctatttttttggagttttaggagagatggggtttcactgtgttagccaggatggtctcaatctcctgacctcgtgatctgcctgcctcagcctcccaaagtgctgggattacaggtgtgagccaccacgcccagcccgagaattttttaaagaaaacaaaaataaacaaactgattcaaaattggcaaagtacttgaatagacacttttccaaaggagatatataaatgaccagtaaacatatgaaaaaacacttagcattgctaaatattatggaaatgcaaatcaaggccacaatgaggtgccacctcacacccagtagagacgctattataaaaaacaaacagaaaacaaaacaaaacaacaacaacaacataacatgttgatgaggatgtggaaaaattggaacccttgtgcactattggtgagaatgtaaaatggtacaaccactgtggaaaacagtggtagtttctcaaaaaattaaaaatagaattactatatgagcccccaatcacactttcatttatatatcaaaaaaattgaaagcagagtctccaagagatatttgtattcccatgttcatagcagcattattcacaatagctaagatgtaaaagcaacccagttttccatgtttatgtagagtaatatataaacaaaatgtggtatatacatataatgaaatatcattcggccttaagatggaagaaagtatgacatacactatatcacagataaatcttgagaacattatgctaagtgagattagccagtcacaaaatgttaaattccatatgattccacttatattttggtacttagaatggtcaaaaatcacaaagactcaaagtagaatgatggttgccagaggataaagaaaagagaaatggggagttattgtttaatgttatagagcttttgttttgctagattaaaagagttttagagatggatagtgatgatggttgcacaagaatatgaatatacttaataccacaacattttacatttaaaaattgagatagtacaaacaaatacagaaaaaaaatctagaggtggacagtgaagagatggtgcaggtgcacatcagtgccattgaggatgcctgctggctattttctgctttgccatttttattgtctactttcattcccatcttctgcaactctagacgtcaattctctataccagacaaagtataaagatgaatgccagaagagtctgcacccctgctttattttaacaaagcaccaaagttttttcagaaaccccatctagcagatttccttttagatattcttatctgtaagtagcaacagtgggtagaaaaatagctaggaagtagggcttatggattgcagctgtgttaatcaaccaataacacagtgaaagatataaataaatatgcgaacagtgatcagtaatttttttcatttaaaatgtgaagttattctgtagcctagatatttctgaccagattccgtgtgttcagcaatattattttcctccttaattgatacaataggtaacttgattccatcatggtttgatttctgtaaaatgctcttgaattactggattgaattactcagttatggctttcagtctgaacacttgtaatatttcacaatttcagattgctagaagacttagcatctttgtttttgtcttgaagcaatattatttcctaaatttctttgaaacatggcaatataaatgaacaattaacatttaaaagttgagcatttaacttcataatcaaataggaaactttaacaaaagcaaaaatacatgcgtgagaaaatgtgtgaagttaaagtaactttgaatttcaaaatagttgatttaatattttagaacacaatacgtatggttatagaatagtaaaactttaaacatttaagtcatatatgtgaatctttacaatatatgtaacatgcaaaatgtttatgtacaaatatataaatatttatatctatagttctatattatatatactatagtatacaggtatactataaatactttctgatatttttgaaaatatatatttatataaaaacatgcacgattgcataaaatgtgtatacatacatacacacatacatatataatctttacacactacactcagatgtgcacagagaaaaaaaagcttctttattttttatacctgatgcaatcttcctacttagacaataatgtataaatatgtgtttggacaggtagggaatagatgtaatctgggtcacacttaagtttcttagaacagtatttcagcattatctgtttaagacaatataaatactcactagttaagctgccaaccaaacctctcctccctgacttcattctaaaattgtggtctagatgtaacatgtatttaccagtcctttatgctggtagtatggcttctctctcttgacacctctctctgccattgctgtatattcagtgccataacctattagatgggacctcccatggaacctgtggaaattttctggaggcttacatactcctgaaaactactgtgattatttcacccaaatttctcttagtttcccagtcatcatttcccccttcttccaaaatgtttctccagtgcctcttcacttaaggaggggtccaaagtggcagtaggggatgaggaggaggacctctgcctcctgccttcatgtctcttctgtgtctccctttctccttcccgtaattcataatagaaggaacttcccttttctctttctcaaagaaattctagattttatgtatatttttttccttcagaaggaaagaaagcctcctggctaatctttaatggtaggaaggacctccactctacatcatgaatgaaactctacaatctgaatgaagttggcttggctctgaactgtgtagcaacaagatgacttgcgcttaaggatgaaaatgttttaaattaatattctctaaatactatacttattattgaatatgtatttttcttgttttattggcctaaacaaaaaatgattgaattctaaactataaatcctcattgtcccattgttattgaaaagaattttagatatagtagtgaagatttttattcagataggaaaactttgtgttctataaataacatttcttgtgttttctcacagatggaaattttcaatattctttctagctcttcttttttcagacatttaaataaaataagttataaggtaatttatttcagcatgtagtacaaattataataaaaatagatatttaaagtatctaaaaatattcattgagctgacattgtgtgttctattagtaaacacgttagacacatttcttaataaaataatgtctttattatttctgagaatatatagtgaatcttgttgactatagaaaagaaattgcacctttgaaattaaacactcatgtttttatttaagaaatagataaatgataagtgctccataattatagtgttaccttacctctgataatgttttctgctttcttaatgaacaaattgaaatattcctgactgattcctatacataccatgagtctctgctcagataaattctaagcatacatgtttcttaaaccatgtattgaatgtcattgaatttcaatcatctaatataaatgtaatagcacaaaacaaatggctgtgctatgagatgcacacaaaatataaagaaatagttttctagccatgaaatgtttaacaaattttgtgtcaaaagatgtaaaaattaaatgataaaaaaatgcatttttttgtgattaaataaaaaacaaacatcccttctcttatcctctctaggattaaagccaaaattgcttattaaattcgtagtattacacactgcccttaaaagtgttcattaagttgattaacaagaaaatgtattaaaaattattcattaaattattgagcaaaacacatttctggttttcttacatagctaaacatatgctaatcagaaaacccagttatctgacttccagctatttactcaggaaatgaaaattgtattatttatccattgctcaaaactgtataatacaaggcgcatttacaaggtcaaattaacaggacttggtgactaataaattgcatgtatgagataaagtgacttagaaaattagttaattattttgccatgtcatttcctgagataggaaatactagaagagaataaataagatactcttaatgtatgttctcacgaatttcaaataatgcattgtgtattgatagatgaatttacactactttctttgactatggctttataactcactttttttatactattaaaaaacaacaacaacaacaaaaaacaaaagatgagctggatatcgcggctcagacctataaccccagcactttgagaggccaaggtgggattgagatgagaagtttgagaccacctaggcaacatactgagactctgtctctacaaaaataaaataaagaaataaaaattagctgggcatagtggcgtgcacctgtagtcccacctacttaggagactgaggtgagagaatcacttgagcctaggagttcaaagctgctgtgagctatgatcacatactgcactccagcctgggcaacagaatgagacatgtctcaaaaaaaacaacaacaatgaaaataaaaaaagatgctatattaatatccttctttcagagccatactagtttataaaaataaatgtgtattcaaattacaacagtaagctgggtgcgatggctcacgcctgtaatcccagcactttgataggccaaggcggacagattgtttgaggtcaggagttcaagatcagcctggccatcatagtgaaaccccatctgtactaaaaatacaaaaattagccaggcatggtggcacatgtctgtaatcccagctactcaggaggctgaggcaggagaattgtttaaacctgggaggcggaggttgcagtgagcagagatcatgccactgcactccagcctgaatgacagagtgataccttgtctcaaaacaaacaaacaaacaaaaacagaaatatcttgcattgttgagaatgagacatatattttgaaaattcttctatgatattacaaaaggaaattctaagacacatttaaattaaataatgaacatgaaagtgttcaattacagtatttagtactaacatgcaagtatttccagctagtggaattataagttaatacaacttttgaggaaataatcagtgagcaaactccgttgatggaaaatacgtaactttttatttattaggtttattagtttgagatctttttaatttaactggcattatatatatattcatatttaaaattaattgtgaacatgtgttaatgacatatggtcctaacaattaattaaagtgatctgttttcatttgctaatttttaagcttgaacaatgaaaagaagtctttccttaataagacataaacattctctatggcacagatccacattgaagcatattgttgccatccttctgaaccaatcaagaaaaattaaataaatatgatttacacctaactaatttataaatatttccataggttcagaacaatagtcaatagacctaatggatagccctgaaatcctcatttttacataagtatttctgaagcaagtggtattaaaaaacttcaagaaatatataaactggaaattattctatgtatagatgtgactgtacatttctgtaagacatggatttttttcatgtcatataaaattcagtaagaaatgaagaaaatgcctgcatgtcccataaatatcatcccctattagcacaaaattatggaattgttatttgacttcttagtttacttagtgatctggttgtattcttcattatccacttaagagttacagtcttaaactgaggatacagaatactctgaaaacatgaatataaattttaaagaataggatgagaaaaacagtggattgacaggtaaagacaggctggtgtaaagggggtcaggcaatttgaagaaaagccagcaaactccagggtcaccattcttagattttggatccaggctgtaaatttcaatgtcttgttaaccctcaggcaaattgggaactaccgcaactgtaaaaaacacatcttctttactgctttcaattctaaggcaaattttaaagaaataatatttgttaaaatactttttgtcatgaaagcatggtagccttttgggagaacatttagaaaatatataaaagtaacgaggaaaatgaaatgatctggattccatctagtcaagtagcacttgaatttctttaaacatacttacatatatcgacacacatgtgtatgtttgtgtgtgtgcatcttttaaagtaaataatcttaagaaaatataacacacagactaatgcacaaacaataattctacagcttaatgaatttttacatagagaacacacctatgtaaccactactcataacaaaaaacagaaattaatcagcactccagaagctcagctttgtgatcatttctgtcgctattcgatcttcttcttcaaagtgacccgtattctaatttttatcaccatgtagggattatgcctgtttttgaagtttatataaatggaatcatatagtatgtgttatttatgttctagaaacttaggttcatgaaattaatccatgttattacttatagcagtagttcgtacattctcagtacttcatatgattccattgcatatataaaacacaatcctgtataaccatctactatcgatggacatttgggttgtttccagattttgactatataatgatgttctgaccatctttgtacgtgtctttaaataaaaattttatttaactttaaatacaaaaatgtgtgcaaatcacatatgaatagcaacataaattttcaaagggtaagccaacatacaaataaagaaataagccatcactaatacccaggaattccctgctatgcatggtaattattaagtgactactgaacactgtgcatgaaaaaatttatagaggcttgggataaagttacattactaaaaaaagtatttgcttttgcttctgttaaaataagggcagatcacctaaatccaatcagagtttcaatactgggtttacatttgagggaggtttggtctttttcccaagcaccatgacttgcatggtatagaacttctgtgaccccaacagaaagcattgggtatttaccaagatctgtcctctttaatagctaaaaaaataaaaaaaaataaaaaataaaaaaaatcacttgactccttagccccatgactgctgcaaaaccttttcagcttcactcaagtcacttcttagtgctcaggattttagcctctcactacaaatcacttactaattaatggaacttgcatttttttaaacaaaaggtggataattctctcatgacagtatcaccttgctttttcctcctcctttttatttatagttactaaatatttaataccatagcataccaggtttcttactttccaggttaatattctttctctctgtacctttgctctcagccttttgtgatcagccccacactgtgacagagctaggtagaggttctgtgctgtactcaggctttgattagagagagcagtttccagcttgaatcacttatgaagatagtcattgattgtgcagaagtcattgacctacataatattgactgcagcaggccagggatttaacttttaactaggtagcacacactactggtaggtttacctgcataccatttccgtaagctgtatgcttataagataatcatttcatgcctagtatatggtactcaaactcttggtttaaatgtacacctagaaaattattaaggtagcatttttcgatagcatgagctttccagaaaatgctcatttgatgtaccatgctattttataatgtactggttttatttttaaacagtcaaacatacaagcagcaaaaactacagaaatggcacatttcagagataaagcagtgtacgtgtgtataaacaaaagcttgccacccataaaatgtgaacaagataaaggtaaaaccgttttcctccaggaaatacttgacatttccaaaaagatgtttgccctttaatatcatcatttgcttttcccatctgttttttgaggtgggaagcttctttgcaagcttcttttttttaatttttttatttttttatttttattttttggaaagctaaggattagaaagaaaaatgagatgcttttcagatagacaaatgccagaatgactacttaaatgaattctaagtaaaaatagctcctctcacatttaatgcttgtgtttttctttaagacctcaactgccacagtaaacatagtggtgacagatgtcaatgacaatgctccagtgtttgatccttatctgccaagaaatttatctgtggtggaagaagaagccaatgcctttgtgggtcaagtaaaagtaagtggaatatttatatagatcttatatgtagtttttcaaagagtgtaagtttattacattttaattctcaaaagaaactcagctaatgtaatctgttaaatgactgtgctggatattcttcaagactttaaaaaatgaatcatatcctatatattttaattaactttcaaggatacagatttacattttataattattgtataatttaaacattgattaatgtgatagtatgctaatttaatatatatttttagtttctgaaattaaaacattttacagaaacatgtaattaggtatactactaggtatggatgtggacatttagacctcaaaatatatatatttagatttgaattcattacattaggtaaatactatctttagagtctaccgtgtgtttctaatattttgcacacacaccttttccagcactcagaagatttactcgtagtaaacttactcttagtgttcttctaagtgcttctggatctacctggacatattagccggtgtctgtggttcatttgatgaataattcctttattgttaaaacagagacagtacttcctcatttgggccattcttggtcttgaacataataattggtctagaagtcacaaagaagaaaaaaattggaggaagatgtgcacaatttgaagtatcaacctcagatgaggtgtttatgtggtcttcaggggaggaaagaatcttggtttagtgaggtgtgagccacccagatgttccaaacccagagttcagggtcctactccttccctgtgaaggttctgacttttccacagaaggcgtgctggtgctttcaagtgaggcttctctactgttctgctattcttataaccaggcacaagatctgatttttagctcaatctcctttaaactgcaaaaggagagggttgctttaaatggtgttatagagatcttgtgatgttcacaccatgtcctgagattttgattgaccagttgaagcttttttaaaagtcattttttcctttagatcactgacaatacttgcaactaccaactccacagtcattatcattatcattgtcactatctcaaattctggaaatactgcataaggcatacataaccttatatgtttatgccatcccaattcacataggggataatcttggtcattgtgatgttataaaatgccaactggtcttgataccaactggccaacaagcgattcaactccagcatcccatctgaaggctctgctccccacactgtagtacctctggtgtccaatggcttactgtggattctccaacagaaaatctggacacaaaatattcatgtataaatattttttgagaagtgtagataacagtgataaggaagtgagaaagtgaggcaaagaagagaaggtagccagtaacaagattgctattaaaccagcaatcataaggagaactgaaacttcactccaagggcaaactctagaaaaagatgcaaactcatgcatcagagttatctgtcctgatagttttaattgtccagttcctgagaggttatggaactggaaaacatatacactaaatcctgagagtaattagctgcaatgttggccaatgggctgccaagtttttggattttcttgcctccagtagaagcaagtagtcaaattccctcagcataatctgatagaagggcactgagtcaggctgtagatactgatggcagcagtggcccatctggagcagccactgcaaagacaccagctacagcagaggaggtatgacctgggctaaatgctccagggagccggtgggagcaaggagcaggcaggaacctaacccccttccaagttggcagggtgggagccctgccatcctgggtgtagctccagctgcccagctgtggctgcagacctaggcatctctgtgctctcagggatccaggaagctcccctgcccccacagagtcggaagtgcctgttccccctgcctgacctcttccagctcctggcaccccttccaattttgaagcaaagttcaggccgagcccaggtgctgtcacaaccaggctgggtgtgtgcgtgcttgggttggtgctgacatgccagccccctgccacctcagcctcctgtgaactttgggcgccaatgaacataggagggaggccaagaggggacagagggctgctcactgtgggcctgcaggcacttctcctcataaacagcctgggcaccatgaacaacatgattgatggcagcagaagacaggctcctgggtggaaagtggggtgtccctggtgaagccccaccttcaagccagggatggcctgaagcctggggaccagcccatcagttccagtggagtccgtggcccagagtgaaaacttacggtgcttttaccgggcctgcccatggccacccgtggaccaatcaacatgtacttcctcctttctgagcccaaaaaaaccctggagccagccagcctcacacagacatcaagaataccagctgcagggaggagatttcctcttcgtgtctcctgggaccaccttctgcagaaaggaactacctattccgggtcttctctctgctgagagctggacacttatggggataacctgcctatggataggagctacacacttcggtctcttgagagctgttctgtagctttgtaaagttcctctccaccttaactctccagctgtgcgcgtacctcattcttcctggatgtgggccaaaaactcgggacccaccaaatggcaggaatgaaagagcggtaacacaaacagggctaaaaccttgtttagctgccacccccctcaccatgtggcgagcaacaaaaaggagagaagagttgcggctcttcagggagcccctcatccagacgcgggtgctcacagcagaaggctcttgccctgtatctgattcaatctaaggtttgctgggagagggcggctggagctacccgtcccgccaaagcagctagcgtgcgtggctatgcacagtgacaagaccctgcacttgctcgctcatgcacccatcgctgctctgaacctggcttgccctggcaaagtgtcggatttagcccagtagcatgagccaagcacagcctgccaggtggagtgggtgatacaaacacagctagtccgagcaaaacttgggcaaaggcgccaccacccgcagaggtttctggctggaaaagcaacacccttaggatccagtgacaataccaggaggtggaagttggccaaagcataccaaatgctctgagggacatgcataggacactgacaagtttggctacaccaagaaaacaaggtaataaagtctataacaggggcatgtgcaaaaattatcatcaaaggagaaatgctgaagttgactcaagaaggaagaacacaggtaagagagaagttgagagaagttggaatctgttagggaaagttagttgtataagtaaaggcacagagaaatcagagtgtgacatagcatagttacaatgaataagacgtaccatgtcataaacacttttctataccatgttgtagaaggtgacgggggagccactaaagggtctgaggtatggcaacatctgatttgtattttataaaaattactcctgatatattgaaatgggagattctaaatccagaaggcagaagtaggaggcaattgtaataaaccaggcatatgaggcttgaactaatgtaatcgtctttattaatgataattaagttatattacagttgtcagtttaaaatgccacattgctgaaaactgaaaaacttcacttagccatatatatattaactattcagttaaaaacaaacaagcattgaaattatttacaaaaatgatctttcccattttcttaatttatttagcttggagagataaagcccagatggaatatataactaaaaacacacaagtagacatcaacatgatgattagtttttagttaaatttcttttcctttttttcttattttttttttcccgcttttcctagtgattctttgttcttgaattattgtgttaaccttgttgttgtctcctggttcttaaatttgataagaaatggcctctataatttatttcagtttttaaaattgaaatatggaccttagcctggtctttaggcaataacttgttttcataaaaactaaaacgatgttgaaagcaaaaaggaagaggaagacatccaaggcaggctgcatctaactgattctgcacagtgtaatgtttataggatggaattttgatgctcataatggttgctacctaatgataattatatcatatattaatttcactaaattactcatgctctgcttgtaaaatttaattttaattgtcatcaaaaactattaagacttaaaaccaagatacatattgttaattactatactgaatttgagttatcaactttgtgtttatattctattgatattttaatatgaataatccaatatttgaattaaaatgctgaagggagttttcatttagttgttttttgtttttttttttttttttttttttttgagacagaatctcactcttgtcacccaggctggatggagtgcaatggagtgacctcggctcactgcaacctctgccgcccaggttcaaacttcacctgcttcagcctcctgagtcgctgggattacaggcaacctccaccatgcccagcaaatttttgtacttttagtagagacaggtttgtgccatgttggccaggctgatcttgaacttctgacctcaggtgatctgcccgccttggcctcccaaagtgctgggattacaggcctgagccaccacacccggcctcatttagtttttaaaggtagtgttgtagtaacaaataataactaaggaatacttttgaagcaaatttatggattatacatagcaaaaagttttatccagcatattaaaaaataacctaccaatcaacaatttttaatgtttatctttttattcacaaggtatcatattataccttgtgcatttagaattgaaaactgtaacaatatgtatgaaaagatatactcaaaacctagtaaatacagtaagtatatactctgtgtcaagtgtcaaatgggtgctataaattctttactgcaaggaaaaagagacattataatagactgaggtggccaggttagggttcatgagaaaagcagattattcttggttcttttcaatgtattagtgaaatctttgttggaaatttaaaaaaaaaaggaaataaaaataccagccaaaaaaatgtaatatgaaatataatccagctgaagaagcaatttgaggactctaagtcagtattctgacaataatggaagagctgtttaaaggagttctggaaaaatgattaaaaatacattgagttcagatggggcctaatgaaatagtgaatgatatgaagacttagtgtaatattttgcctagtatccttgagagtatttcacaggagatagaatctagaggatttgtatgcatatcttgactgtggaccacaagcatgcaaataattgatctttagaatgggtctcagatatgagaggcctcttactagaggcctcatactcaactgcagaactctcagatgatcccaagtctttgggggagcagatgccagtagaagcccccaaatgcagtcatattctgatcaaatctgcaggcctggtcctggacccctcaagtctcaaaggaataggcatttgggaatatacaacagcagagcatgatataacttctgtgaaggtccattcagcctttagatagactgactctaagccagtctactaaatcagtgtccagctttccagccacttacctttaaaagcctgttttatactggactgtgacttctagactcaccacacagggatcccggacttctcatcttacctaacaaccctcacctcttatgctccttacatactttaatgagacgaccactccctggtcacttggttcatcctgtcactagatcacgtgactccatgaatccagacccagcatcccaacaagatggagaacttaatgaacagcttaaaatatgggccatggaataaaactacctgagttcaaatttgacttgccaaaataactaatgcaatcttggataactaatttagcttctctgggactggatttcgctatcgcaaaatggagataataatagaattcatctcaagtagtgatttgaaggattaatacatacacataatatatgtacaggtttaaaataaggaatgaagctaatatgcacttaatttttattataattatgttaaatactaaataatttataaagtatggctacgtatattatagaaagtaatattttttacaacactatgaactaaatgcaaacaattgtttatgatttttcgaaatacggtagttgcactcttgcatttgcctaatattaccatatttagagaacattttaatggaagtactgttcttaagaaactataaaatcttaagttgataaatgattttcttctactgcatcactacaaacaatcatagtcagtcagattataaacagcgtttatcctttttaagtgtgttagccaaagcttggtctttgataataacaaatgtacaaatcaacatttagtacatgaacatatatatgcatatagtcacatttgtaggatattttagaaatttaaaggaaatgaaagatatttgttattatcaaaatagagctcatggttgcgatcctgatttttgtatttttgtttattcatcttaaaataagtccagctagtgggatatgtggagcttgcattgaaagaagcatattggatagactgacagctctagtaaaaaatcagtaataatgactatcaatttttgaattcttacaatgtgccacgaactattctaaatgctttccattgtacatatttgaattactttcaaatgtttggtcttaaccactctactatacaggattctccaatgaccatgcttcctgtgacttgctcatgcgtatctgaactgaaaaaatacaaacatgcgttaggtggctatcaaagtgttgttcctggaaaagcagcatcagcatcagcatcagcaccaatagaaacaccttagaaatgcagactgctatactctataccacagagattgaatcagaaaccctagtgttggggccagaaatctgtgttttagtgagctctgccattgattctggtttatactaacctgtgccatgcacaagcgcatgtgtatatgtaagaaagagagaaaaaggaaaagggagataaagaaatattatgtgttagaggaaaaatataaaattcttttatgtattatgtatttacttattgttatataagataaatagggtaaagctgggtctgttgttggggttatgcataattattattgtattactgttattgtgcatactcccaacagtagacccaatttagcctaaactagttactttacataacaataataaataagtcaatttcttgtcaaatgttcatgtttaaaagtggcataatgaaaatcattttcatttgtagcaatatgaatggaaatggaggttattatgttaagtaaaataaatcaagaatagaaagacaaatatcacatgtcctcactcataggctggagctgaaaaagttgttctcatggaaatagagagtagactgatagataccagaggctgagaagagtggtggtggtggaggatggggctgatgaagaaagttgttacaaacatactgttagaagaaataagttctggccaggtgtggtggctcatgcctgtaatcccagcattttgggaggccgaggcgggtggatcatctgaggtcgggagtttgagactagcctgaccaacatggagaaatcctgtctctactgaaaatataaaattagctgggcatggtggcacatctctgtaatcccagctacccaggaaggctgaggcaggagaatagcttgaacccaggaggcagaggttgcagtgagttgagattgcaccactgcactccagcctgggcaacaagagcaaaacttggtctaaaaaaaaaaaaagaaagaaagaaagaaagaaatatgttctaatgttagatagcagatatggtttggttgtatccccaaccatatggtttggggatatgaccgatatggtttggttgtatccccacccaaatctcgaactgtagctcccataattcccacacgtcgtggaaaggaccaggtgggaggtgactgaatcatcagggcaggtctttctcatgctgttcttgggatagtgagtaagtctcacaagatgtgatggttttataaatgggagttcccctgcatacgctgtctttcctaccaccatgtaagccaggactttgctcctcatttgccttctgccatgaaagcaggcctcctgagccatgtgaaactgtgagtcaattagacttctttccttgataaattacccagtctcaggtatgtgtttattagcagcatgaaaacagtctaatacagtgaatgggtaccagtagagtgtggtgctgctggaaagagacccaaaaatatggaagcaactttggaactgggtaacaggcctgggttggaacagtttggagggctcagaagaaaataggaaaatgtgggaaagtttggtacttcctagagacttggagggctcaaaaggcaggaagatgagggaatgtttggaacttcatagagaattattaaatgactttgaccaaaatgctgatagtgatatggacaataaagtctaggctgaggtgatcttagatggagatgagaaacttgttgggaactggagttaaggtcactcttgctatgcaagagactggtggcattttgcccctgccctaggaatctgtgtaactttgaacttgaaagagatgattcaggatatctagcagaagaaacttctaagtggcaaagtgctcaagaggaaacagagcataaaagttggagaaatttgcagcctgatgaggcagtagtaaagaaaacctcattttctgaggagaaattcaaactagcagtggaaatttgcataagtaaggaggagccaaatgctaatcaccaagacaatgggggaaatgtctccagggtatctcagagacattcatggcaggccctccaatcacaggcccagaggcctaggaggaaaaaatggtttcctgggctgggtccaggacccctctgctgtgtgtatcctcatgacttagtgccctgtatcccagccactctagccatggctaaaaggggccaaggtatagctcaggccagggcttcagaggttacaagccccaagtcttggcggcttccacatggtgttgatcgtgcaggtgcacagaagtcaataattaaggtttgggaacctctgcctagatttcagaggatgtatggaaatgcctggatgtccaggcagagttatgctgcaggggcagagccctcatggagaacctctgccagggtagtgcagaagggaaatgtgggtgggagcccccacacagagtccccactgggacactgcctagtggagctgtgaaaagagggtcactgtcctccagccccaagaatagtaatccactgacagcttgcactttgggcctggcaagtcgcagacactcaacaccagcccatgagcccatgaaaacaaccaggagtgggagctttacccttcaaagtcacaggggtggagctgcccaaagctgtggaagcccatctttagcatcagcatgacctggatgtgacacatggagtcaaaggagatcattttggagcttcatgatttgacttccccattggattttggacttgcgtggggcctgtagcccttttgttttggccaatttctctcatttggaatgggtatatttacccaatgcctgtatccccagtgtatctaggaagtaactaactcacttttgattttacaggctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgggatgatatggtttggctgtgtcctcatcgaaaatctcaccttgaattataatccccatgtgtcaagggaggggccaggtgaagataattgaatcatgggggcagttttccccacactgttctcatggtagtgaataagtctctcaagatctgatggttttataaatgggagatcccctgcacaagctctctcctgcctgccatcatgtaaggtgtgactttgctcctcattcaccttctgccatgattgcgaggcttccccagccatgtggaactgtgagtcaattaaacctctttcttttataaattatccagtctcaggtatgccttttttagcaacattaggacagactaatacagcaactgtggttagcagcaatgtgttgtatattttcaagtggcttgaagagagaacttggaatgtccacacacagaaatggtaaatactctaagtgatggacaccccaaattccctgatttgatttttacacattccagcaaaatatcacatgtaccccataaatatgtacatatattatatatcaattaaaaatggcataatcccaacaatggacttggatgtgcctctcagaatcttatttattcctaaaagagaattgaaggatttcctgggaataatttatgctaatgtgtaacagtcagacagatgaatctggtctcattataaacctgatgtcatcagaagtaggagaacatgatgcatagttcaacatggtttctgtcattttcatttgttttctcaactaatgttctgtgaattcaatcatcagtctgggttagaaagtgagaagataaagatctatttcagtaaattctgtctaagatacatgatcatgagaaaaacttctttgtacttattaacataattcagcataaaagaaaaagaggtggccttttacttcagcacacttatcacactatatgctttagtgcatttctgtatgtgagacatgggtggatggaggttgaggggggagggaagtggaggtaggaaggctttcagctaatatcagaggtgtctggcctttgtaggagtatctcattgaggagtctgctaaggtcagaattctcaagtttaaggactaaattatttatctctgtttttcatagcaaccctgggcataaatgcttgcacaaatgcattagagaaggcacacttggaaactatactgcctgttaaacaatgtttaaacaaagattaaacaatgttctcagcattgtataatatagagtaagctgattcccagtaaacttccatgtaataccttgtataaatttttctactgaactgacttctttgaggtctaggtaacaaaaatagaaccataagtctacaacatgttcttccagttctaaataagaggctgaatttatttaacttaaaacacaaatgtattcccagtatgagacctgcatgctaaatcttagctaagatattgtaggaatgtttctgtcttaagcacttaaagaagttttaaaatcattagtaaactacagtgtttggaagggtagtgatacagtcattaaaaaaatgatgtttccttcaactatacaatttaatattaaacaaaataaatctgaacctcagtggcctaactctgattactatagttgtctccctgtgtggggttctaaaactaaaatgaaggtggagagcattatggtgatttcttattttttgtagctcagtatgacactcaacagtgcctaaaactgtaataattcttttttaagtgggctgcaagtggggaattttatgagttctctttttaagccaaactatataatgcaaaccctgtaactcattctgataaagaaaaaagcccacacaatttgaaaaattggttatgtcaatataaatgtgctacataataatatttacaatagaaatctacctaatgtctgtgactatttttgaaatgtggtcatgtttcagatattcaattagcagctcataaatagattagaaaattttaagaatatatttttacaatatttatttagggcctacccctttagcaatgtttaggcttaatatcagctattagaaaaatacacattattgtgtgtgtgtgtatgtgtaaatatttatagttgtgaaatcccagctatacaatgaatgatatctgtgtccactttatggtcacaaatgaccactgtgcttttaaatgttatctttatctaagtcactttactgctctattgctataggatctctctctgtctctcttttttcttaagattctactacctgcttgctgctagttttcatgtttaagcacatctaattctgtcttccccttatctgtttgctccttaaactttggattttgaaagtatcatctaagttgcccttttgactctatgtattccttttttatcaattgcaattacattaaagccgacagctttacttacattgagatgcttattttccttctactcctttaagctacagcctcaaatagacatatatctgtaaaatatccacttgaatttccagaaagcatctaaatttcaacatttttaagattgaagtcttattttcgtcttccccagaaagggctccttctgaattctgtacctcaattaactattccccaagccaaatgctaaggagccatctaagtctcctctttctctctcactctccatatccaagtaatcaccaatattgatcattttacatgttacaaatttttctcacattctctctctcataacaaccataatcaggctcttattatttctcacttgaactattgctacagcctgtgagttagttatcctgatactggtcttgacactttataattatctgtgatgtaaattctggaattatgtctctaactaacaaataacttaagtacacaatatggttattattacccacagaacaaacaaaacacagtacccacctcacactattactttgacaactttatctctagccatactcacttgctcacaattgctaatatatgtctctttgcatctgtttatacccccaccttgattttctttttctccattttttaaagataactcagatacttgaaaatttagccactataatcttttccagaaaatcttttgtgaactttcctataccctcggtgttttctattcatggtctcatgtaatactgtgtacaaattttgatagtaattgctagagtatatttatgttgtctatttatctaaacatcttgaaagtagagattgatgttagaaatttcactacatagcccaacgcttggcttagcccttgcataatgtatgtacatacatgaaatgaaactaaatttaatgacataaaattatctaaaagtaaagttttgtaatgaagattcctaaatgtaaaaagagaaccggtaaagtatatgtcagcatctaaacatacatatttgtcttacctcacaagcatacaaacacataaataagttctcttgacaaataaataaaaagctttgatattggatatatgtccacttttagaatttcagtatgtgtaagagtatacttacatgtactagtctgttctcacactgctaataaagacacaccttagactggggaatttataaaggaaagaggtttaattaactcacagttccacatagtttggaaggcctcaagaatcttgcaattatggtggaagaggaagcaaatgtgtccttcttcacatgggggcaggagaggttcagagcgaagcggggaaaagctccttagaaaaccatcaatcttgtgaaaacgtagtatcatgagaacagcatggaggtaattgccctcatgattcaattacctcccactgggttcctcccacaacacatgcggattatgggaactaaaattcaaggtgagatttgggtggggacacagctaaaccatatcattctgcccctgacccctcccaaacctcatgtcctcacatttcaaaacacaattatgcccttccaacagtcccccaaagtcttaagtcattgcagcattaacccaaaagtccaagtcctaagtctcatctgagacaaggcaagtttcttccacctaatagcctgtagaattaaaagttactacttcctagatacaatgagggtacaggcgtaggataaacacatgcattctaaatgagagaaattggccaagacaaaggggctaaaggcccaatgcaagtccaaaatccaagagggcagtcattaaaccttaaagtttcaaaatgacctcctttgattccatgtctcacatacaagtcatgctgatgcaagagtgacactcccatagccgtgggaagcttcaaccctttggttttggcgggtacagcccccctcctaactgctttcatgggctgccattgagtgcctgcggcttttctaggcacatggtacaaggtgttggtggatccaccattctggagtctggaggatggtggccctcttctaacagcttcactaggcagtgccccagtggggactctgtgtgggggctctgaccacatgtttcctttctgcactaccgtagcagaggttctccatgagggcaccacttctatagcaaactcctgcctggacatccaggcatttccatatttcctctgaaatctaggcagaggtttccaaacctcaattcttgacttctgtgcacccacaggaccaacaccacatgtaagcggccaaggcttagggcttgtgccctctgaagcaacacctggacctatacattggccccttttagccacggctggagctgaagcaggcagaacatggggaactatgtactgaggctgcatagtgggccctggacctgacccataaaaccatttctctcctagtcctctgggcctatgatgggaaaggatgctgtgcaggtctctgatatgccctggagacattttccccaatgtcttggtgattagcatttggttccttgttatctatgcaaatttctgcagcaggcttgaatttctccccagaaaatgagtttttattttctatcacatcatcaggctgcaaattttccagactttaatgctctgttttctcttgaaccctttggcacttagaaatttccacaagataccttaaataatctctctcaagtttaaagttccacaggtatctggggtaggggcaaaatgcttctagtctctttgcatagcaggagcgacatttactctatttcccaacgagttccccatcttcagctgagaccacatcagctggacttcattgtacaaatcactaccagcattttggtcaaagccgttcaacaagtctctagagagttccaaagtttcccacttctttctgtcttcctagccttccaagtgtttaggaagttccaaactttctcacatttttagatcttcttctgagccccccaaactgttccagcctctgcctgttacccacttccaaatttgcctccacattttcaggcatctttacagcaaccctactttctgtggtaccaatgtactgtactagtctgttctcacattgctaataaagacatactcgagacggggatacttacaaaggaaagaggtttaattgactcacagttcagcatgtctggggaagcctcaggaaacttacgatcatggtggaaggggaagcacacacatccttcttcacatgatagcaggagcagagaaatgcagagtgaagggagagaaaaaatgcttgtaaaacatcagatcttttgagaactcaattactatcacgagaacagtatagaagtaactgctcccatgattcaattacctccaaccaggtccctcccatgacatgtagggattatgggaactacaatcaagatgagattttggtggggacacagccaaaccatatcaatacagttgatttaaaaaacagtgttacaacaccagaatctcagcgatgcagcaaaagtagcattaagaggaaagtctatagtgctaaatacatacatcaaaaatatagaaataactcacattaatactctatcatcatgcctggaagatctagggaaaaacaaacaaacaaacaaacaaaaccccttatgtctagcaaaagagaacaaataactagaatcagaaagaactgaattaaattgaggccccaaaatctatataaaggatcaatgaaaccaaaagttggttcttcgaaaagatgaacaagatttatagacctatagctagattaacaaataaaaagagaggaaatccaattaagaacaagcagaaatgacaaaagatgacattacaattaacctcacagaaatacaaaagatcctcagatgctattatgaacacatctatgcacacaaactagaaaatgtagatgaaatggataaattcctggaaacacacaagctcccatgattgaatcaagaagaaatcaaaagcttgaacagaaaaataatgagttttgaaattaaattagtaatgaaaaatctaccgatcaaaaaatgcccttgaaaggatggattcacagccaaattctaccagacatacagagaagagctggcaccagtcctactgaaactattccaaaacttcgagtaggagggactccaccctaacgcactctgtgaggccagcattctgatactaaaatctggtaaatgcacagttaaaatggaaaactacaggcccataccactgaggaacagagacataaaaatcttcaacaaaatactacctaactgaatttcacagcatactaaaaagtatctcaaaatgacaaagctgggcaccatggctcacacctgtaatcccagcactttgggaggccgaggagggtggatcacaaggtcaggagtttgagaccagcctggtaaatatggtgaaaccctatctctactaaaaagacaaaaattagccaggcttggtggcgggtgcttgtagtgcaagctacttgggaggctgaggcaggagaattgtttgaacccaggaggcagagactgcagtgagccaaggttgcgccattgcatgccagcctgggtgacagagcgagactccgtctcaaaaaaaaaaaaaatcatcacaatagatgcagaaaaagcttttgataaaatccaatatttcctcatgataaaaacccacaagaaactaggcattgaaagaaaatacttcaaaataatcagatccatctatggcagatccacagccaacatcatactgaacatgaaaatgctgaaagcattcaccttgagaactggaacaagagaaggatgcctactctaacccctcctatttaacatattaccagaaatcttagttagagaaatcaggcaaagaaagaaataaaagacatccaagtaggaacagaagaagtcaaaatatctctcctcactgaaattattattctatacctagaaaaccctaaagactccattaaaaggctactgaaactggtaacttcagtaaagttttaggatacaaaaatcaaggtaaaaaaaatcagtggcatttttatgcacaaataacagtcaagctgagagccaaatcaagtgtgcaattacatttacaatagtcacaagtgaaaataaaatacctaggaatgcatctaaatttggaagtggaagattgctacaaggagacctacaaaacactgctgaaagaaatcatagatggcacaaacaaatggaaaagcattctatgctcatggattggaagagttaatatcattaaaatgaccatactgcccacagcaatctgtagatgcaatgctactcctatcaaactaccagtaccatttaactgaattagaaaaaaaaaaaactgttctgaaacttacatggaaacaaaaaagaacctgaatagccaaagcgatcttaagcagaaagaacaaaaccaaaggcatcacattatcctacttcaaactatactacaagcctacagtagtataggctacacatagacagacacataggttaacggaacagaatggagaccccagaattaaaccatttgattataaagtcaacaaaaataagcaatcagaaaaggacttcctattcaataaatgttgggataactggctatccatatgcaaaagaataaaactgcactcctccctttcagtatgtataaaaagtatgtcaagatgcactaatcacttatgtaagatgcaaaactataaaaatcctggaagaaaacctaggaaatatcattctggacatcagccttggcaaagaagttatgactaagtcttggaaacaattgccacaaaaacaaaaattgataagtgggacgtaattaaactaaggagcttctgcaaagcaaaataaaatatcaacagagtaaacaacctacagaatgggagaaaatatttgctaactatgcagcttttagatgtctaatatcctgattctataaagaacttaaaataattcaacaaacaaaaaagaaataaggccattaaaaatttggcaaaagatatgagcagacacttctcaagacatacaagcagccaacaaacaaatgaaaaaatgatccacatcataaatcatcaagaaatgcatatcaaaaccagaatgagataccatctcacaccagtcaaaatgactattattaaaaagtcaaaagataacagatgtttgcaaaggtgtggaaaaaagggaatgcatatacactgttggtggaaatgtaaatgtggatatctccaaactgctttctgcagtggctgaactaaaaacagaactaccacttgaaccaacattcttatagctgggtatatacccaaaggaaaatacatcattctaccaaaaagacacatgcacttgtattttcatgacagcactacctacaatcgcaaacttatggaattaacctagatgcccaacaatggtggatttgataaagaaaatatggtacatatatagcatggagtactaaacagtcataaaaaatgaaatcatgtcatttgcagcaacatgaatacagctggagaccattattttaagtacattaatgcagggacagaaaaccgaataccacctattctcagatgtaagtgggactgaaacactgggtacacatggacataaagttgggaacaataaacactagggactactagagaagagactgggggaggggcacaagggttgaaaactgaaaaaaacaaccattgggtactatgctcactacatgggcaatagaattattagtaccccagatatcagcattacatgatatgcccttctatgaaacctacacatgtaccatccatgcatgaatctaaataaaagttgaaataaaaaaaaaaaagtgattatcacccccaccccccaccacacacagcagtgtgaatgcaaagaacaattgaaatttatagttggtactggaaaaaatagcacatctctttacccactcatgggacaggcaaagataatgaaggcatttcccaggcgtaaaaactacatggaagaaaagtataacagacatgctatcagcctatttggtcatgtatttgaaattgtgttttccatttccccatttaaattatttaatgtatatccaagaagcaataccaagtaattttgcctcacaaacccctgctacatctatctagctatatattttaatgctacattacttatttatgagatcctactttatacaaattgcacttctgttttatagactgatgaaaattcatgacctattcactttagttcagttcagttttccttctctacaaatattataactcactacaattacttacgtggactttattgcctacctgaggaataagcttggcaaccaacttggttttacagaaagaattccagctatatccggagatttttattaagaccaactcttgtcctttaaactttaagaaaaaaaatgtaatacacaaaagtgatttaaagataaatgtacagtttagtatattattatacagtaaacataaatgtaagtccaaatcaggtatagaatgcatcaccagaaaatctttcttcatgctccttctcaggcgcaattgctttcctccacctagagttaaccactatgttaatttcctgggtttttttgttgcacatttaccatctaagtaagcatttataaacattatagtttagttttgtcttttttcgaagcctgtaaacagaattttagagtgtgtgtgcattagtatctgtcttctttcattcatatttaactttttactattcagccacatttctacctgttcattcatttatttgctgtttgtggctatgccacaatttattttcacattctcatgttgatgagtgtttgagagctctccagtttgaggatgttatcttcagtgctgctgtgaatatgtttatatcatttctcctggcgctcatgtgcctgagtttctctatgttatgaacatgtgtctattcaattttgttggaaatgcgaaattgttttccatagtaactatgccaagagttgtatatgagagttggtcatggttcctgtctgtgtgcttggtatgtcagtctttctaatttgagccaccttgttacggtttcagtgatatcgcattatgatcgtgattagcattttgctaatggcattgagaatcttttcatatatttacttactattttgaatttcgtcttttccgaaatgcctatttgagtttcttatttatctgttggagtaaatgtgttttcttcttgaatgttcttttttatctgtgggagttctttgattattatagaaatgagcccctcctttgttatatatgtttcaaacatttctcccattctcgagcttccatttcacttcctgcaagatatcttttgacacacagatttaaattttaagattatcaaatttatccatcattttgtaagtgttactattcttttgaccttgcttaaaaaatagcctacttcctcaggtcatgaaggacctgctttttaaagatttattgtcttgttattcgtaataggtttatcatctgaaatgatttttgtgtgtggagtgaggtgggagtataatttgttttcttctatataaatatatatatttcccactgactcgcaatacatattatcataaatcccatatacatgtgtatgagggtttgtttctgggctctctattctattgtgttggtttattagtctagtcttgcagcaatagcacactgtctcaattatagtgattttacatacagtcttgatacctagcagagcaagctctctcatctttttcatcaaattttagctattttcataggtgtagtgatttctttctgtactttgtgatttgttggcataaagagccaataatttctactgactaaccataaatattggtttaatgggacccttactatgtcatctcagtgaaaacatcaccccggtcttcagaaaaccaggatctctagtgcagcagagcctagctttgcaaggacgaaagtatgcctttcccaaatgggttagtcaagatgatgatgagagaggccattcccaccctgaacccttgatttgtcatttccatctagtcttcttatcaagaaaaatgtaccatacaatggtcattccttctgtggccctgaaaaatttcattcccaaattcatccttagctctatctttaagaggcttttccagtattctactaggtcagcactgctgggtggtactgtatattagtgccaacagatccagtggtcctatgcatatgattgcacctaactttgccatgagatgaacttcttggttggaattgatgttatgtgcaattttctggacaaagtcagaatagtcagtgtcctcagctattaatattggccaaatcactgcagcaataaaaaagcaactcatacttcaaatgtgtattaatcacaggaaagaacacaatgatgcggctttagtttacctgattttgatgtttttagattatataaatccagcaatagccttcttggctgcctttctgtatttgctttgggaacaccgtggttggatagccatccttatagatctttgcacttcgtagcagcttatttgacgttgttttttgctgattgctatgatacatttcatccatctgcctctgatattggagtatttccacctggattctgaatccagaattcttccactcacattgacactaaggaacacaagtttcatagcaacattcactaccctctactctggcctggtgaggagagccatcactgaacttttcaatgataccagagcacctcttgttgcacctttctatattgcttcagaattgggagtgctacctaggctctcctgaggaacaaaactaatagatggtttctctggtcatacataagaaatccatgctaaaatgcccacttctatatacctttaacttcaaatccctgtccaggcactttcactacctacaccttgtttattataggccactgtttttcacaacctttggggaataatccagcagtaccttagaatcaactccaggtgtcctggccacaattatgacaaagtatctccataccactaaactcttggtaagatgtacttttctcccttcaaccccttccaacataatcaagatctatcctcagtcatgtcctcctggtgctgccaatactataaggcatatcctgctgttctttttgggaataatccttttctactcatagcagggacagttagaacatgctgcaacttgactttagttattggtgcaaaagcaatgcagggacataggtacagaggacatctatcatcttgcttacaagatggtaaggtatctaattcagatgaagtcattacctgatctccaggcgagggatactgttctcatctaaaaatgaaaagaaagtgaagttttcagtctagaagttccagagaatcagtatgtttttttgaagtgtttgtagccacatgtgcccagaccagctctccttccctaccaatactggtgtggaagacttgtcagggagttgattgcatctttccttgtaattatgtcttgagaccaggggtagtggctcacctgtaatcccaccactttgggaggctgaggcaggtggattgcttgagcctaagagtttgagaccagcctgagcaacatggcaaatctctgtctgtacaaaaaaatacaaaaattagccaggcatgttggtgcatacctgtagtcccagctattcaggaggtgagaggatcacctgagctaggaaagtcaaagctgcagtgagctgtggttgtgccactgcactccagcctgggaaatgggagtgagaccctgtctcgaaaaaaaagaaagaaagagaaagagagagagagagagcaggttgtaattacatcttgagcatgattttgagtaaagtctgtcattgtctgtggatatggagcttctttaaacgtgctaatggaggtcattggtttttactctttacctctgaattgatattgctggttctgagcttcatttattctttttcaacacctttgttatatttagcaaccaatcaactctgtaagttttatgaattaatgttcaccgataaatctgaaattatacagatatggcattaaaccaggctccccattcccccatataccatatcagttcatctcaggtgaaggcttcaaatgaatcatgacttactctgaactcctgtacagtaagcatgccatttggctagcaaattagcaaattccaaaatctcatcttaagtatctgcttcctaggaccacttctgattcttgcattatcagtaaatctgtctgaaacatattccaaaggcaagtactcctcacctattctaaaccacaatcatttttcccctagattatgtaaatagtatcttactttttgacctgtgctacccctcttacagtcaatttctgcactacagcaagagtgatattttaaaaatgcaaattagatgacaccattttgccactcagacatttcagtggatgctcattgtgttagaacagaatccaaactcctttttcatagccttcatatctccacatgacttggctcctcctgctctctccaacatcatttgcatcactccactccagccacactgggcttcttgctgttcttgaacacagctacgcttaccaaaccttcaaatggattttgtacttgttgttacctctgcctggagcactctttctctaactctctgtgtgattcactctttcattcaaaaagacatcttttgcaaggatgacttcactgagtaccccatttcaatagcactctccctgtcctccagaaacaagtataccccctttccctttaccaacattaaattttctttacagcatttttgactgcctgcaaatatagcatattcctatttaggttgtctgcattcaaattctagctgcatcacttagtaactattgacttgggcaaatgatctaatccatatgaaactcagtttccttagctatgaaatggagagagtagtcctaattaataggattccctaaaacttaaaagagagaatttaccatcacccaagacgttacaaaaatgtctggcaatatttcatccatgggaaattgttatagaaagctgcttcgtgccatcagagcctccccagtttgacattcaacttgagaatgattcttcagtcatccctgaatctaagtcattatgccattatatagaaaacattttttttctatcttaattactaaaaataatctcaagaatgttactaatatcaaataatctcaagaatgttactaacatcaagaggtactgtatctattgtcatttcctgtatttacaaatattgtaaactaatgggaaaaatgtaatcattttgtcatgacttttatttaatacaagtaatgtgaaagtcaccgttgggattccaaacttcctgacagtgtgaaaactaaagtttaagagttctggatgctgttgaatgtcatttcctttttgaacccacaatattggatttaagtacctatatttatgtgctctcatagttcactttactttttcataatgtccattaaaatatgaagttgtttattttcgtaacttaatattttggttgacatttgtctttcccattagaatgtaattttcaggaggccgggttaaaagtcctgctgtatgctcttattatgcaatgcatatttactttattacttaggtttatcactgtaataatttttaaaaggcaattattttttaatatctactttttcaccttggttcaagtgacataagatcaaagaacacattactcttgtccttagttagagccccagccctgaaaatgttgttcagcttaaagtcaacaataaatgtgggtgaataaatgaatgaattgatggatgaaaacatgtatggttaagtcaaatcaaacttatagcataattattttgtaatgttatgaattgatgtatttggggaaaataatactattttttaaatttagttaacatttactgagaggcaaattcagtgctacactaaagcattaatgtgaacaaggcacattttgtgcccattagaacttgccacatgctatctaactggtatgtggcactgcattggcatctgcattcaacatccaactttcttgctttctttcttctttcttaatttagtgtgttaagccagactcttcaatttcaaacaatgtttaatattaagcatatacgtctacttcaggacttctttaaatagatttttttcctatttcaattcatgtgagatccaaaagggcctatttaaaagttacctgcaaccacataatattgatgaagttttagagtaaataattgcatccaaatcttcgtatattggcatgctcatcatttatgaagcttgccattacatttagacacacatatatgctaagcttgggaaattgacatttttatagagaattcaaaaaatcacatttgtagtgtgacactctagtggtaatgttttttcatcatgtctctgaaatgtatggtgcacactgacaggccatgcttttgtaaaatattcctaaacaagtaccctttattatatatatctccatacatacataattgtgtctaactggcatgtggcagtacattagcatctgcattcaacatccaacttcattcacagaacacatttagtaactgaatatagatgtattagcccattttcacgctgctgataaagacatacctgagacagggtaatttataaagaaaaaataggtttattgaactcacagttccacatggctggggaggcctcacaatcatggcagaaagtaaaaggcacgtcttacatggcagcaggcaagagagaatgagagccaagcaaaggggaaacctcttataaaaccatcagaccagacctcatgagacttattcactaccaagagaacagtatggaggaaaccgcccccatgattcagttatctcccaccaggtcccacccacaacacatgggaattaggggagctacaattcaagatgagatttgggtgagaacacagccaaaccatctcaatagcaaagatggcatcatttgtcatattttagttttacattttaaagaactaattatgactttttaagagtaattaagtaaacagtattaggaaacatagtgtatgttttgtatagtgcatgatttgcatgactaaataacaaaataactcattaataaatgagtgcaatggatatatatgttgtccttttcttcccccacccactgccctcacatagaatcttgggatgtgaagagattgtaggaaaacagacatagtaggaagcaattatattttctttctcatttctctttattttgtaatgataaattcttcagcaggtttgaaaactgatggcaatagatggagtaaagagggatgtagaaatgccagaaagagaggcaacagagtcccaaaagctcaagtgtcatatgttcccttgagaacctaggaggaagtggagttttcctcaattttagcagcaggagaatgataaagataagtacagatgttggatggtttatagatttattttgaaatgaatatttcaatgtttcaaaataattagtggaattcacagctctgggcacactatatactgtaattctcatgacttcatggtatgacttccatgacttatctgaagtatgtttttccttctgttagatatcatgtcagactagcttgccacagagtaagggagacattgagggaacccactgacaattctctgtaacttagatttttatttttctaatgaaatatatgtaaagtctgaggggctatgtaatgataaccttcaagtgtgtatttgtgtgatatggcccttaatccccatcatgaaaataattcagagtgaattctaaattatgtccagctcatctttctatctctggactccaatctatcatgcagctagaataattaataatgctacactagttatagcagcatcccctacctgcacaaaaattacaaacagatggcacattcatactctaaattcaaatccaaatactcttatttgctagctaaaggaaaatgaacttattttttgtttttctgaaatattcttggctgtaaaatatggacaataataactgccatactgggtgtttataagaactaaaagaaaaaacctaaagttcatcatatttaagacttctgtttctacttgggaaacaaattcaacaggaaaatatgagttacgtctctgggcacaggggtggaaaatgacaaatattagtttggatcaaaaaaatcaaaccctagactttttcacctttgaggtaataatgtagctggctgtttcatttgaaaacaatgaatgatattgtaataatttaatatatgtgtgtatgtgtataaaatttgctatattctgttaagcaaggattttatactctaagaaaaaaaccaatccaagatagaggcttgttatgaagactgtgtgccaagcagatctcccttgaaggtagagctgaatgtcttggctttttggagtgatgtagggatgaaggagtaaagagggatgtacagctgctagccacttcagagatgaccttatctacagaaggttcccttgcccatagtcacacccatttcagtgtagcccatatcctgactgatgcctgagtgtaaaatgctggacattttaccccagctcagaaaaactgtgacatgcaattgcaattctgcagctccttccttgggttggccaaggctgtagttgaccctgcacagtagtttgactttctccctgaatccaattctggtcttgtcctttgccctccaaaaatgttgacccccaaagcataccccaacaaaactcttgcaactaatctctgcctcattgtctgcttgccagagaacccacctgcaaacacctttatacagtatagctttttcttcaagtcatacaagaatcaaagtgagaggctcttttttaaaaaatctaagtgcagtctgcaaaataaataaatcagacagtatttctttggcttgctttcccactatttagtttatgatatctcagaagaattagttcattgggatttctgaaaccaagctctggaaatattccctatgtgtgtcataattcaaaacgtggatatatagcaaatacagcctctttttcactgtcttattccttctatgtgaacatttttatgaggagatcctctgagcccagtcttttctaatggttttatgacttctcagtatcatactcatccaactctgcacagacagatttctgtcaaaagcaatcagtctttatgaaagtagcaggagtaatgtttcctctgggcaaaccaaatcaaagtggttcacacttgtcatgttagacgtaacttcagtctccatttagactcctcagactttaagtttgaaataagtcaataacttctttctttattatctgcaaagattcttggtagataggttgtagagtttctgtttctcaaagcaatacacatttttaatacaagcatatttcagacatattgagagttctcttccagaccacagtaatacagcaaatgttgcaacaaagcgagtcacataaggttttaggtttcccagtgcatataaatattatttttacactatactatactccattaagtatactccatactgcaattagcattgtgtctgaaaaacagtgtccataccttaattaaagtgttttatggcttaaaaaaatactgtcaatcatctgaaccttcagcaagtcttaatctttatacagatagagggtcttgtctcactgtcggtggctgctcactgattaggagggtggttgctgaagttgggatggctgtgtcagtttcttaaaataagacaacaatgaattgtgctgcattgaatacttcttgctttcattaaatttttttctgtagctagtgatgctgtttgatagcattgtagctaaataagtttttttcagaattggagtcaatcttcttaatccttgctgcaaagtatataaaatattctaaattatctgttgctatttcaacaatgttcacagcatcttcattaggagtaggtatcatatcaagaaaccactttctttgctcttccataaaaagcaactcctcaactgttcaagtttatcataagattacagcaattcactcacatcttcaggctccacctctaattctagttctcaccatgtctatcacatctgcaattccttcatccaactgaagtcttaaacctctcttgaacctctcagagtcattcatgaaggaagaaatcaacttcttccaagcttctattaatgttgatatttttacctccttccatgaatcaaaaatgttgctattggcatctagaatggtgaatcatttccataagatttttagttcactttgcgcagatccatcagaggaataactatcaatgacagctataatcttatgaaatttatttcttatataataagatgaaaacctcaaatttactcctttatccatgagctgcagagtggaagttgtgttaacaggcaagaaaacaacactgatgtccttttacatctccatcagaactcttgagtgaccaggtgcattctcaatgagcagtaatgtttagaaagaagtcttttttttttcctgagcagtaggactcaaccatgggcttaaaatacttgctaaactatgctgtaaacatagtttatgcttccataaatatatgcttttattaggcattgttattccatttattgatcacagacagagtaaatttaacagaattcttaagtgcactaggattttcagaatggtcaataaatattggcttcaacttaaagtcaccagctcttagcacctaacaagaaagtcagcccatcctttgaaaccttgaatctaggcattgacctctctgttttaagttacggaagttctagatggcatattctaatagaaaactgttttatctacattggaaatctgtttttttagcgtagccaccctctacaaatatcttagctggattttctggataactagctgcaacaccttctgcatctgcacttgctgcttcaccttgcacttttatgttatggagatggctttttatttttcccttaaatttcatgaacccacctctactagcttcagacttttcttctgcagcttccttccctctctcaagctccagagaaaggaagagagttaaggtcttgctccagattaggctttggcttacgggaatgttgtggctagtttgatcttctatccagaccactcaaactttcttcacatcagcttcacatcaggttgttttactttcctatgatttgtgtttgcactggagtagaacttttaatttatgaaatatcttttccattgcgttcacaatgtggctaactggcacaagaggccaagtttttaagctttctcagcttttgacctacctttctcactaagcttaatcatttctagcttttaatttcaaatcagagacacacaactctttcacttaaacacttagagcccatacatagtggggttattaattggcctaattttaatttcactgtgtctcagagaataggaaggctcaaggaaagtgagaaagatgggggaatggtcagtgggtggagaaatcagaacacatacaccatctcatcttggaccatgtgtcaaaaaaatgtatacatagaacctttattaattaaatttgctctcatatggtgtgttctgcggcaccccaacacaaccacaatagtaacttaaaagatcactaatcatagatcaccataacagatccagtagtaatttaaaagtttgtcatattctgagaattaccaaaatgtgcctcagagacatgaaatgagcacacgctgttggaaaaatggtgccaatatatttgcttaaggcatctttgtcagaagccttcaatttgtaaaaaatgcaacgtccgtgaagcacaataaagccacgtgcaatgaaacagagtgtgcctgtaaacttaccacttctattttatctcagattccagttctagtatacagtatcatttaattctactgactagactgctcctgtggaacagttacactccataaataacatgtcattgaaaacattctgttattctcaggaaaatttctgcttggccaattgatattgaaatattcctcttattgcctacatgctaacaattaacaaaggaatggcatccaaatgaagtttcctacactttttaatctccaatctggcttattttacctttaccagaaagaaaaaaggatgttaataaagtacctggcccttttatatatctgtaacttctaaaaatgtgtgtatataattaatattaaggtaagcagcagtactgtttacaccacaattaaagaaaacaaactgacagcacttttcataaagcctgctgctgaggaatgattctaaaatagttacctactatttacatagtagcacacaggaaggtactaggaaagtatatctgaaggaaggcagctggaaaaggaaggacacagcagaatctgagttcataacttctaattcaaaaggcagtttcacattgtgtacatcttagctctttgaatgcagtcccagggagtagatagagaaacataagttgtttcttccaattaattctgttttcctaatttaaattactgtgttggacaagacattagaaaacatgatcctcagttacttcagtgaattgttgtcagcaaaatgaatacctaacatacatttttaaatcaaccaatttggagacatcccaaattaaggtaatgaaacagctgaaaattactaaactagctcaaggaatgagtgatgataaaataaaactggaacctatatctggctctatccctgtgatgttatcaaggtaggtcaaattgtgacaatgtgtgtaaaatagagaaaaacacctttaattttatgggtattgtttgggaaaaacgtgagcttatattcagcaaatgaaatgattgatagtattgggaaattaagagatatttttctctcattaaatagttattatattagccagaggcatttttattgctcttgttttacttacaattctgttaatcctttacttgaatgttatccagaaaatttaattgtatagaatttcacagagaatccaatctggctgtcacattcttttcagtttccagttaagaattttttttctagaaatgatacaagaaaatgatttgtgagacaatgtaatataatgaaaagccctgtgacagaaggacaatgcttaaggtatacattactcttgactcttcagagaagggcatgggcatgtttatattgaacccaacagaatactagaaaaaagaaaattaaaacttggattagtatataggacctataaaaacacctgataagcaaaatgtcacatattcaataagcatagagaagactatttaaaatagttattcagaaaacaaaccacaatactttgtgttataacttggcagaaaatgtaagcataatcaaataaataggaaggcctgggctaagcagattatcacataaaatgcaattcatggagatggtatttttcccttatttcattacttaagaagtgatgagtattgagtacaagctcagagataccctgagttgccccatatagtaatatggacagacattttagaaagtgatgccactgtaatgagtgctgaaagaacaatgcttatgtggaaatgtttatggtatataaggaagttacagaggactctcttttggctagagcatgcattctcaacggtggtagatcatttccaatgtggaaaatcaggttttgggagacaagaaaaccttacttttcttatgtataaagcatggataatatatatacataaatatatctgtggaagtacaaatttataagggttctattagaaagaaaaaaatcttaaaatcctcttttgacaggagttgataatgaaaaaggttaagcaatgctagaatagactgttaaaagttaaactaatatatttaattatacaaaaataggtatatatattgtacttactttaaaactgacctagaaatagatttccttaaagaattctaggtgactgatatggtttggctgtgtgtaccaacccaaatctcatctcgatttgtaatccccatgtgttgagggagggacctataatccccacttgtccaaggagcggggtgactggatcatgggggaggcttcccccatgctcttcttatgacagtgagtgagttcttactagatctgatggttttataagtgattgggagttccttcttcactcttttctgtcaccaggtaaagaagttgcctgcttccccttcaccatccaccatgattgtaagtttcctgagacctccccagccatgtgaaactgagtcaattaaacctctttcatttataaatcccccagtttctgggaagttatttatagcattgtgaaaactgactaatatagtgacaaaattgaaaacaagaaagcaataaaatgtaacaaaaggacaaagtttaataagtagttatgtgatcacttaagttttatttaaagaacaaaatgtgtcttattttcttatatttcttctaataaacagaaaacataccttcttttaagacaaaattataaatactaattggcaatttttatttcttcatgtgtttgggtggttggggtgggaatgatatgtaattgaaaaatggaaatagcttcagaagaaattttggcagaaattattgcatatctaacctatgtcattgcaaaaagaaaaataaagcaggcattgtatgatataaataagccatcctgtccttatgaattcttaatttcatgtgggctattaaaaaatgacagaaaaaaagcaatagggcatgtggtaaagaaacatacaatgagcttcaggagcatgaagatgaggcatttagcttactcagatgcttctgagaggtgatactagggctgaagaataatcagttttggaaataaggggaagattttatgactggataaagcagacatgaaatagcatggttagtatggcaaaatgcacttagatttagtggtaagaatatgttcgcccacagagaaaaagatgagaatgaagaagttggagaaatagaagtaagaagaggttggaaaactaaatataatttaatatataattttttttaccatcacataaagaggtatatacacactcaacctatactgcataattatcaaatactaagcaatggtggggaaatatgaaatgagtcctcccaggttttcctcttcgttttcagcactataaggaatatttgaaaaagggaaaagacagccttactatgtaaatacatttaatgaacatgaaacaacattactttctttctttgctgtatgagcgtgaacatgacaacaactcttttcctgaagcattgatgtcataatcttcaagtgtttaccattaacatgagaactgaatatgtaaaggtttttagtgcaaagtttcttcctaatgcttacttagtaagaggcctgcaggttatgttggaacagcttaaactgtcttatttaatttgacaccttcagttcatttgcgttaaataacacccaactacaggaatattgtttatttttatttgcttgctatcttttttttttccttctctaccatatttccatctgtgctccaactttccacttctcatacattgtacactccacaaaacaatttacagattcttttctctaacagtgtctcctattacataatacatggatacaccacagatttttaggccaattatttaattgcgtagcatacttaaatagcaataaaaagtgagttttgctatgtgcaagagggaccagaaggctggatggaaagaagaggtttcccagatgaagtagaactgaagctaggttttgaacgtttaagttggattgggggaaaataaaaacaaacaaaaaaaaaacctatatcagggaaggtgagggagagcatggtcatttcaaggaaaaccagggtagtacattgtaaaagtgtttctgatttatcactgtcccactgtgtgagggaatggaatttctgcaccccttgacatcggccttgtcatgtgatttgccttcaacgatgaagcaggagtataggtgatacgttgacctccaagcagaagcgttaaaagctgcagcttggctatctcatgtctttttttcttcttgcaccacatgagcttcatattccaatgaagcctgctcctttagcttctcttctgagtaaagacaagatagagtaaagctggatttggaattcacagtgggtgctgtataggcgagaaagaaacatcagtggtaacaaaccactgacacttgagagtttcttggtggtgattcataccataaatagactcctttgactaaaacacagagtttgtgtcagagagttagtctgagggatataaatgcataaagataggttagaacaagaccaggtagagccttgaatgctaggataaaatgtagtttattgtgtatcttagaataatagctgaccccttgagaaattatttgtgttaaatatgtgttttctagggactagatttctagggactagaatgaaaagctattcattctggttatgtttttagtgattttaattcaagttatgcaagttatcttctggccagtaagtctacttgccattgttcaataatgattatgaggcatttgtgtggagagtgaaaaaatttacctgcattatgagtctttaaattgcttgtctccttttacactaataatcacagcccttgaaatagctcagctccttaaaaaaaaaaaaaaaaagacaactattgtacatctttttgaagttaatagataataattttaaaaatgtattttcactaataatgtcatgaaggatgcactgcccaacctccctgatcaacagcttttatggttcccacttcaaagtgagaaagatgtacacgacctcttaaatcgctgtaaaggacaagcaaaaggtagagcaaagcactctctcagcttcacactgggccaattaggtgctacatggtagttcacacctttataatagctataacattttggttttgtcctcaagttatttccttggggctgatttttgtcataaaattttctatctaaataattaatctgaatggatatttgacatattttaaatggaaatgaatcattgtaaattacacaagtaacctacccagggacttctcagtggaaggagtgcaaacatcaacctgttctttgaggttttatcctagtatattccacccatacaggcatgctttaaggtcttctctacaggactggtaacccccagggtagcaaacccagtaatggacttccacttttatggatggaaagaattgtgtaacagaccattctaagaagataatgagaaaaaaaggggtggggaatgaatttagtgtttaagaaatatatttcccttttcccttttcaagtggcatgctataaaatcgcttctcaaaaattatacaaaaaactttggttcaataaattcccttgacttttttcttaagtaattacttggttgtctttcatatactctaactttggtgttaatgaataaggtttgcaagtggtgtttctggcaattattcaaagttctgtccagtgaggtctttatttgactacaggctatcagccaatttcccagcaatatgcattcacaaattagtagccacaaatcaggccccatagtaaggtgtatattacaaaaatgtgttaaccatggacagatgattataaagttgcagctattactgttcattgctttgatgtagtacaaggggaaaagagatgtgttatttttcttattaacaaatttaattaacttttaattgatttctaggaaaatatatattttcattatagcatcatacactgagctgcttgactaaatattaaacatcaatgcaaagttcttgacagtactgctgataataagggattctatgtttggttatcttgtttaacatctacatgttcatctagaatagtaaagaagtaaaactgccttgcttagccagctcatgttgcttaacttacatcaccttatttatgctccttaatttaatggggacataggaatagataaggaaatagctctgcattttatattctgttccctttgtttccattagatgtgtgtctcagtcaccttaaaatttttagagtagctttctgggggatattgtagtcttttttttattattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgacaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagactttgctatcgtgaataatgccacaataaacatatgtgtgcatgtgtctttatagcagcatgatttctagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgtagtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgagttcattgtagattctggatattagccctttgtcagatgagtaggttgcaaaaattttctcccattgtgtgggttgcctgttcactctgatggtagtttcttttgctgtgcagaagctcttgagtttaattcgatcccatttgtcaattttgtcttttgttgccattgcttttggtgttttagacatgaagtccttgcccatgcctatgtcctgaatggtaatgcctaggttttcttctatggtttttatggttttaggtctaacgtttaagtctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgaaggctctattttggttccatatgaactttaaagtagttttttccaattctgtgaagaaaggcattggtagcttgatggggatggcattgaatctgtaaattactttgggcagtatggccattttcacgatattgattcttcctatccatgagcatggaatgttcttccatttgtttctatcctcttttatttccttgagcagtggtttgtagttctccttgaagaggtccttcacatcccttgtaagttggattcctaggtattttatcctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaggggaatgcttccagtttttgcccattcagtatgatactggctgtgggtttgtcatagatagctcttattattttgagataagtcccatcaatacctaatttattgagagtttttagcatgaagtgtcgttgaattttgtcaaacgctttttctgcatctactgtcaagtggacttcatccctgggatgcaaagctggttcaatatacgcaaatcagtaaatgtaatccagcatataaacagagccaaagatattgtagtctttttttccataagcatcaaatatacttcttgtcatggtagctttgaattcagtgaattaagttgtcatagattcagtcaaaatgtgtgtgtacttgacatatcgtaatttataccaatttaaactgattatttaaaattctgaaactctattggtgaggatgccccatttagcatttactgtcagtctgcttaatgaatatctgcttggatattttctctaaaaactcctatccggccaggtgagatggctcatgcctgtaatctcagcactttgagaagccaaagggggaggatggctcaagcccagaagttcaaaactgacctgggcaacaagaggaaaccccgtttctgataaaaatacaaaaaattagccaggcctgggggcatgtgcttgtagtgccagctgcgcaggacgctgaggtgggaggattgcttgagcctgggaggtgaaggttgcagtgagcctagatcacaccactgcacaccagcatgggtgacagagcaagacctgtttcaaaaaaaaaaaaaaatcccatcctaaaatatagattgctatatatttatatatggcagtatacacacacttgcacacatgtgcacacacatatatcaaggttaaaaattctgagatggggatactatcctggattgtccaagggagcataatgtaatcttacatgcccttaaaagtgaaggaggatgcctgaagagtaggtcagaaagataaaatggaaaaagatggagggagggattcaaaaaatgtgaggggcttgaccaccattgctggctttaaaaatggaagaaatggccaggcgcagtggctcacgcctgtaatcccagcactttgggaggccgaggcgggtggatcacaaggtcaggggtttgagaccagcctgaccaacatggtgaaacccggtctctactaaaaatgcaaaaattagctgggcatggtgacaggtgcctgtaatcccagctactcaggaggctgaggcaggagaattgcttgaacccagaaggcggaggttgcagtgagccgagatcgcaccactgcactccagcctgggcaacagagcaaggcttggtctcaaaaaaaaaaaaaaaaatggtggaaatgtgtcatgaaccaagggatatggggacctctagcaaccgggattggtcctcacatgacaaccatcaaggaagtggggatctcagttctacaaactctagcaactgaattctgtcaacaacttgaatgagcaaagaagttgtttctccttagagtctccagaaagaaacatagccctggtgagaccatcttgaatttttgacctatagagctttaaaataatgaacttgttttgtgtcagctgctaaatttgtgataatttgctatgggagcaaaaacaaaactaatttagatatgtttagatatgtttcctagtggatgtatagttaagcagctggacatgtataaaacacacggacacacagccacatcagtcaaattgagccattctaccataataaatattcaattatatgggtcaataaaaacaacttgaacaagagtcatttaaatttctaattgcataaatgattagtttttttgatcttaagatattccatagacagaaaaagtgactgaaatttttaagggtattattattatgaaacaaaacatatttatattttgttcttggcttacaattttatctatttacttgatgagtaatttcagaccaaaaaaagagatcaccctctttttttggtgaaaaagggagaaggcagtgttggttgttttcactagaatgatcagcttgactgatttgtcaataattcgtaagacaaattctaggcaaagtataaaagtaaaagaaactatatcaacagaaactattctactctgtcaccgtattttttctcttcaggtatttctgcaattcttctatcttttctcagaattaaacctcagagatgtcaaactcccaggggcagttgtgttttgatgagtcaaagagacaaatcctgctgaaatgcttggcattatgacatataggagcactgttgtaaacatgattttcacatcttagacattcttgtttcaaagaagatgcaaatattcagcatccccattctgcatgctttaccattgcctgtaaaactggatataccactgcatatgtgctgttaaaatacatcatattgcattccacgctttatggacctcgagtgatttttgtgtccctggctcataaggcagccaagtgtcttgttttccttcctttccttgttgacagtttggggcataattatataatattttacagtttctaagatttatttcagtttcttttacatggaacttttcaaaacaaaatatacagtagctgatagtgagattcataattagtatcacaattgagttttagctaagattaattcttattacatttcattcgatgaatatttactcaatattttctcattttatttgatgcaaagtgattttacatgacttcaaattttcagtaaatataggtatattatggtatcaaacattcttacttatgcagagatgtatattctaatgttgaaaaagagtcccttgcacatacattacagttactgtagttttaatcctatttgacttttggaacagatttagtttcaaatctgttttatttcatctaatgttcattaattccacaagcatttgttaagtacttttatatatgaagtattgtgttaagaactgggacactgagatatttctttcttgtgtaaccttccataagccacagtgttctcatttgtaaaatgagattaataatatttactcataacaacatcatgaggattaagtcaggttatacttataaatattatttatggtaaatatgattaatgtttattataataaacattatcacataaataacagcataacataataaaatattatttattataaacaaacataatgtgtaacattattactaaacatatataaatataaaatgaatatatacagtgagcaaaaacctacataatcttaaattgtcactcggcagattatgttaaatgaattacaaacaaaattttttctcactttagaattcaaaacctattaaaatcataagacaaagattcagtatttttatgagttttctgtcataacatagtattgttattgctaatgacattatccgtttttgttatgttaattttaaatgaagaatattaaagtataatatttttcatgttttaaattttgcattgtattgtcattgtcatttcctccttagagggccaaataatttttggttagaaaaataccataatttgttaactgttaccttcatttacagtagcccgtcaaaacttacgtgaatttttttgtttttttgttttatttaataggcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggtgtgtgggaaaaagcatttattacatgaatcctacattaggagatttgctattagggtttgtgtgccaaaattagcaagtaacaatacaacataccaagttggattttaatttcagataaacaatgaataaatttttattatttctccaatattgcatattgtattttatgtggcaagcctactttaaagatatcccaaaaattaagggcagaaagatctatttgtaagaaattaaaaatatactttttaatagttttttaatttacaaaagtaatattctgtttattccaacagttgacaatacaatagtttatgaagcaaaagttaataatctcccacattgtgcctccagagtactcagcattaaatttatttcacatttatctttgtgttcacacaaatgtcaaaaaatacatatatatatatgaatttgtgtgggttatacatatataacataaatgtgtacacacagaaaaaatatagagagttacaaattggtttcccctctattttacaaatattgtttatacccattattctgtattgttttcacattcaatacacaaaagccatcttctagtaatctaactctcctttttaatgacatctctgtatcaagcctcttttttaagtttttaactataaattacacagtcctgaacattttgattcagtagattaggctgatccataaatctgcatttttaagcaaccacctcatttaatactgactcagttggtctataaggtatgttttggaaaaaaaaaaaagtagccatttttccacctgcagtccacaacttgaatgtttttagcatacttttccagactctgtatcccttccataattgaactcagcaataaacattaacaaatctaaataaggcaaatactggccagggagagaacaattattccttcatctattccaccattcatctgtcaattaattaattagttaagttatttatttaacaaacatgtcttcagtatgtatagtatgccaagtctcctgctggtgttgttaaattcatgctgtcctaggggatgcaaagactttggggatacaaaggtgaacaaaacaaatttactgctttcttcgagttttcaggctggtttagctatcagtcaagaaaattagtagttaaaacgtaggtcctcagtacaaagggcctaggtaatagaggtggagctcctaacctaatcttaaggcaaagagaatatttgctagagaaacttatttctaaatggtgaactgagggacaagtaagagctatccaagcagaaaaggaagaaagattgttcaaagtagttggggggaaaaagcctggtcaaaatcatggaagatgggaaagtgtgaggggtgaggggctaaaggtctagaaaatgtagtggctcttaccatgttaaggataatggcgttgattgaaaattgaattaaaaaccaggggattttaagcaggaaaaaccacataataaaatgtatgctttaatagcatctttctgattgttaagtcaataattgattggaggagaccaaggctgaggttcaccataggaggtgtttgcatttaaaaatgcacattatagcatactctggatcttccccattttcattcttgctccattcggttttctgtacctgaggtgcatttgccagtctgtactgctgagtgaaatagccattctacaagactcccatgaaaacccatcctttcagctaaaggatatcgttcccaatttagaacatcttttagatagcatgtcacatttttttcctttctattttagtatttgtgtcttgtttcttctctgagaccataacctgtagggcagtaattgtgtctggattcattttggtgctctctacagcaccttgtgcgtaactactactcaaatcctagttaaatcaaaggaagtatggtagagtgatctctagaaatgtattataggatccctgtgacaaataattactacttatattttctcagttttcttatagtactttagccatctattatgtttatggaaatcactcagtatttatttttatttaaaatatttgttcatgattatcaaatcagtagaaaataagaaacagtcatttaagacaatatttatttttttactgtgatatagttcatttagtgatttttcaagttaaacagatacagtaataacgtcaacaatgacaaaatcttatagaaagatccctctctctctctctctgactctccctctcactgtctccctcctttcctccctgcctccatctttctctcccccatccctccttctcttccctggtaaattattaaataatgtgcttttttaaaaaacaaaaacaaaaaacgtgtctttttgtcctcgttaaattgatgctgtcctaggcactaacgcatgacttccatccttcctgcatttctttattttggtaacgtcactaataaaactattcttctgcttattacaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggtaagggctagagatgacttctggttgcctgctttgctctctctacatgtaggttttgttccttctattatacctataatatgttttgataacaattcctaatgacacagtggtaccagacccataacatagattttccaatggaaatatttatgaatacataagaaataactatatttttgactataaaagataaatttgaaagaggcagtaaatatgtgtacaaagaccatggaaatttgagtctgcatcagctctgtgacttccatcaagtcctaacctctctagactagattttagttcaaattccacagcatcaggcataattatttggtacaaatccttcaactaaaaaaattttatatatgactctgaagggccaagagttcttaggccctaaaattaatttagggcccaaacctctggaatgaaataagcttccaagttagatggaattgaggttaaattctggctcaaccctttttaagctctatgaccttggggactttgttaacctctctggatttgttatcccatttattataataccatgtgccagatgattgcctgaaagagcatggcatttttaactttttgaatttctagtgatttttaagagacaaaagtagatatgagaagaagtactgtaagttgatcagttctcaaatagtagtacataccgtgatcctctgagcgtcatcttaaactttcagatttctctactccttccccaaagaaggacctgtcccatggggaccatcataaacatcagcatttgagaaaagtacacagatgtttcttatacaagacatctgaatcccatattgagaaatttacttcaattacaaagatacatatacaaaaatcctcaagttactttactaaatgagtatattactaaaaaatgactttacatgacaataatttcttaggcaatataaagtaaaagttcattcactatcatggtacattgtaaaaatttttgttttggtaagggaagaaaatagaaacttaaaaaagtcttatttaaagtgtttttttctgcttcctgaatagacttggaatgatgaaaaagggctggtcagaaaggaatagagatacctgcacagagcaagggcagtggagggaggaaaaagacagaagatctataagataaatgaagcacttgcaaagaagcctatagagtatatcaatgaccatgaataaaatagatgaatatgagtaattagttgaataaacaatttaactttagtatacatgttttgatttatattttattcacagttgtatctatgttctacccccaaaaatataattgataattatggctcagattttaccaagtgactatagatatcaagtttctatgttaaaaaacaatgaaatctatgggcttagatagaaaaatgtggaaagatgtggacatttttaataaatgtttagttgcaggatcataccataggattggaatgaaatattggcaaccacatattgtctactacatggtgatactattcatgcttcatatagtcgctaaaatgtgtaagagctgagtgggatcaaagttacatgacttaccaactttgttaggttatctaatcctggagatcatgcagataactctaggcatctatgttcacttaatctttgccagtattatattttcaggttgtattttgttcccatgaatgccttttcatttgttcttttgaagtgattatagttaaagtccattatgtgtttaaggtgaattgtttagcagaatttacctatgataattactgacaattccatatcatttggattctgttggttacctgaagactgtgggaaagtgcagatacatttattcctaaaaataaaagttcctgaggattactccctttttctttatttttatttttattttgtttagtggccagtactacaatagcaaagctattatgtgagatcattcagattctgcatgtgcaacacaaatgtctctgagggaccttagtagaagactatatgtatccagggtcctaaggaaaagaaggtcataggcaacttttctacaattctcatattatagggactacaaataagattttcttttatttgaaatgatggaagaagaaatcatcacttttcttaggttgcagtatgattgttatcctgctaaatagctagccatatgctagtggttttcttagacaacaaagtaatgatgtgaaaaaagatttcaccaatacataattagtataactgtatttttccagtaggttaatgttcttgaccataaaattttggggtatggattttatttttttaagataattcttcagtcacagtgaaacacggaagtattccactaccttttctttttttagtgtcttattttacattttcatattttattttagattcaggcattacatgttcacatttgttacataagtgtattgcatgatgctgaggtttgggatatgaatgaccttgtcaactagatagtgaatatagtacccaataattagtttctcaacccccgcttcttcacttcctaccccacccaatttctgtctattaattttcagtggctatttttatgtccaggagtacccaatatttagttaccatttagaggtgagaacatgcagtatttggttttatgctcctgaattaatttgtttaggataatggcctcaagctgttatctatgttactgcaaaggacatggttttattcttttttatggctgcatagtgttccatggtgtatatgtacccccttgtatttatctaattcactgttgatgagcatctaggtcgattccatgtctttgttattgtaactcataaaactttgataaatacatattatatcttggctgggcatggtggctcatgcttgtaatccctacactttgggagaccaaggtgggtggatcacctgaggtcaggagtttgagattagcctggccaacatgatgaaaccccacctctattaaaaatacaaaaaattagctgggcatggtggcacacaactgtaaccccagctactcaggaggctgaggcaggagaatcgcttgaacccgggagacggatgttgcagtgagctgagatcacagcactgtactccagcccgggcaacaaaagtgaaactccgtctcaaaaaataaaataaaataaatgttatatcttaacatatgttgtctcttgtaactgaaaacatattattattttaattcaaaaggtttagggaatggtcgggtgagtaattcaaatgattctgagtaatttccaacacttttctttctttaaagcttttaatttaggttcatagatacatgtgtggtttgttatacaggtaaattgtgtgtcacagggtttgactgtacagattattttgccactcaggtaatgaacatagtaccttataggtagtttttttatcctcactctcctccatctgtccaccctcaagcagcccccaatgtatgttgttcccatctttgtgtccctatgtactcaacgtttaccttcagcttctaagtgagaacatgcagtatttggttttctgttcctatgttagttcagttaggataatggcttctagttgcatccatgttgctgcaaaggacatgatctcattcttttttatggctgcatagttattccatggcatatatgtgccacattttctttatttagtctaccattgatgggcatttaggttgattgatttcatgtctttattactgtgaatagcatgatactaatgatacatgtgcatgtgtctttatggtacaacaatttgtttatctttgtgtatatacctaaaaatgggattgctgggtcaaatggtcattttgctttgaggtccttgagaaatcaccaaactgctttgttccattttctcctcaacctcaccagcatgtttttttttttcttttttactttttaatagcaattctgattggtgtgagatggtatctcattgtggttttgatttgcattgctctcatgattagtgatgatgagcattttttcatatccttgttcaccatatgtatgtcttcttctgaaaagtgtgcgttcatatcttttgcccactttttaagtgggaggtttgctttttgcttgttgatttgtaagttccttatagattctggatatttgacctttgtcagatgcgtagtttgtaagcattttcacccattctgtaggtggcctgtttactctgttgatagtttttttgtttcgttttgttttgtttttgctatgcagaagctctttagtttaattaagtcacacttgtcaatttttgctgttgttaaaattgcttttggcatctctgttatgaaatctttgccagggcttatgtccagaatgatatttccgaggttatctttgtgtttttatagttttaggtttgacattgaagtcttcaatccgtcttgagttgatttttgtacatggtgtaaggaaggggtccagtttcatttttctacatatgtatagccagttatcccagcatcatttgctgaatagggagtccattctccattgcttgtttttatttattttgttgtacatcagatgcttataagtatgcagcattatttctgggatctctattctgttccattggtctatatgtctgcttttgtaccaggacaatgccgttttggttaccgtagcattgtagtatagtttgaagtcaagaaatgtgatatcttcagcttttttctttttgctttggattgtcttagctattcaagcttatttttggtttgatatgaattttagaatacatttttcttgtgaataatgcctttggtagtttaataggaatagcattgaatctgtactttgttttgggcagtatggccattttaatgatattgattctttctatccacaagcatggaatgtttttcaatttgtttctgtcatctttgatttcactgagcaatattttaaattctcattgtagagatttttcaccacctggttagttgtattcctaggtacttttttgtgtaactattgcaaatgggattgcattcttgatttggccctcagcttggatgttgttggtacataggaatgctattactgatttttgtacattgatttggtatcctgaaactttgctgaagttgtttattagatcaaggagttttggacaaagactatggggttttctaggtgtagaatcatatcatctgcaaacaggggtagtttgacatcctctcttcctaattgggtgggttttctttctttctattgctttattgctctagccaggacttccattactatgatgagtggcaataagagaggacatccttatctcgtttctcttttcaaggagaatgcctccagcttttgcccattcagtgtgacgttggctgtgcatttgtcatagatggcttttattattttaaagtatgttccttcaatgcctagtttgttaagcgttcttaacatgaaagtatgtggaattttattgaaatccttttctgcatctagtgagatgatcatgtagtttttgtttttagtcctgtttctgtggtgaatcacttctgttgatttgcctatattgaaccaaccttgcatcccaggcataaaacctacttgactgtggtggattagcttttcaatgtgctgctggtttgccagtattttgttgaagatttttggatctgtgttcatcaaagatattggcctgaagttttcttttttgttgttgttgtgtctctgccaggttttggtatcaagatgattttggcctcatagagtgagggagggatgcctcctcctcaattttttggaatagtttcagtagggatggtaccagctctttatacatgtggtagaatttggctgtgaatctaactggtcctgggcttttcctagttggtaggctctttatttactgattcaatttcaaaattcattattggtctgtttagggattcagtttctttttaacacaaacttgggaggttgaatggttccaggaatgtatccatttcctcttgggtttcttagcttgtgtacccagaggtgttcatagtctctgagtgttcttttatatttctgtggggtcagtggtaatgtcttttttcattcagtcagtcatttctgattgtgtttagttggatcttctctttttttttcttatttgtctagctattcatccatctatctaattaattctttcaaataactaagataattcctaaattcatttatcttttatatggtctttgcatctcaatttccttcagttgagctctgattttggttatttcttgtcttctgctagctttgagtttggtttgctcttgtttctctagttcctgtagatgtgatgctagattgttcatttgatatccttctgacttttttaatgtgggcatttagtgctataaacttctttcttaacactgctttagctgtgccccagagattctggtatgctggatctttgttttcattagtttgaaatattttatttctgccttaattttattgtttacccagagataattgaggaacaagtggttaatttccatgtaattgtatggttttgaatgtttttcttagtattgatttctgtttttattgcaccatgttcagagagtgtggttggtatgattttagtcttcttcaatttgttacagattgttttgatgtccaattgtgtggtcaattttaaagtatgtgccatgtggtgatgagaagtatgtatattctgttgtttttgggtggagagttctatagatgtctattatgtccatttgttcaattgttgaattcaggtcctaaatatctttttcactttgtcacctccatcatctgtctattactgtccatggggtattgaaatgtcccactattgtgtggaaatcgaagtctctttgtaggtctgtaagaacttgctttatgaatctgggtgctcctgtgttggatgcatatatatttgggatatttagatcttcttattgcattgtatcctttaccattatgtaaggctcatctttgtcttttgtgatgtttgttgatttaaagtctctttttgtctgaaatttggatagcaacttcagctttttctattttctgttttcttggtggacttttctccaaacctttactttgggcctatggatgtcattgcatgtgagatgggcctcttaaagacagcataacgttggtccttgcttctttatccagctttaaattgtgtcatttagcccatttacattcagtgttaatattgatgtgtgtgaatttgagcctgtcatcatattgttagctggatattatgtagacttatgtcattgctttatagtgtcagagatctgtgtatttaagtgtgtttttgtagtggctgttcacatgtagcactcctttcaggagctcttataaggcaggcctggttgtaataaattcccttagaatttgcttgtctgaaaagtattttatttcttttttgcctatgaagctcagtttcactggacatgaaattcttgggttgaaattcttttatttaagaatgctgaacataggcccccaatctcttctggcttatagggtttctgctgaaaggtccactgttagcctgatgggttctctttgtaggtttcctgctctttctttctagctgcctttatatttttttctttcattttaaaaagaatgaaagagaatctgataattatgtgttttggggattgtcttcttatatagtatcttgcagttctctgcagtttttaaattttaatattggcctctctagtgaggttgggaagttttcatggacaatatcctgaaatatgttttccaagttgcctgctttttccccatttccctcagtgacgccaatgaggggtagatctggtctcttcacataatcccatatgtttcaggggttttgtccattcttttttattctttttttaattattacttttgtccttcttagttagttcagagagccagtcttcacgctctctgattctttccttagtttggtctcttctgctgttaatgcaatcacaatataaaactcttgtagtgtgtttttcagctctatcagatcattttggttcattcttataatggccatttcatctaccagctcctgtattgttttattgtaatccttagtttccttggtttggattttgacttcctccctgattctcaatgattttcattcctacccatattctgaattctatttctttcatttcaactatttcagctgagttaagaatcctggctagggaactagtacagttgtttggaggaaagaagacacttgttttttgagttgccaaagttcttgcactggttctttctcatctgtgttcgctgatgttctttcaactgtctaatttgagtacagtcagttggtttatttagatgttttcagaggagtgaggttttgtgcatgacctttatttgtaactgagctcttgtccttggtttcacagaagaatatattagcaaaatatttttaatagtaaagtttgggctgtgatccagcagatggcacttaactggaatggccagtaggtagactcttcgtcagtctcctctatttcctaaggattgttgtgccccttctcagtgatctgaaagtgtcggctccttttgcacttgactgctggctgtatatctgtttggcactcccaggctacacattgtagctctggggcaagctcaggctttatgttctttccccagcttagacacaacaagggaagggaccttggctgtggctgtggcagatggcctttcacttgtctcttggtgctccaccccagaaaaatacagagccactactaatcagtacagtcagcctggggtgtggtggctgcattgtaggaccaagcttgtgggtgatgcagctgtctggaggtgtggctaaagcactcagggtctttgctccctccacagtctgagggcagcaagggcaatatcactgcagcagcagtggtagaggggctttcggttgtccctgggtgctcaacctgagggaaactcaaaactgctcctactgggaatgtccagccagggagtggggtggctgcactgctggcctgagctgggtaaagaacgggaggttgaggattcacagggaggacagtctgggcttctctctatatgatgactgtgtcctcctggaagagtgagtaaaacctttggccctttctttcttctccagtccaagggcagcaggggcagaactactgctgtggcagtggcagagtggctgttagttgactgtaggagcccctccttaaggaaacacaaagccactagcagtgagaatgctcagctggagatggggtggctgttccgtgctcccgagcttaggcactgcctggtaaagagtgagaggtgggggctcacgggaaacagacactgggcttctgtccatattgtggctgtggtgtgctggagttcctgcatagtggccaagccctttgttcctccccagcccaagggtagctgcagtcacagagaggttgtggattgtctctggggttttctcaccactgactgaagtgttaggcattgacaaggtggttgtgctaggggcccaagtccagaggcactgggcagtaaagagtagcagaggcagagacctgcatagaaagcagtctagctgcttttctgtaatgctgccgtgctgtgctgggcgtttgcatcagtctccaaccaccacattccctcctgagcctgagggcaacaggaatgaggactgtggagcagcaaaaaatggtgacctgccttgccctctgggagctctgtcccaggaaagtacagagctgctactggcccaagagcccaggtcgggggttgccgaggtcctaggttgggaagccctgcccggtgagaagtagcaagggtgtggacccacatggaaaacagcctacccgcttttctgtaaggaaactgcgctgtgttgggggtcggcattagtccctaatccctgtccctcccaagcctaagagcaaaaacagggagggttgcagagcagcaaaaatggcagccagcctctccctctgggagctccgtcccagagaagtacagagctgctcccgacccaggaactcaggtggggctggaatggacagtaggccttatcctgcaaggtgcagctgagatgaggcctgcaatgtttcactgctcagcctcgtggatttggcccctttactggaggcatgcaagtctggcctccactgctgcaggagctacagccactggtgccagagtgtctggggatacaagtctcctgggactccctgtgtgcctgagtatggctctgccaagactccacatggttctccgtgtcagcctggaggcaccggtggggagctcatgggggagatctcctgagtccagggatgcaaaagtccatggcagaaggtgggtccccagggactcacttactcactgtttctccacagtgggaggactcccctgactctgtgccaccccagggtgggcagttgtcttgtcttgctctcctctgttctctatgtgttatgctgtttcctgatgaattccagtgtgtctccacctggatttttcagatgagctagtgtccactcgccagcctttcttttctcaatgagattgacacacaccagctccctctagttagttctcttggcccccacctctttcgctgtctttttttacacttgacctggattatctgctagcacacaaattgatgccatttcttctatggatactgtttccacctctaaactaccttggaatggagatcgtaagctccttccatcctcggacaccctaaacctgttgggagagttttatcaggatctgggttctttatttctcgggggtccacatgtctatatacttaattattccgttcttgtgtctctctgtcctaagatatttatttcaggaggtaagaaatgtgtctatttcaggaaattaaaactttattcagtactaaattttctttggaaataggaactcaaactgtcaaaatcttttctggggtaacctgatttttcttttcatacctctctttcccgagacaataattatcagtgctctagtggtctggaaaaaggatcaagggacaagacaaaattatggattgcctgaagggagggctttgattgtattgtattttgaaatatgattttgtcacactattgtgttataacatttagaaatctgttacaaaaatatttagggaatataatattggtggttatgaagatgccataatatgtaagcagatgaaaaagactaaggtgagagtgatctatatagactaaatagcaaaatatcttctggaccaggtgaaaaatttgccttggtttactcttgtctactcatatgacttggtggaattgaacagttaaaacattaaaaatagaaaaataattcatttattgatgattttggacaaagaagagaaaaaaaagacttgctattaatgacatttccccttttcttcccagatcgaaaaatagatcctcaaatggtgtggccttttctctgatgagggtgtggttgatgacagacagttatggtaaacactcatagattctgacttggcagctctggattcaatttggatatatttgcttggcttgttttgatggaaaatgttaggggagttaaattatgtccaaaattatcacctcaaaaagcaagatatgccctaagtaaccctcattctgtatctgggcctcatacctctttaaaaaagttcttaatgttgcctcaacatccctttatttcaatatgggggtattacttaacgcttctacatcagcagctggaagataatttattcctcagatagagaagagtgttggtttaattcgtgttgtatcaattgctttatcttatttagagaaatcacaccattcctttggtcaaggcgtcctgactcatgcaaagtcattgcctatttattatacatttaaagcaaaacttaacatttaactctagacatatgtaataccacttttttattccaagttcatctaagcataataaaatttgtaggaaattctcccaaatgtagactgacacttgctttcctcttttctgataactcagggtggggattatcacaaatataactttaaaattctagtatatactactgaggcccataaaatattattatcctttttttaagagaagaatggagtacaattctcagttctctacaaatgtagtctttaccagcttttcaaattgtctatacttggtctaattactcgcagtactgaaaagctgttttgttgataacataattgtatggtattcgctaggagatacttggacccaaaaagtcaccacaggaaaacatcttgaagttctttctttcaaaatgagcagaaacataatttcttttgtaaacaagaggaaaaaataaaagatgaagtgtttaatgcctagtccatcaaacctgtttaaaattggagcaagaatgggaaaattcaagtattatttggaaaaacaatatttccacagtataaataaaaatttttatcaagacatctgcacacagctttcttagtgtcaagttttaagaatccaaaacaaaacctgtgatgatcaaacaaataacatacattttttcttgaaaagattttatagaacatcaatgtaacaaggctttttccttgtatatacaagatatttacttgtgtattttacttgtagatatttttcttgtatatttctagatatactaaatatttagaagaactgaatctgtgatgatagtaaattagagatattttcttgtgtattttacttgtaaatatttttcttgtatatttctagatatactaaatatttagaagaactgaatctgtgatgatagtaaattagatgatataagcaaatctctggaaagtgaaaataaaattctaaacaattttaaaagatccagagtgataactagccttacaaactaagttataatagaaacctggtcttagagtctgcgttgtaacataatatagaaaatacacagaaagaaaagggctgttctacagcaaactgaaaactgaatatgaatctgaaaagctgaatatgtaaatggatatattatactaagcagcattataaggagtataaagaacttgtctgagataaacagatgacccaagtcattttgctcattataattttggatagaatggctgcatgggagtaggagagagggagacatgcttctgtgaagacgggagactagattgacccttggttgtgtttgcctgtcttagtgtgcaggtgtgggagtaggcagggaggggtgaaatgacgagaaatgaagtatcatcaggttcaccttgtaacaagggctgaggttgttgttaaacacagtgagtcttggaaaatgaagctaagatttccacctttcagaggagttttcttctccagaaagaaatattgctaccccatagaatagaagaaaaaggatagcttttctagatgaaaactcagtgcccagtaccaaggcagcatttgtgaaaccgtggacacctgagaggcagttacgtgctactgatgctccatcatgacagtgttgatagggtcctgcttttgatttcatcagaaaagctgatgcttgagagaccaggaggttgtcccagactcaaacaaaacagaaattctggacatttcatctacagcatacctattgtatggaggtaagaggtattgtctggaggtgggaatttgaataaatgataatttctgtgaaccagctagttggtgtatggtcagatttaatattgttttttacaacttgctaattgttctgttggggttgctttgaagtatggctttcaaatgtttccctctcttctagtccgcattttcagattcctattggtgtgttctttatattatatttgtcagtgaacttggtgatagcaggagaaaatatctttaattctactattctagagttttaggactaagatataacatatttcctataaaaatccaaaccagagaaaacaaagaaaatgtgcatgtccaggattaaaaatagtatatctacgtagtaaagaatctctcccatggctccataaatatcacccactggtttctgggagacaccagaaagtgcctctctcatatacttttaaccttcattgattatgtcgttgcacattataggatctcattcttctttatggttaaatagtactcccttgtgtacctgtaccacattttctttctccattattctgttgatggacacttaggttgcttccaaatcttggccatggtaaatagtgctgcaataaacatgggagtgcagatatttctttcatatactgatttcctttcttttggccatgtatctagtagtgggatttctggatcgtatgatagctctatttttagttttataggaacttccatactgttctccatagtggttgtactaatttgcattcccaccatcagtgtgtgagggttccttttctccacatccttattagcatttgccattgcctgacttttagataaaagccattctacctggtgtaagatggtgtctcattgtaagtttgatttgcatttctctgatgatcaatgatgttgagcacctttttatataccggtttatcacttgtatgtcttcttttgagaaatttttgtttagaacttttgcccattttaaaatcagattactagatattttcttacaaagttgtttgaactgcttatatattctgtttaattccttgtcagatgggtagttggcaaatatttgcgctcaccctgtgggttgtctctttactttgttgattctttcctttgatgtgcagaagctttttaagttgatgtgatcccatttgttcatttttctttggttgcctgtgcttgtgaggtattactcaagaaatctttgcctagtcctatctcctggagagtttccgcatgttttctttcagtcatttcatagtttgaggtcttagattcatatctttaatcaattttgatttgatttttgtatatggcatgagatggggcctaatttcttcttttgcatatggatatccagttttcctggcatcatttattgaagagactgtcctttccctggttacattcctggcacttttgtcaaaattgactttgctgtagttgtgtaaatttatttctgggttctcaattctgttccatggatatatgtgtgttttttttttttatgccagtaccatcctattttgtttactatagctctgtaatattatttaaagtcagataatgtgattcctccaggtgtttttttttttccttttgtttaatatagctttggctatctaggtcttttgtacttccatacacagtttagaattttttttctgtttctttgaagaatgtcattggtatttgacagggattgcattgaatctgtagaacgctttgagtagtatggacattttaacaatattgattattgcaatccatgaccatgagatatcttttcattcttttgtgttctcttcattttcttgaatccatgttttatagtttccattgcagagaactttcacttccttggttaattcctaggtattttattttaattgtagctgttttacatgggattactttattgatttcttttgcggattgttcactgttggcatatagaaatgctactgatttttctgtgttgattttgtatcttgcaactttactaaatttatcagttctaatactttgtgtggtgtgtgtgtgtgtgtgtgtgtgtgtgtgtagtctttaggtttttccaagtgttagattttatcatttgcaaacaaggataatttgacttcttcctttccaatttagatgatcattattttgttttcttttctgattgttcttgctaagacttccagtactatattgaataacagtggtgatagtgggcatcctggttgtgtcccagatcgtacaggaaaggctttcagtttttcctcattcagtatgggagtagctacgggtttgtcatatatcacttttattatgttgaggtatgttccatctacacccagtttttgagggtttttatcatgaaagagcattgaattttattaaatgctttttcagaatcaattgaaatgatcatatggtttttctctttcattctgttgatgatatatcacattgattgatttgaatatattgaaccatcctagtatccctgagataaatcttatttggtcatgattaatgatcttttaaatacgatgttgaatttctttgttattattttgttgaggaattttgcatcaatattcatcaaggagattgcctatagtttcttttttggatgtctctttgtctagctttggtatcagtattattgtctttatagaatgagtttgaaagtattccctcctcctgtttttttttttttttttttttttttggaatagtttgagtaagattagtattagtacttctttaaatatttggtagaattcagtagcaaaaccatcaggttctggcttttcctttgctaggtgacttttcattacagcttgatacttgttatttgctatatcttgttacttgatactagtttgttcaatgttttggatttcttcatagttcaatcttgatgggttgtgtgtgtctaggaatttatttgtttcttcttgattttccaatttattgacatatgtttgttcatagtagccactaatgatcccttgaatctctgcagtattagttgtaatgttttctttttcatatctgactttatttatttgggtcttctctcttcttttttagttagtctggctaaaggtttgtcaattttatataactttttaaaaaaacaaactttctgtttcattgatctttttattgttttcttcatttcaaatccatttatttctgctctgatctttattatttattttcttctactaattttggcttcagcctgctcttgcttttctagtttttaaagatgcatcattaggttgttttgtttagttgaagtttttttcctttcatgatgtaggcacttatagctataaatttcccacgtagtaaaaatttcagtatatcctattgaatcaagagtttttcctgctgatggattcgtggtcttgctaacttcgaagaatgaagctgcggaccttcacagtgagtgttacaactcaaaaagagtccacagaccaggagagtgagcagcagcacagtttattgaacaaagcgaaagggaagcttccacatggtggaaggggacctggaagggttgccactgctggctgtggtggctaggacttatatccctgtgttaccccctcccctttctttctttttgtccattgagagtggctcttttttcaatcctcccttggagtggttaactttgaatccttcactttattgattaagaactcaaaaccctgagtcacaggggtcttttgtgaaagtccccaaatcaacccaggaagtcctgccaactccacacctcactattggttttgatactttgtattttcattatcatttggtcaaaaaagttttcaattttcttatcaatttcctcattgacccctggttattcagtaatgtattgtttaatttccatgtgttagtataatttccaaaatttatgttgttattgatttttagttttattctgttgtggtcagagaagatacttgatattatttcaaagtttttaatgtgttaagacttgttttgtgacctaaggtatggcctgtatttgagaatgatccatgtgctgaggagaatgtgtattctgcaggtgttggatgaaatgctctatgagtaactgttagatccatttgttctacagtggagattaggtctgatgtttctttgttgattttctttctggaagatctgtccagtgctgaaagtgggatgttgaagtttccagctatttttgtttggggatgtatctggctctttagctttaataatattcgctttatatatttgagctctccaatgttgaaaatatatatgtgtgtgtgtatgtgtatatatatatacacacacacactgaatacatatgtatgtatacacatgtatatatacatatatgtatatatatacatgtatatatatacatatatgtatatatatttacaattgttatatcttcctgataaattgatacatttatcattatatagtgaccttctttgtctctctgtgtagtttttgtcttgaaatctgttttgtttcctgtaattgcagatattcctgctgtttattggtttccattagcatggaatatatttttccatgtgtttattttcagtctatgtgtgtctttataggtgaagtgtgtttcttgtaggcaacagatcattttgtcttttttttctttaatccgttcatccactctatgtcatttgattagagagcttaatccctttacattcaatgttattttttataactaaggacctattgcttccattttgttatttgctttctggttgtcttatggtttgtcttctttctttctttccttcctgtcttcctttaagtgaaggtagtatactctggtgctttgattttgttgactttttattttttatgtatctattgtacattttttggtttgaggttatcatcaagcttgcaaatactatcatacaaccctttatttaagctgataacaacactgtttgcataaacagacaagaaaaaataactaataaaaactctatacttcatctccatgctttttaagtttttattgtttctatttataccttattttactatgtcttgaaaagtgattgtagttatttttgtttcataatttagtctttctacttaacataagaatattttatacaccaccacagttacagtgttataatactctgtgtttcctgtgtacatactattaccagtgagttttgtatcttcagatgatttcttattactcacgaactttctttttttattgaagaactttctttagaatttcttataggacaggtctggtgttgatgaaatccctcagcttttatttgtctgggaaagtctttatttctccttcctgtttgaaggatattttaaccagatatactcttctaggaattttttttgtccttcagcactttaagtatgacatgccactctctcttggcctgtaaggtttctgctaaatgtctgctgccagatgtattagagctccattgtatgttatttgtttcttttctcttactcctttaggatcctttatttatccttgacctttgggagtttgattattaaataacttgagctagtgttctttgggttaaatctgctggtagttctataatcttttgtacttggatattgatatccttttctgggtttgggaagttcttcattattattccttttaataaactttctacccttatctctttgtctgtctcctctttaatgccaataacacttacatttgcccttttgaggccattttctagatcttgtagtcatgtttcattgattttgttcttttttttctcttgcctcctctgactgtgtattttgaaatgggctgtcttcaagctcactaattctttcttctgcttggtcaattctgctattaaaaaactgatgcattcttcagggtgtcagttgcatttttcaactccagaatttcttcttgatttttaaaattatttcaatctctttgttaaatgtatctgatagaattctaaatttcttctctgtgttatcttgaattttttgagttttctcaaaacaactattttgaattctctgtctgaaagatcactctctctgtttccccaggattggtttctggtggcttgtttagttcatttggtgacttcatgttttcctggatgatattgatgcttgtggatgtttgtctgtgtctgggcatttaagcgttgggtatttattgtattcttcacagtctggacttcttcgtatttgttatttggaaagcttttcaggtatttgaaaggatgtaggtgttgctaaagctgtatctgctttaggaggcaccacaagcccagtaacactgtggttcttggcagactcttactaccttaatggtcttggataagatccagaagaattcccttaattaccaggcagaaactcctgttcttttcccttgctctctcccagacagagtgtctctgtttggagccacctggagctggggttggggtgacacaagcacccctgtggaccccactgctgggactgcagtgggtcagacctaaacccagcacagcactgggtcttgtccaagacctgctgtaaccaccctggctaccacttaagtttgttcaaggccatgggtctctataatcagcaggtggcaaagccagccagacctgtgtctttcccttcagggtggcaaaaatctcccaggccctgaacaggttcaaagttaccgtctggaagtcaaaaccttagaattctaccttgtgttcttgtgtactgtggctgagcaggcactcaacctatgagaaacagtccttctccacaagcagaggagccttaccctgtgccactatcaaagacccttggggagtactgccaggctaccaccaatgttcacttatggcccatggcctcttaaatcagcttgtggtgaatatgcctagcctggcagtaaaaatatcaaatattttctttagctgcagatgtagccttttatgactttttatgcagaagcataaaagaagggaaataagtcagtaaagacaaggagacaatacagaaattgagagagaaaaaaacccagcagaatgctaataatatgagaaatatgagaaacagcaacttggacagcaaatagaaagtgtctagtagtggaaaacagaactggtaagaggcaaacaatcaaccatacacccacgtaaaagtaggtatcggctccataaacctcaaggcattatagagcagccatatagctcaacaaggataatgctaatgctagaccataagacagaaacaactaaagtcattccgcccattggcttatactgtctgtgtctcctcatagagcctgaattagctttagtatggtaaggactggcatttgctatatacatatctttttttttttttttttttttgagactgagtatcactctgtcacccaggctggagtgcaatggcgcgatctcggctcactgcaacatccgcctcctgggttcaaggaattctcccttcctcagcctctcgagtagctgggattacaggtgcccgccaccatgccaggcttattgttgtatttttagtagagacacagtttcgccatgttggccaggctggtctcgaactcctgaccttgggtgatccgcccacctcagcctcccaaagtgttggaattacagatgcgagccaccgtgcccagcctacacgttatttttaaaaagatgatcaagttccaactagttagaactttctacttatcttctaaataaaaactgttctataggtttttgcctgtgattccagaaaatcaaaaattttatcatctttttctctttatttttattttttttgtgtgtgtagaacttcaacttgtcattacatttacaaacttaccagcaagttcttatcttcctagcatgatcattaaaaagattccttacatcttcttggtagtctgctaaaggagaaaaggtttctgtgattattacagactctaatgtagcaaataaataaataaaacatagttttctcctgttagctacctacaccttcaggtataattttatttgcttgacacatggaaacaaattgcaggctttatgagtataaccattttttaaagttttccttaagaaaaaaaccataaggtttttcaagttgtaaatcataacattcagaatactcttttgaagcattaaaactattttttgttgagaccaataaaaatttttaccaaaagaaacaaatattatgggttttagtgatacaattcttaactacagaggaggaaatatttctttttgctaatactaccctctagtggaataatgggcaagagaaaagagcatggttttggagtgctgagcgagtccttaatttactgcacaagagaacatttgcacagaagccgatttatatacatttttgttcagatgtccctgagcataaatacagtgaactattgattatgcttgttggaattgcatttcaatacatttctcctcttgaaataatgcattgtggaaaaactatatgcaactagctgcttttgtaaccacaatgaaagattataaccccaaagtatgtacaacgtgccataaaaagaaatactactacaataactacattaatttattcttcatcctgtcaatagaaaataaagggggaagagaaccaatcttttcataggcttcagtcatttacagtcttaggtgtgtgtctaatcagtttgtgaatcactgtacattcaagttagaaggtgaatccaatgaatacttcccaagcaaataaaaagttcatcatattcaacactgtgaacagctgtgttgacataattggaaaagtatatacattttttttgtttctgaagaatcaaattttccaaaaagtaccttgtgacattaaggttttaaatttcccctgagaataaaataaagaataaaatttttaagaacataatgagctcattggaaactcatgcatggaaacattgcagtgttgggctccttcctttcgaaccttcagaagttacaatttaggggtgctaaaggatttccacacccttagttaccacatccacttattaagttaattggcactcttggaaagggcacgaaaatgtgtgaatgctaatgttttatatatttactccctgcatggagcctcaagatcaatacccttcacagtcctcattatagagaactaaaacttctcggttcatttacttgttcagattctaaagtccataatttattgtaaaaatatttttcatagaagagatggtgaatactgtatttcaaaacagaagaaatgatattttttatttttcagttttgtgtacagttcaagttctcctattagaatatgcaggtttattcatattgactactcagaactcaactctatggcgaatataaaaggaagcattgtttgatagtaagaaataattattctgacttctttgcaaaaagagaagtttgagatctgttaatttatgtgtttccagcttaatactgtacaggaaaattgttgtgtctaagcaaatatcaaagaatatgtagaattttttaaattttgtttttactagcaagtgagaaaaaggggacttggaggagaagagcagataattaacaaatttaggtttcagttcaaatatgtttgacccacactacccaaaacacggtagggtaaggattattaaaatattataaataaataaatctgccatatgaataagcattatttattgacaaaagattatatacaattatctctaaaagataaaatgattcagaaaaatatggtcttcctttcaggggacttgatttattattttggccctgataagtagattaatttagtcaaagttactagcctttctgcagattagtatttttactagcctaatggcagttaagtgacacaaagacagggacatctttttcttgagtcacaacagtatcttcagtgcctcgcactgaagtgctaaatatctgatgaaagtgggaaatacctgataactatttatttaatgaacttgacaatgcatgaataacaatgcatatatagcgccaaattggaaaaataagatacatataagttgctctgaaaaaaattcagtaaattaacattgttttctgtgtataaatatatctaatcttaagtgtcattattttagtgcgctgcagagaaaatctccttttatcatgtaaaatggcaacaaaggatatttcacagtttgtatctgaaatgttctagtcagtattatgctaagtatataaaataatttacattgctataaaaacatataaagagcatttaaaaaaaatcttttacgcctgcttcacagaatgtagcttttaaagaaacttgttcttattttcaaatgttaaaattttacctcttaccattagaagttagaaaaaaattccagggtcacttcagtctccaaaaggcatgtttttgagggtgaaagactttattccagtggaacggccttcagttgatatccacacattaatattgtatgagaactctggcagtttcctctgaggtgccagtctgaaatgagagtaatggaattgagaggatggaaggctgacagtggtaaataagttgtgtgatatgaagactgggagtcaatctagtaactgtatccctaacctggtttcaactgaagtactaaactcctaattgtgttttacaggatatgaatgattatcctcctgtctttagtaaacgaatatacaaagggatggtggctccggatgcagtcaagggtacacctatcacaacagtttatgctgaagatgcagaccctcctgtaagtagaaggcattgattaatattctgaactgtactgagaaaaatccttaacactcataaatgaccgaatcacaagacagcaaaagtagtctctgtaaatttcaccctatttattcatacattttatgttcttttacttatttcatccacaggtacagagcatatttcagatgactattattgaacctagacaaagaatatgctttttgtttttctagaatgcacaatgtactaattactaatttatctaacaatgataaatatatatgaattgtctccatttgtaagcttcacttaatctggatatgttttaaatttatgtattttccactgtatgcatatatgactattttgttagcaaactccaaatcaacatatcacatgaaacttatattgaatgtgtttattttggtaaattaaaaagcttaagattgcttacagaaaatagttaacattcttttatcatatagaactttacttttttgagatatcccaaattatctttcaaggcaaggttttaattaaaatattattatagtgagagtgataaaataccatgtataattaatagtatacatataaaaaagctttctataaataccttgttttataaatattaattattatcctgatgatttaaatttttctctgagtgggctcacactgtaagttggtggctgataaattttagaaaaatacaaataaaagttaaatgaactattttagaagagtaagaaaataaaatcctgaatcttataagtgatttagaagttctgttttctattgctaatataaatagtatttcttttaatgcttgtatttaattaaaagtgaatggccatcataacatttttcagcttcgatttggacaagtcttataaactctattgtgactatatggaatcaaaatgtattaatgttaatatgaaagtggtgggctttaattcagaagctccttttcttaagtgtgttaaaatgtctttgaaactgctttattgtgctttgggatatatgataggcaaaaatttcatagacttgaacccatcaataaagatagtgaatgtgaaactggcaatttttctgttttttaagtacattgtaacatgtacaattactttgaaattaggaatatgtattcaattttattcaacatatgtgtttttagcaccaactatatactggtcattgtggcaaccagtttttgctctcaagaaactgaaaattttatagaaaagacagaattgcaaatagaaaccataacactctgtaataaatgagtgtaaggaaacacaatactaacatacatttaaaaaaaattttcatcagcacagaatttaatatagagtttaatggcgttaatgatgagagattaaaagtcgcgctatttttcacctacatgggacagacctgaaagtcttcgtatagacagtaaatttattacttcccctttggtagtaatgactgtggtgcctggcttggcattcagagcgcatccaccaaggtgcgaaaagttgtcttggtctgttgtctgttctataaagaagataaattacttatcgtaagtatttatgtaaagagaaagctctgtttttacactttgaagctcttttaaataaaattgccagatttaaatttcatatttctttggaagaggttttcagttttgcactcccagtagtaatttttagcgtttaataattgatattggcctttcattagatagaaagtggatgccagtcattccattgaaatactgaatctatttatttcagttattgagtatatatttatcagactcagttttgcccctggaaacaccaacaatcttttgatatagctatgatcagaattgagcttttgaatcattgttgcaaactgggacccttaagtgagcatagttgcaatttggttgcacctacacgaatcctaagtaaaagctcaattccatgaacgtttttgaaattactatattacataattacttttttttaaatgttatgctttttacccttattttatgttggtaccataaagacagaataattattattcagataggcttgccaagtgttttctactctgttactgttataaatgtttattaattagaagaaaatagtttcaatttcatactcttcagggatcctataccactacctggggctgtaagtatctatcttaacactgtaggtttatttaatagtctctcttccaaactagaatgtaaggtccttgaggacaggaatcaaaacttatttcagtttgtattctcatgtctaactctaagcctgctacttactagtctgccaggaaacatttgttgaataattgaataggtgaataaataaacgtttattctgtattcttcaggattgacaaaatgtgccagacttccagaaatttaattttgtattactgtagaaaaaattcttaatatctccaagacttagtttggccatgtaagggctatgagaattaaatgattgatgtatatacatgctcaaccaggcttctgcccctgcatatattaggtattactattattaagcaataataattttcatttctagaggttggccacatcgttttcaaggtatcctgtttcttttgaatgaagtgagaaccactcatgttaaactataaaatgacaacaccataactttttgaaatatcagagaaactggaaaaactctgaaagccagagagagcactattgttgaatacaaaataagaattataaaatacatgttttgcaaaactgaagtgctccagagggaggaaaaacatattccaggaacttttccctctactaaattgaagctgagaggatctcttttttctaccgtgctttcgtgacagcgttgacattatgtagttcacatgagacatgaatagtgaatgactgatcatttttgaaattaaaaatggctaaccgtttatttcttttcaccagagacgtttcattcccaaatttgacagaacaaaactacaggtgtaatgtttatttgcatagttttgttctttttgaaactgcatttatgaggagattttggggaacagggttaaattgtgacagaatagtcttttgtgagtatgtgaacatggaataattgggataaataaatagggtttatgtttcatcttcacttcatctccaacaagtgaagcattatttgtaccattccttatattttatatattttaggaatttataaggttcttgtttaaagtagagtagtaattggaacatgtttaatattgtctccgaaactggtgggttcttggtctcaccgacttcaagaaggaagccgcagactgtcgcactgagtgttacagttcttaaagatggtgtgtccagagtttgttccttctgatgttcagacgtgtttggagtttcttccttctggtgggttcgtggtcttgctggcttcaacagtgaaactgcagacctttgcagtgagtgttacagctcttaaggcagcacgtctggagttgttccttcctcccgtccagagttgctcattcctcccagtgggttcatggtctcgctggcctcaggagtgaagctgcagaccttcgcagcaagtgttacagctcataaaggcagtatggacccaaacagtaagcagcagcaagatttattgcaaagagcaaaagaacaacgcttccacagggtggaaggggacccgagcgggttgcggctgctggcttgggcagcctgcttttattcccttatctgaccccacccacatcatgctgattggcccattttacagagagctgattggtccattttacagagagctgattggtctgttttgacagggtgctgattggtgcatttataatccctgagctagacacagagtgctgattggggtatttacaatcctctagctagacataaaagttctccaagtccccactagattaactagacacagagcactgattggtgcgtttacaaaccttgagctagacacagagtgccgactggtgtgtttgcaaaccttgagctatacacagagtgctgattggtgcatttacagtcctttagctagacacaaaagttctccaagtccccactagatgagctagacacagagcactgattggtgggtttacaaaccttgagctagacacagggtgctgattggtgcatttacaaacttgagctagacacagagcactgactggtgcatttacaatcctttagctagacataaaagttctccaagtccccaccagattaactagatacagagtgctgattggtgcatccacgaaccccaagctagacacagagtgctgattggtgcatgtacaatcctccagctagacataaaagttctccaagtccccaccagactcaggagcccagctggctttggctagtggatcccacgccggggctgcaggcagagctgcctgccagtcccgcaccgcgcgcccgctctcctcagcccttgggcagttgatgggaccgggcgccatggagcagggggcagcaccctgttggggagactcgggctgcgcgggagcccacgggggtggggggggttcggccatggcgggctgcaggtcccaagccctgccccgtggggaggtggctgaggcctggcgagaattcgagtgcagcgtgggcgggcgggcagtgctgggggactcagtgcaccctctgcagctgccggcccgggtgctaaacccctcactgcccagggccggtggcgccagacggccgctcggagtgtggggcccgccaagcccacacccacctggaactcgtgctggcccacaagcaccatgcacagccccagttcccacctgcacctctccctccacacctccctgcaagcagggggagccatctccagcctcagccagcccagagaggggctcccacagtgcagcggtgggctgaaggggctcctcaagtgtggccagagtggacgccgagtccgaggaggcgctgagagcaagtgagggccaccagcatgttgtcacctctcaatatgaacaattttgaccaactttcttttatatatatgtatataacatatatatataacattgtgagaaatatgttctttatatatataacatatataaaacatatatagaacatatatatatataacatatatataacattgtgagaattatgtagacttttaagacttcttttttcaggctttaatactgatttatgaaataaatatgctccataaaaattcttgcaatttttaatagttatggactttaaaatcagttcccaaatacttagtattctcactatactttttcagaaagtatatatataaagagaaaatcattacaactgtgaagtattttatttccctctgttgagattttgagaactattgtagcgtttcagagcttagaagagctacctgaggaattatttgcaaaggggtttcaacacccatctgtcattcaagggtacatttattgatctctagagagtgtaaaaagatggctagatcttcttttctataatgtatatctgtgttttattaaaatgtcacgatgttaccaaacatgctatgtaattatggacatttcccaatgcttaaccctccaaacagtcattctgttacaatctattagcggagggtgctaacagtagaaagaaagtaacagtcatgtaattcgctgcttgcttgctttgtgtgccatagtcaaaactattcaggaccaagagtgttataaaattgtatttttccttccagataatatagttttttggtatcattttcaattgatatcactactgatttatttttcatgactcaccacatactggcttgtgttgttagtctgtattgatttagattattgctaacaatgtagcagagactctgatttttaagatcagcagctactaactatgatttctcacccaggagcatgaggagggaatatacacagctcagtgttgttgttgctttttttccccttaacatcaaagctgttagggaaataatcaagaactacttttactgtgaatgtcagcttgtgaaaattgacatgctatagtcccagcctgactcccatttgtctcaaatacttaattagaaagaaggtacaccatgaaacagttggggcttgatctttaaaacaacagtggaatataattagatttgaaagtgtaaacgggtataaaagggaaggcttagtgaaaaatgattatattattaataatacttgaaattaatattagaattaacaattcagatgtaaataatgctcttttaatttagaaattgtcatacttaccagagctaaaggggcatttttcttttgttataaatggaaatgtgcgtaaaatttgtttgtttcaacctttaaaaaagtgtccttcagatcccataatgtgttactaaataaaactaaaatctagcctggaaaatgtccatactcagatacttagcaggtaaacagactaaaagcctaactttagtagtatgtttccctgtaatgacagcttagtcttagccaattccagtaggtatactttaaccactcataggcggccaactgtttaaactttgtttaaataaggcaaatgctgagctgtaaccaatccagctgtttctgtatctcagttttagtttttgcacatcacatttttttcccatagatgtttgaccttgtgacagtgccaaagtctctccgaattttctttgattctaggggctgatttggaaatcatgttttttttcttttctcaattaaactcttaaatttgtctaaagcttttcttttaacagtatcaataattcacatatttcgggagtggggaataagaatatacctcacaggacctgggtcccaacatactttaaacaagacagatttccaagaaaattgagtgaaatataatagactttctctgggactggcccacagacctcccttatggcttaaatgatattctttattctgagtgtcttgccaggggaaatggaaacagaccctctgaaagggtatcttggcttctcatgacctggattcttggccttaacaccctctaaattaagccactcataattcctggtcttatctttgtcctctttgcaattcgttcattttcttgcatggtggctatgtttggaccgtagccctacaatcaaacacagacctaacatagcctagagactgtgtcacagcctgaggtcacttttaggacaaattaaattttaaatgatttcaaaacatctgagtgcaactatctatagaatgagaaaaattggcacccacaccctcccccatcccctcggcctcaggtgtggaggatggaggctgaaggagctgtaccatggggctggcagaaaccttatctgttgcccagttatcaaaccaaggagtacatgaaacctaatgctgaggggaggctagaggcagatggcagtgtgaggctaaggttgccttcacacagatcagcaactccgtgagaaggaccctagatgataggtattgagttgccgcagctgctttgattgctttgatctgacgcggggatgatgtggttgcatttaaagagcctgggatggatcgggcagaaaatatcagactaagagcttaaaaaagaaacgtgaacacaggagttacctgagttgaggttcaaactctgaaagtaaatccattctctaagaatgaaaacataattagataagagaaaaacctggaaatagactctcagaatttggggatatgtcaaggactgattagtggaaagagccagagaaattaaagactgacaagatggaagggaaacctgctagtaatgtggtacaggtgaaaagaagttttcaatggagagaaggaaatgaatggtgaaaaactttgcagacagggtaaggacaatgaaatttaaatgaaggaccatagttctgttgattaggaacccatgggcggccttcatggtaaattggcctctggtctcctgatgctgccttcttactcttttaattttcatgtgtctgaggcatctggggacatgacatttatttatgactcacctttttgtttttaactctgtaagtttattttcattatattttctttgaagaattagtcacatacattttatttaaaaataatttatggtgccttaattatatttcctaggcatttttaaacagccatttatattttccatatttaaacctatgtatgacgtgcaacactccttttatattctgacccatccactcttaagctctgcatttgctgcatctcttagtttatttatgtattcaatttattgaggatatacactttgtaagttcttatatgacactttttttttgcttatacttagaaaacttgaaagactactagagtcttgggtcaaaagtttttccctttaaagctatatagatgatgtttcgctatgtttttattatttaataaattataaagtgtgaagccaaattaatttttcttcatttttagatattttagctttatctgcttaaaaaaatctccatttttatattaaagttttttactagtatatatttagatattcttttctttgtatgaattgtgtctggtgtatgatggcccctcatatgcaaatttatatagtttatcagctcaataaaattttaagtggtttcaaaagtgtgggctcaggagcaagaatgtctggtttcaacttcaaaaactcccactgactagccctgtggccttggtcaagtcacttaatttactgtaaccctcagttctggcatctggaaaatgagaacaaaaatagcacaattaaaactttataacccttgaacagctactccctatttcccctttcccttagcccctgacaaccacctctgcttcttgagtttgacgactattttagatatctcatgtaaatgcaatcatgcggtattggtcctatgactggcttagttcacttaccataatgtcctcaagattcgttcacattgttacaaatggcagtacttccttctttttaaagctgagtaatgttcacttgtatgcatataccacattttctttatccactcatccatcaatgaacatttagtctgtttccacatcttggatactctgaataatgcttcagtacacatgggagtacagatagatatctcttaaagatcctgatttcaaatattttgaataaattcccaaaagtggaactactggatcatatggtagttacattagtaatttttttgaggaaaccccatactgtttctcatattgacagtgccattttacatttccaccaacaatgcacaagtgtagcaatttcttcacattcttgctaactttaaaaaaatttgttttaaataaaagccatcctacaaagcatgaggcgatatctgattgtagttttgactttatttccattatgactaatgatgttgagcacatttttatgtactgttggccatttgtatgtcgagtgtgtatgttgttgtttttttttgaaaaagttattcaaatcctttacccatttcttaattgagttatttgttgtttgtttttctggtattgttctaaggatctgctttccaaaattgtgactgtagttaacaatactgtgtgatacacttaaaaatttgtttaaagaatatatttcatgtgttctaaaaacaaaagaaatactttatagggttgctgtgatgttgaaatgatgtcatttatgtggaacagttggtgcctactacatagtaaataatatatattaactatcttttttttatgtttactctgaccttttttatggtttaagtctatgagatctgtcatccatatttatattttgtgatctgcttccttctctttgtgcttttcccctgcattctggaaaatcctgtaaaggtcagaggtccaggaacctgagcataagttgtagagaagaagtgggtagcataaggtagtagggagtcaggaaggtgctatgcctctgaaacatgaccatgacaattttttccctgcttgatcttttctcggggtgtgtttataatctaaggactggacccaagtattctgttttgaagtttccctttgactacactaccattgtggctaaatgctacagcttgtttggcttcacacctggctgttccactcaccatggtaatggagagcctgccaccccatcctctctccaacctcaagccatctttactacagagtcaaataatttaaaagcattcaagacaatgccactgtcaggaacattgtatgtcatattatgaactttctaacatataccagagattcctatacaactgtgatcattagttagtgtgaagtaccctgtgaacttctggtgcagcaggatttgattaacacatagcaaaaagaatgaagtgtaagaactgagtgctcaatgaaaatagaaaaagaaagcaataccattatataaagttttttttttaagcacacagaagcttctacagtttttcctacaaaaacaattcttagtaaacaacaccaaaatctcactgttctgcaatagcaaagatcaatatttttatttatgggtctgtgaggcagctaggagttggctgaccttgtctgggctcatgtctgttccacatatctccttctgcagggacgcatggctaaccaggcctgcttttcacatagtgagaatagaatcctaagagaacttgcctaaccacatgatgacatgtaaagactgctcccgtgtcacagttcttcatgtctgttgaccaaagcaagtcacatggcctagcccaaaaaatcagaataggaagtagaagaaaggggaggggatatttgctaaactataatacaatgtaccataaatggtctagttaaaagatactccttaaatgtattaaaaagattgccattggtggcaaagagagataggaaaaacaggtatgagaataaaagaagagaaagaaatgaataaacaaatatgccttgaagatccatcaatgataatgtttcataaactataggtaatatttaactcaaatctgtgcccttgagatccaaacacaataaaaattcctcaagatttactatatgtttgtgcattgaatattatttaaagagattctattatataagagatgctagattaagcataagggaaaactgtcatggttccaagccttggtatttcaaacttgaaaggataaaagttaaaaagtcaatcaagtaaggccaggcacggtggctcacgcctgtaatcccagcaatttgggaggccgaggtgggcagatcacaaggtcaggagatcgagaccatcctggctaacatggtaaaactccgtctctactaaaatatacaaaaaattagccgagcatggtggtgggcgcctgtagtcccagctacttgggaggctgaggcaggagaatggtgtgaacccaggaggcggaacttgcagtgagcagagattgcaccactgcactcaagcatggaggacagagcaagactctgcctcaaaaaaaaaaaaaaaaaaagaaaagaaaaaagaaaaaaaaaaaaagaaaagcacttagaaatgtttagggttctatgaaaccagataagagggagcatgattgtatctagagagtcaaggaaggttctagaagtgattctgagcggaggtctgaaggttatgccaagataaagtcacgtaacaaaagaatcaggccctgaagtatgaggaagaacagtaagtttcaaaaaccaaggccatttttttttcaggaggatggagagggaaacctaagttggatcctgcttaatcttgtagattgtgaagacagtgttaagaatttaaggcatagaatatagggtcactaattactagctcagataaggttcatctctaagttcctttggctacatgaattttttgtattaggaaagtctgacggtgtgccaaatgtcaacttcataaacttaacaactgtgtttaaataaataaattttacaaggaatgtgttatttcatacctttaagggtcgagttacgtttacctttgaaaagcacatttcccaaaacatttagtggtaaatagccctaaagcaagtattttttacaatcttaaatagctgtgtcaatatcctatctgtagaaactgaactatacaaacaccttatattaagtgtcaaactgcataaggaacttgccaacatgttgtcaaaacatattggtcattccaggtgttaaaaacagggaagagggaggaagaagtaaaaaaagcacaggactttctcagtggttacatgaagagttccgcctgctgtttttttttttttctttctcttttgtcctttaaggataccttgacatccagttaaattcactaaaatatgactaagtcacatgcctgcaaaacgtatatatatattttgtgtgtgtatatgtatacacacacacacacacacaaacacacacacacccaaaccactttatagtaattcctttatagtaattcctgatgttaaatcatacttgggagattttgtgaattgcactgttacaaaatcagtcagagtagttgcctcaaagactttgggaaaaagaattttggaaaccatgtcggggtaaaatatttgtgttcttgaaaacaaattacttaatatttgtttttaatgataataataagtttggtattccctgctacaatgtgattgctataactatgaagaaattatgaaggaaacaatgtgagcctgagtaagtaatttcttgataattatgtgtttaagaaaaatgactaaatcaagatttcccctgatactaaggacctaattattttagtccattatattttctttttttatatttttttattattattatactttaagttttagggtacatgtgcacaatgtgcaggttagttacatatgtatacatgtgccatgctggtgtgctgcacccattaactcgtcatttagcattaggtatatctcctaatgctatccctctcccctccccccaccccacaacagtccccagagtgtgatgttccccttcctgtgtccatgtgttctcattgttcaattcccacctatgagtgagaacatgcggtgtttggttttttgtccttgtgatagtttgctgaaaatgatggtttccagcttcatccatgtccctacaaaggacatgaactcatcattttttatggctgcatagtattccatgctgtatatgtgccacagtttcttaatccagtctatcattgttggacatttgggttggttccaagtctttgctattgtgaatagtgccgcaataaacatacgtgtgcatgtgtctttatagcagaatgatttataattctttgggtatatacccagtaatgagattgctgggtcaaatggtatttctagttctagatccctgaggaatcgccacactgacttccacagtggttgaactagtttacactcccaccaacagtgtaaaagtgttcctatttctccacatcctttccagcacctgttgtttcctgactttttaatgattgccattctaactggtgtgagatggtatctcattgtggttttgatttgcatttctctgatggccagtgatgatgagcattttttcatgtgtcttttggctgcataaatatcttcttttgaaaagtgtctgttcatatcctttgccacctttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctcttgagtttaattagatcccatttgtcaattttgccttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgaaggctcttttctgttccattgatctatatctctgttttggtaccagtaccatgctgttttggttactgtagccttgtagtatagtttgaagtcaggtagcgtgatgcctcactgaaattccctaagttttcaagtttgaaacatccttcatacaggtatgcaattaccttctgtagtaattaattatattctcatgataactaagtcgaaacatattgtgtttaacacacactgtaagaatagaaatcaaaagtagaaaatgtgctgaataatgaagaaaataattgaaatcttattattctattttcttggtgtaaatttacattcattctgctatattaattattctcgccttattactctgtagaattatatcacatttttattttaaaaatctaatgtgagcatcaccaatgcaggatttgtctgccatgtgttattcatgttaatacagatatgagtaaatatccatactcataattattgaattttacacatttcaaatttagcagataaaaggacatcacaaagctgatatcatttgttacatattttggaaaccacataatatttaaataagttacatactacccccaatcatatttagaaagatacctaaatcatgaaccaaaaaaaattgattcctttataatagatgtcataaatcatgttcttcctgagtgccgttaggtttgggcactctagagtatatgaaaattattgactgatgtcactagtgttgttgtttttgtttaactcataaaaattatattgtacagcagttaattaacctctttaaaccttgtaatcatataggaataagaagaactattttgctggattattgtttgggcttgatggagaatgacacacttagctcatgtgaagcacattgatgttagttaatttttcctcctctttctcctcacttccagagtgatggaaaaacacaactttgcatctagtttggtacagtgcttacatcctcatcaactgtaaactttaggatattaatacctaaactcttgaagtaactctgatgtcatccatggcactgtaatattcgagaagaaagttttcgtgaaaatatgctgacagggcctttagaatcccacacatttttaaaatatacatattttaataacgttcttaccaaaaattaggaagactttttgtttaaaagacagctttaatttatgtaacttcctactgatatatgtctacttttaccccttgttcaaaatcctaataaaattaagtttttttcttttttttttttgagatggagtctcactctgtcacccaggctggagtgtagtggtgtgatctcagctcactgcaacctcctgccccagagttctagcaattctcctacctcagcctcccaagtagcttggattacaggtgcccgccacgatgccagactaatttttttgtatttgtagtagagacggagtttcaccatgttggccaggctggtcacgaactcttgacctcaggtgatccacacacctcggcctcccgaagtgctgggattacaggcgtgagccgccgcacctggcctagtttatcattttaatactcaaatgatatactaaattagactgtacatataacacaattactatacgctctatgaactaaaatacattttgtgtattttgtgatttgtgagtgtctgcagtgagttttaaagtctagtttactataaatcttaagatctgttctctagttgtagcacctccgtttaatagcaccacatgtttccttttcacagttttaatcagaaatgttgggaaataattgtgtttttatgtgtacattttgtctctccaacctgtccaattgtgaggcccatgagtacaaaagcatacctatgtttctcatccttgtccaccatcttgagagacgaatatgagaagctgtcaatgcgaaaattagcagatatttataggttatagattgaaaacttgccaacaatgtatccccattcttagataaataaattcttagagggtgatatggttttgctgtgtcctcacccaaatctcatcttgaaccgtagttcccataatcttcacgtgtagtgggagagacccagtgggagacaattgaatcatggggaggttacttccatgcccttctcatgatagtgagtgagttctcacaaaatctgatggttttataagggatttttcccttacttcactctgcacttctctttgctgtcaccctgtgaagaaggatgtcttgtatgtttctgccatgattgtaagtttcctgaggcctccccagccctgcagaactatgagttaattaaacttatttactttataaattaccaagtatctggtatgtccccatagcagtgtgagaacggattaatacagtaatttgataccaggtagagtggcactgctgtaaaggcatctgaaaatgtggaagtgactgtggaactgggtaacaggcagaggttggaacagtttggagggctcagaagaagacaagaagatgtgggaaagtttggaacttcatagagatttgttgaatggctttgaacaaactgctgaaagtgatatggacaataaagtccaggctgagttggtctcagatggagatgaggaacttgttgggaactggagtaaaggtcacacttgctatgcatagagacgcagcattttgcccctgctctagatatctgtggaacattgaacttgagagagatgacttagggtacctggtggaagaaatttctaagtagcaaagtgttcaaaaggaagcagagtataaaagcttgaaaaatttgcagcctgatgatgcagtagaaaaaaaaaaaaaaaaacattttctggagaggaattccagttggcagcagaaatttgcgtaagtaatgaggagccaaatgttactcaccatgacaatgggggaaatgtctgctgggcatgtcagagacattcacagcatcccctcccatcacacactcagaggcctaagagggaaaaatggtttcctgggctgggtccagggacccccctgctgtgtatagcctcaggacttggttccctgcatcctagccactccagccatggttaaaatgggccaaggtacagttcaggccatcgcttcagaagatgcaattctcaatcctaggcagcttccatgtggtgttggtccagcgggtgtagagaagacagtaattgaagtttaggaacctctgcctagatttcagaggatgtatggaaatgcctggatgtccaggcagaggtgtgctgcaggggcagaattctcatggagaacctctgctagggaagtacagaagagaaatgtgtggtgggagcccccacacagagtccccactggtgcactgcctagtggagctgtgagaagagagccactgtcctccagtccccagaatggtaaatccactgacagtttgctgtgtgtgcctggaaaagctacaggcattcaatgccagccatgaaagcagccaagagggggctatacactgcaaagccataagggtagtgctgtccaaggccatggcagcacacttctagcatcagtgagacctggatatgatatggagtgaaagaagatcatttgggagctttaagatttaacttcccccctggattttagacatgcatggggcctgtagccccttcattttagctaatttctcttatttggaatgggtgtatttaccaatgcctatacccccattgtatctaggaagtaacaatgcttttgatttcacaggctcataagcagaaggtacttgctgtgtctcagatgagattttgtacttggacgtttggattaatgctgaaatgagttaagactttgagggactgttgggaaggcatgattgtgttttgaaatgtgaggtcatgagatttgaaaggggccagggtggaatgatgtggtttggctgtgtccccacccaaatcttatcttgaactgtttttctcataatccccatgtgttatacatcttggcagctcatgatacacatacacgtaagtgttactgaaatgtcaggggtttggtctaggatcaagcttgtcgaactcatggcccataggccacatgcagccaaggagagctttcagtgcagcccaacacaaattcataaactgtcttaaaacattatgaggtttatttgtgattttttttaaagctttcagctatcattagtgttagtgtattatatgtgtggcacaagataattcttcttccaatgtggcccaaggaagctaaaagatcggacatccttggtctaggtcctgttgctcactgcacagaaagccgatcactgagacaaaaagcattgccagggttggctttaatcaggtgctgcagcccaggagatgggaggttagtgtcaaatacatctcccagactgactaaaatcaggggtttatattgcagagaagaaatgtaactacatgcaggaaaacaggaattagggacagataaagaagatgagttggttaacagtaaacagggactcagttagccagtcatgacagtgaagggtcttgtatctcgttgcccagatgcagtgctctagtaagtttcagttccttgatactctctgggaggcccgatggttggtgtccttagaaaataactcagataaaacaaatgtagctctctcaagttttaagactgagaaggttaatttctatgtttatttaaaagacaccgtaaatatcacttctatgggacagtttaaatcagttgtagtattcatttaacaaattattattgccctcttaaataatggcaaatcacaaaaaaaatctactcgaatggagcttacagatgatggacagagacaggctgcaaaaccatacacaagtaaatatgtaacataatttcacataagcatatgtgctataaaaataatagtgatagagtagtttgtggatgagtatatgcagaggagtttgtgtcatttgagaccagaatgttaaaagaggataatgatgcaagagtcttacaggcaaagacaaaagcaaatggaaaagcttgaggtaggaaggaggttggtgtttgataaggtcaatatggatgaattatttctaaagaacattcaggagaagggggtgtgagatcaactccatctccttgtgagctttttcattttttatactctcacaactcagtaatttctatttagtgaacgtgttaaatgaatgaatgaatgaatgaaccccacattacctagggttaagcatggtactataactcatatgagcaaagcaaaaagaataaaggtggaagcatcacactaccctacatcaaactatattattaatacaagactgcagtaatcaaaacaacacggtactggtacaaaaacaaacacatagaccagtggaacagaatagagttctcagaaataaagtcacacacctgcaaccatctgacatgtgacaaaacttacaaaaacaaactatagagaaaaattgcctattcagtgaatggtgctagtatactcgctagccatatgcagaagaatgaaactaggcctttccttcaaccacatacaaaaatttttttgatatgaataaattacttatatttaagacataaaactataaaaatcctagaaggaaatctaagaaatatcattctagacattgctcttggcacgtaagttttgactcagtcaccaaaagcaattacaacaaaaacaaaaattgatgagtgggaactaattaaactaaagagctttgccccagcgaagagactatcaacaaagtaaacagacaacctatagaataagagaaagtgtttatgaactatgcatctgacaaaagtctaatatccagcatctataaagaacctaattcgacaagcaaaaaacaaacaccctattaaaaatcagaggacgtgaacagacacttctcaaaagaaaacatacaagcaactaacaaacataagaaaaaatgttcatcactaataatcagagaaacacaaatcaaaaccacagtaaaataccaccgcacaccagtcagagtattgattattaaaaagtcaaaaaacagatgctggtgaggttatggggggaaaaaaaacacttattcattgttggtgggaatgtaaattaattcagccactgtggaaagcagtttggagatttctcaattaacctaaaatggaatcatcatttgacctagcaattccattactgggtatataaccaaagaaaaataaattgctctaccaaaaagtcacatgcacttatatgttcatcactgcacttttcacaatagctaagacatggaatcaatctgagtgtccatcagtggtgtattggataaagaaaatgtggtacatatgcaccatggaatactatgcaaacataaaaaagaatgaaagcacgccctttgcagcaatattgatgcagctggaaacaattataccaagtgaattaatgcaggaacagaaaaccaaatactgcatgttttcacttataagtgggagctaaacattgggtacacctggacaaaaagatgggaacaatagatactggagactattagaggaggtgggggaaggaggggagcaagagctgaaaaactacatattgagtactatgctcactacctcgatgactggatcaattgtaccccaaacctcagcattatgaaacatcgtgtaacagacttgcacatgtaccccaaaacctaaaataaaagttgaaatttaaaaaaaaaataagaaaaagggcagaggcgcctgtggtcgccatcacttgaaagttgtgaataggtaaacgaatcagctaaatagaagaatgaagagtgatcactaaggcagccagtagtgtggaatatgatattctataacccatataaagagtgttccaggaaagatagagtgattaactatcaaacctttagacagttttcatataaacaaggactgaaaaaatgctgtatttcacaaataaatagaaataaaacatatgagcatgatgacaggttagtagtttataaaatttttaatttctaatattttagacaatttttaaatttctcttacaaatatatcttatataaataagtatattattacttagttgtatgatactaatctttaaagttaagtatattttatctaatggaaaacaaaaagcccctagagatttgttttaaattgtgtttaatttctggctggatgtggtggttgatgcctgtaatcccaacactctgggaagccaaggtgggtggatcacttgagctcaggagtttgagagcagcctaggcaacatggtgaaaccctgtctcttctaaaaatgcaaaaattatccaggcatggagcgtccctgtaatcgcagctacttggtaggctaaggaacgagaatcatttgagcctgggaggcggaggttgcagtgagccaagatcacgccactgccttccagcccggacgacagagtgaaactctgtctcaagaaaaataaggtaaaataaacaaataaacaaatataaaattgtcattaaattcagttattattctatgttggcaacgttttcagctcactttgatttagtaaccttcctgtaatagcatgctcctattttgaatattttatttctaaaatacatgtatccttctgaaggagactatgttactttaccaattagaaaggctcttcctcatatctaagtatttgttgaaaccaaatctcattctgtcttcagcagtgaaggagcaatggctatgatttttttttctaaaaatcttttaaaaatctatttaaatgctgtggtctagtggtaatactgtgtgaatacagggaaataactaatgacctcaagatttttctaaacctaaatagagaacactatatttggttgatgagagtacggaaccaaaaaagtaatttactggtcagtaagaactttaagaaagtaattctgtatactgcttttagtgttcatattaaagcaattttatcacaatttcaaaatgatatagaaaagaaatatatcgccgtagtaacgcaattttaaatattgatttgtttttttaatttatttttttaatatactttaagttctagggtacatgtgcacaacgtgcaggtttgttacatatgtatacatgtgccacgttggtgtgctgcacccattaactcgagatttacattaggtatatctcctaatgctatccctcccccctccccccaccccatgacaggccctggtgtgtgatgttcctcgccctgtgtccaagtgttctcattgttgagttcccacctatgagtgaaaacatgtggtgtttggttatctgtccttgcaatactttgctcagaatgatggtttccagcttcatccatgtccctacaaaggacatgagctcatccttttttatggctgcagagtattccatggtgtatatgtgccacattttcttaatccggtctatcattgatggacatttgggtttgttcaaagtctttgctattgtgaatagtaccacaataaacataggtgtgcatgtgtctttatagcagcatgatttataatcctttgcatatatgcccagtaatgcgatggctgggtcaaatggtatttctagttctagatccttgaggaatcgccacactgtcttccacaatggttgaactagtttactgtcccaccaacagtgtaaaagtgttcctgtttctccacatcctctccagaacctgttgtttcctgactttttaatgatcaccattctaactggtgtgagatggtatctcattgtggttttgatttgcatttctctgatggccagtgatgatgagcatttttttcatgtgtctgttggctgcataaatgtcttcttttgaaaagtgtctgttcatatgctttgcccactttttgatggggttgtttgattttttcttgtaaatctgtttaagttctttgtagattctggatattagcccttttgtcagatgggtagactgtaaaaattttctcccattctgtaggttgcctgttcattctggtggtagtttcttttgctgtgcagaagctctttagtttaattagatccaatttgtcaattttggcttttgttgccattgcttttggtgttttagtcatgaagcctttgcacatgcctatgtcctgaatggtattacctaggtttttttctagagtttttatggttttaggtctaacatctaagtctttaatccatcttgaattaatttttgtataaggtgtaaggaagggatccagtttcagctttctacatatggctagccagttttcccagcaccatttattaaatagggaatgctttccctttttcttgttttggtcacattcgtcaaagatcagatggttgtaaatgtgtggtattatttctgagggctctgttctgttccattggcctatatctctgttttggtaccagtatcatgctgtttttggttactgtagacttgtagtatagtttgaagtcaggtagcgtgatacctccagctttgttcttttggcttaggattgtcttggctgtgggctcttttttggttccatatgaaatttaaagtagttttttccaattctgtgaagaaagtcattggtagcttgatggggatggcattgaatctataaattaccttgggcagtatgaccattttcatggtattgattcttcgtatccatgagcatggaatgttcttccatttgtttgtgtcctcttttatttccttgagccgtggtttgtagttctccttgaagaggtccttcacatcccttgtaagtagggttcccaggtattttattctctttgaagcaattgtgaatgggaattcactcatgatttagctctctgtttgtctgttatcggtgtataggaatgcttgtgatttttgcacatttattttgtatcctgagactttgctgaagttgcttatcagcttaaggaggttttgggctgagatgatggggttgtctaaatatacaatcatgtcatctgaaaaaagggacaatttgacttcttcttttcctaattgaatatcatttatttctttctcctgcctgattgccctagccagaaattccaacactatgttgaataagagtggtgagatagggcatccctgtcttgtaccagttttcaaagggaatgcttccagtttttgcccattcagtatgatattggctgtgggtttgtcacaaataactcttattattttaagataggttacatcaatacctagtttattgagagtttttagcaggaagggctgttgaattttgtcaaatgccttttctgcatctattgagataatcatgtggtttttgtctttggttctgtttatatgctgcattacgtttattgatttgcgtatgttgaaccagccttgcatcccagggatgaggcccacttgattgtggtggataagcttcttgatgtgctgctggatttggttttccagtattttgtttaggattttcacattgatgttcatcagggatattggtttaaattctctttttttgttgtgtctctgccagctttagtatcaggatgatgctgacttcataaaatgagttagggaggattccttctttttctattgactggaatagcttcagaaggaatagtaccagatccactttgtacctctggtagaatttggctgtgaatccatctggtcctggactttttttggttggtaggctattaattattgcctcaatttcagagcctgttattggtctattcagggattcaacttcttcctagtttattcttgggagggtgtatgtgtccaggaattcatccatttcttctagactttctagcttatttgcatagaggtgtttatagtattctctgatggtagtttgtatttctgtgggctcagtggtaatatcccctttatcattttttattgtgtctatttgattcttctctcttttcttctttattagccttgctagcagtctatcaatttagttgattttttaaaaaaaaacagctcctggattcattgattttttggaagagttttttgtttctctgtctccttcagttctgctctgaagacctgaaggtgttaaagtcccccattattattgtgtggaagtctaagtctctttgtaggtctccaaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgctattttttttttgctttccatttgcttggtagatcttcatccctttattttgagcctatgtgtatcgctgcacataagataggtctcttgaatacagcacactgatgggtcttgactctttatccagtttgccagtctgtgtcttttaattggagcattcagcccatttacatttaaggttaatattgttacgtgtgaatttgatcctgtcattatgatcttagctggttattttgctcgttagttgatgcagtttcttcctagcatcaatggtctttacaatttggcatgtttttgcagtggctggtactggttgttcctttccatgtttagtgcttccttttaggagctcttgtaaggcatgcctggtggtgacaaaatatctcagcatttgtttgtctgtaaaggattttatttctccttcacttatgaagcttagtttggctggatatgaaattctgggttgaaaattcttttctttaagaatgttgaatattgtcccctgctctcttctgacttgtacattttttgcttagagatccacttttagtctgatgggcttccctttgtgggtaaccagacctttctctctggctgcccttaatattttttccttcatttcaactttggtgaatctgacaatcatgtgccttggagttgctcttcttgaggagtatctttgtggcgttctctgtatttcctgaatttgaatgttggcctgccttgttaggttggggaagttctcctggataatatcctgcagagtgttttccaacttggttccattctcactgtcactttcaggtacactaatcagatgtagatttggtcttttcacatagttccatatttcttggaggctttgttcatttctttttattcttttttctctaaacttctcttcttacttcatttcattcatttgatcttcaatcactgataccctttcttccacttgatcaaatcggctactgaagcttgtgcatgcctcagatagttctcgtgccatggttttcagctccatcaggtcatttaaggtcttctctacactgtttattctagttagccatttgtctaatcttttttcaaggtttttagcttctttgtggtgggttcaaacatcctcctttagctcggagaagtttgttattactgatggtctgaagccttcttctctcaactcctcaaagtcattctccatccagctttgttccattgctagtgaggagctgtgttcctttggaggagaagaggtgctctgatttttagaatttcaacttttctgctctggtttctccccatctttgtggttttatctacctttggtctttgatgatggtgatgtacagatggggttttggtgtggatatcctttctgtttgttagttttcgttctaacagtcaggaccgtcagctgctggactgttggagttgctggaggtccactccagaccgtgtttgcctgggtatcactagcggaggctgcagaacagcaaacattgcagaatggcaaatgttgctgcctgatccttcctctggaagcttcgtctcagagtggcgtccggctatatgaggtgtcagtcggcctctactgggatgtgtctcccagttaggctacttgggggtcagggacccacttgaggaggcagtctgtccgttcttagatctcaaactctgtgctgggggaagcactactctcttcaaagctgtcagacagggatattgaagtctgcagaagtttctgctgccttttgttcagctctgccctgcccccagaggtggagtctacagaggcaggcaggcctccttgagctgtggtgggctccacccggttcgagcttcctgtccactttgtttacctactcaagcctcagcaatggtggatgcccctcccctagcctcactgctgccttgcagttcgatctcagactgctatgctagcagtgagtgaggcttcatgggtgtgggaccctctgagccaggcgtgggatataatctcctggtgggccgtttgctaagactgttggaaaagcgcagtattagagtgggagtgtaccaattttccaggtaccatctgtcatggcttcccttgtctaggaaaggaaattccacaaccccttgtgcttcccaggtgaggcaatgccccaccctgctccatgggctgcacccactgtccaacaagccccagtgagatgaacccggtacctcagttggaaatgcagaaatcacctgtcttctgcatcactcacgctgggagctgtagactggagctgttcctatttggccatcttggaacctcctccaaatattgatttacttgtaaatagatagcttttatcattattcatggtccaaaaaattcctcttgacatatatacagctatgcatagagagatacggtagaatatacatactatattatcatgaatgaagtagaaattaatatttaaaattttcatattgattttaaatgttttctatagtttactttaaaaaatatgattatttgaagtatttaattgaaagaaacattaacttattgggtatatataaaagagacttctgtctattcctaatacaatttaaaataaaagcaaatatttggaaatttaatgtttgtctaggccaggtgcagtggtttacacctgtaatcctaatactttgggaggccaaactgaaaggaacacttgaggccaggagttctggaccaacctgggcaacataaagaaatccttatctctacaaataattaaaaataattagttcagcatgatggcatgcacctgtagttccagctatgtattaatccattctcacatggctataaagaactgtccaagactgggtagttaataaaggaaagagttttagttgactcacagttccagagggatggggagacttcaggaaacttacagtcatggtggaagcggaagcaaacacatccttcttcacatggcagcagcaaggaggagtgccaagcaaaagggggaaaagccctttataaaaccatcagatttcgtgagaagccactcattgtcccaagaacagcatgagggtaactgcccccatgtttaagttacctcccaccaggtccctccaacagcatgtggggattatgagaactgcaattcaagatgaaatttgggtggagacaaagccaaaccatatcaagcctcttgggaggctgaggcagaaagattgtgtgagctgcagtgagctataatcatgccactgcacatcagcctgggtgacaacacaagatcctgtctttaaaatatatatacatatatatatgaatgattatttaaatatttaattgtcacatatataataattaaaatatataattcataaactcatttactatattattttagtttttaaaacataactaataagggtgagttttatacattagaatacttcgatcatatctattatattttagtggaataaagtattaaaagatacttaataaatgctaattcataattttaagtgatcaagtttataacttttttagagtacttgaaattctgggtttcaaaatgacaattttttccaagattaaagccacagctatttttataatttcttaaaacaatgaatttgacttgattcattttgtaaatttcccagaaataatattaggaattagagctgtttcccaaagcctattacctttacctattatatagcttatttatgcaactattttaaaaagactttggaaagaagtaaagaaaggaaaggagggaggaagggaaagcaaaaagaagggaagaagggaaggaagattttaggaaaggacagagagagaaaaaaacttttaaatgttttgagaggaaagtctacatcattttagttatttagtatagttatcataatatgtgatataaaataaaatgtgctttgataacaagggtgataaaagaatcaaaatgtttcttgcaggctaaatgagtcctctcagggccacactttcatgatggtgtggtatatctatagaataattgcaatcttagaataaaaagtttattgatgtagtcactatgtaacatgtatgttcatatttgtatacatacaatcttatctgtaaaaatcatctaggaagttctaagattttctggatagcaaactattttagtcatatgttcatatttatatacatacaatcttatctgtaaaaatcatccaggaagttctaagatgttctggatagcaaactattttaggcatctgagagataacattccataataccagcatgttttctttttcattttatcaattacaggcataattccatatgcaaaaaaaaattttggctttattaaaaagaagattctaagtataattaacttattttatgtttttgagagccaatctgattgtcataagtaattttagtcaccgtcctacagactgaatgggtcctcatgctagcaaaaactctaaaaatttgttcttgaagcagttggtgctataattatcctctttcatcattgacctcctgttctggaggtgacttgaattatgtgctgcataacctcttagaaagtgttctaaggcgagatttactagggtatcaaattctatagtatctttgccaagcacttttgctcaattgtattgccaccttattttcctggtaaaggactattgcctttaagatagtactgaaaaatgttaagttgatttgttattaaaagacttcggttttagtgtgagccaagtttgttcaattaataactttggcattttccagctaagaaaatttcagaagataattcttaaagcctagattttattattttaaaaatataggtagtagggctgggcgcggtggcttacgcctgtaatctcagccctttggaaggcaaaggcgagcggatcatgaggtcaggagtttaagacctggctggccaacatagtgaaaccctatctctactaaaaatagaaaaaaattagccgggcatggtggcgggctcgtgtagtcccagctgcctgagaggctgaggcaggagaatcacttgaacctgagaggcggaggttgcagtgagcggagatcgtgcaactgcactccagcccgggtaagagtacaagactctgtctcaaaaaaaaaaaaaaatgtaggtactattaataccaacttctgaacttattgtaggtatgaaaatgcatgtaatacatgcagtctgatacatagtaaaatactcaaactgatagctaacaactcttgttattatcattattattcaaatgcaagcaaagttgctgacattgcatgacactgtgccccaagtcctacgatgtcttctgctaaacccccactctttcacaagcaaatcatatacaaggtttgccattgtatatgattataataagtctgattctgtccatataggccaaagtttttctaaaaaaatgtgtccttgtttctataaatcttcagtgggtgaactgaccatccaccactaggtgaaatcagtggtttatataaaaatattatcccagaactggcagttccctaacatgctttcaaggtttattcaatgttctctatttcccaaaccttcaaatatatgaatactttagatatcagttgaagtgtctgggcacccttgatgtgtggttatccattcacttatttatgcaaataaattttttataaataaaatttataaataaaatttttataaataatttttaaataaatttataaaaattttatgaataaataaaattttataaaaattttatgaataaataaaatttataaaaattttatgaataaataaaatttataaataaatttttttataaataaaaaattatttattcaaatactccttgagtacatattatgggtcaggtaacattcaaggtactcagctacagtccctaccctaataaagcttgtattcttatgtgggagacaaacagtaaacaagtaaatacataaaatatatgctataatttcagacagggttgctgaagaaagataatttaaagggagtattagagaacgcctggagaagaggaaggtaaatttattagccaaaaatctgagagatgagtgtattatattgccaccttattttcctggtaaaggactattgccttggcaaagccaaggaggcaggaacaaggaaaatgtgtgaaagggaaatgaacaagatgaaatcagatgagtaggcaaaaaagaaatgtttttaggatcagattgcccttactaacaactttgtatttattttttttgtgtgtgatgcaaaatcattggaagggtttaagcaggagtcatgagataattttaatacaatggaagcagaaagtcaattaagagtctactacagaaaacacagaggatatgagaagacattagggcctatactcattgaggtattggcaggatgtgatgatgatttggctatggggcttaagagaaaggatcaatgattacccctaggctttcagatagaacaccttagtaaaaggtagagccattatctatagtagaagagttataaatttgggagatgaaatcattctggttttgaatacatttatttgaaaatagcatatctgtggacaattatgtgtactagtttggacttaaaatgttcagagtttagccagatattaaaatttgatatttatgaacaaatagaagatatttgaagctatcagactgggagaggttccaggggccgagagtagaagtagaaaatgtagaagttcttgaaacagagccttggaaaactccaacatttagtagccagaaagagtgggaacaagcagagtctgagacagagcaccagatgggaaggagaaaaggcagaatagtggaaaaaggttaaataaagaatgtattcaaggagacagtcatcagtggtgacgtgtagtatatgaaaggactgaactaacagaaaatagggaattatacaaatcctgaaaactcatatttatctcatagcccaactgtaattcaggaaccaacatgagcaacagattattttcaaggacagtcttgaagaaaatggaaatataaaaagcaatgttctcagaacagtttttacaccaaagtgtcaagtccagccaaatcaacaccctgtggggggtaatgttcttacttcttcttcatcagaataatgccaaataggagtgtttctttctctgaagaagttaatgttgtaatttagtgtttaggtttgaagtaaaactttaccacatactagttctctgctcaagatatttatttgacttctaggttttaagaaatttacaaggcctaagcactgtaaatgttacagtgctcacctcaatgtcaccctacatagttccaaaggaaaccaatctgaaacctaatataagtgaggacagccagcaaaattttgactgttcctttacaatcactttgattcttttaaaaacttatcaaattttaattgttttctttaaaagtgactttgtttggtgtcccaacttatcttggcctatctctggaatatttcagcactctttaacttattgtaagccacaagttccttagctctaaaatgggtaacagagtacacatacatcatctttaatgtggttccggcaagtggtaagcatctagcaattgttagcgtcattaacttaccattattactatcatcttcattattaatgtcatcttaaaagattgagcattaacctaatgatgtatagaaatacctagcatggtaatcaacacagtgtagatggtaaataatttttgtttttttagctttcatgtccattcctgcactttactacagtcctctcaaattagccaagcatggttgcacacacctgtattcccagctacttgggaggctaaagtgggataggaacacttgaaaccagaagttttgaggttatggggaactatggtgatgccactgcactccagcctgggcaacaaaggaagaccctgtctctgaatttaaaaaaggagatattgggtgttttgggaggaagatgtaattcacataattaaaggaaagtggtagagaagatgcccaaagcaaccattaatttttctctcatataaatcattttaaaataacctgtagtagagatacttcattgattcagattgagttatcatgaagaaataatgatctggctacatttcagctctgaaagaatgaaaatatggaaatatgattttcacttctaaaagaccatgaattttaaagatccatttaatattatcattgcactgtgttttaacttggtaacagcaaattaataattaataattttattttagggattacctgcaagtcgtgtgaggtatagagtagatgatgtacagtttccttaccctgccagtatttttgaagtggaagaagattctggaagagtaataacacgagtcaatcttaatgaagaacctacaacaatttttaaggtcagtgtctcttttcattatgtggtctatttgatgtttaatttttgatagagaatttggcttaacagatgacagcacatttttttctttcaatttttctcctttttaatttttttaaattacaatttttttttctcttagaaacttacaaaaatagtaaaaagaaaaccacttggtatctcacatcttggaaatagctagaatttgcgttttgatctctatcctcatgatgacatttcatacaaacacaaatatataaatatatgttttcaaatcacatagtcttatacatactggtttttaaattcaatatgatgttgtctatgccaataagtgacattaatactattattttagtggtttcatagtattttactatataacattttgtttttctttttaatataatactgagttgctttataattagactttccattttttgttacaataaatgctatcatgcaactacttgtatgaatatcatttttcccttactcacttttttaagataagattgatatattacaatcctagaaaatttgaaaaaaataccccttgtatgcattcttcatctttcctgagagtatccattttcctaataccactcaatactgattgttgttatgttaatctttgcatatatctaggaaaatatctgtatctatttgattttttgtcaaattttacttttcttcaaatactaatgaaacagaacatattccctcttttgttttttacatatttaaaaatatatttgacaaaataatgcctgtctctacctggcaaggtattaaaacaataatttgcattaccataagtagacaattttattaagtgtttgaacatttccatttttaatagttacttagaataatttttgtcactgtgaataaagtctttgactctacagtagggaaatagctttatcagttaaccacgtaaggatcagtgagcactatgtctctcatgattttaccgctgtttggaacagctgatcagtttgtaaattagcattaacccaaaggtcaattgtggctctcaggatgatccttggttacagtcttctgtgatctaggttgaattagtttacattgttaacctgcagcttccaaaacaatttatattccaaagaagcacatagttctgaaagtatttaacatgtcttaaagtaaacatagaattactttgatgtaatgtaggttattaaagaaaataatcaattataaatcctattgcagtgataaataatgtcagacatcacatctcaacactaaagctttttcttagttttcatcatttgaacaatttctgctataccaaatgaacttggccttataatttgtttttaagagatagtataccaaagagtgttaaactataaagatttccaattttatcctctagagtaaagtatttctgccctataatctcaaaaacaactaattcactaggaaaattaatttcttttttgagcaagataattagctttttatgtgtctgaatttaacacttcttaaataagtgtattggtgctataaaatcatgtgtatttactgtgggcttcagtggaattatagaaatgagtctttaattggagagatatagtataatacacttgttttactggtagttgttttttaatcatagagttagttacttctttgagtattctcatctagcaagtgaaaataataacatttatctggctggattattgtaaagattaagtgagaacgtagtattttctagcatagtgtctgccacctggtaggcagtgaggaaatgatcattgcttccccttctggaaccaggcaatccaataagtaaaaacatacatataaaaattgtgctgttacgctgttcttacttataatctttaacatgaatttttattgctttttaagttggtggtggttgcttttgatgatggggagcctgtgatgtccagcagtgccacagtgaagattcttgtcttacatcctggtgagatcccacgcttcacacaggaggaatataggtattgatttctgtccgattttgaaatacacgaaatgtttagggcatttttgaaaggagtctctcaaaattgatgtaatatgaatttatgagtagacttccaattttggtttaggcgtttctaaattaacataaaatatagtttaaatttttaaatggttaatatgacaatttagtataaaatatgttttagtaatggtttaatgaataatggatactttttaaaaaattagtgcaaacttattaaaatacaacattatattttggggtttcaattctaattaatgatctgaatggtgagaaatagatctttagtttctcattattgccaggtggaacatttcattcaatttccaattttggcatgcaatctgcaatcatattttccatctaatcagtgtgtatgtgtgtatgtgtgtacgtttgtgtgtgtaaatatgtagtgcatgtgtatatatatagtgtgtatatatatatataaatgtagtgtgtgtatttatatatactgtgtgtatacataaatttatatatatactgtgtgtatatatatatacacactatatatacacatatataatacatatacatttatatatatacactatatgcatatacaccaatattatatattatagtttatggttagtatatatactgttttagtcaactgaggcagccataacaaaataccataaattgggtggcttaaacgacagaaaattctgttcttttttttttttttttttttttttttgagatggagtcttgctctgttgcccaggctggagtgcagtgacgtaatctcgggtcactacaagctccacctcctgggtttgcaccattctcctgcctcagcctcccgagtagctgggactacaggtgcccaccaccatgcctggctaattttttgtattttcagtagaggtggggtttcactgcattagccaggatggtctcgatctctgacctcctgatccacctgcctcagcctcccaaagtgctgggattacaggcgtgaggcactgtgcccggccacaacagaaagttattttcttattgttctggtagctgacaatccaagtttaagaccagggtgtctgcatggtcaggttcagggtctcttctggtcttaataggcagctgcctttttgccatgtccttatctggagagagagagagaaagcaagctctctggtatctctggaaacaaataactatatgaaaaatataatacactgtgagaacacaatggtagaaataagatcacagtattgaggaagcaggctaagggacacttaactatatttgaacatgattaacacagttttaagttgtagattgaaggaaatgtagagtttagtcaatccaaaaagatatagatggatattccacaccaaatattcagcctatgcagaaatataaataaggggtgtgggagtctacattaaattccagaatattttagtagtttagtctatccaaagaaaaattgaaagttggatgatgataataattgaggataatgaaaaatgaatatttcaggtaatggagaacttgatcatgttctaggatgactttagtgttttttactttcttagaatgaattaataattttaagctagaacagcagctaaggtactgaggaataaggtaggtgagggatacatctgcaagcacttaacccactgaaccaagcagtttcatcctctcatacaaagctgcgtttagaagaatctacacaaaattaaattatgtaatataattaccagaaaatcttccatagcatgtatgtaaatcatcgagatgtaaaccatatgtaaaacaaataagaattcttgtttaatctgttttaaaaggttattctcacccacatgtacattattatctattattttccttttttttctgacacagtaacctgtgcttccaatcctttggattggattccaattctttgctatggaatacagtagtcccctccttatccacagtatcatttttcacagtttgttgcccgaggtcaaccgtggtcagaaaatattaagtggaaaattccagaaataaacaattcgtaagttttaaattgtatggcattctgagtatcatgatgaaatcttgtgctgtcctgtgtcactctgccctggagctgaatcattcctttgtccattgtatccaggctgcccatcagtcacttagtaactgtctgggttatcaggaaaaaaaaaaaaacatagtaaatataggctttggtgtcatctgaagttccaggcttctagtggaggtcttggagtatatcccccataaataaagggggactcctatgcacagttttctgttttggaagaacttctctgaacatgttaattttggagttctcaagaacaggacggatataaactcactttgtttctcactaaattatctagatcaggtgttctcaaaaaatatacttagtcttctaagtggatccaaaaaaacgctcacagttttaacttaaaattcccatctgtgttcttcaaagccccttgcggcaagtctaattatctttggaaactccaagagaagaaagtgatatattgcttaaacttcctctttaaataaacttaagtggtgtactgtttctctaggttttcatttagagctcatttccttgtcaatagaaatatgcctctagacttctcttttagctaaaatattgtggcattgaggccaaggtcataaattgaaacagggcattgctcatttaactttctttattaagtatctttgcttaatgccatgttttaaaaatgcgaatgtgttgttcaacgtataatttaccatttcataccgtctctgcatagaactattaactacaaatagattctcttaataaagttgttgttaacttagagagcaaaagttagccaattatatggtactaaaattaacaacagtcacatgggtacatgtgggagaattttgatcttccagaattctaacaattacaaaattgcccttgattatcccagttcatttgttattctgagttataaagagaatttggtaatcttgttgcatcctactgtgtattaataatatacacaactgtacacacataactcccagagatgctaagaatcagtatcttgatcataatgcatttagtagtacttgagtacttaaaaggattaattttttatcaaataaccagaaaatttgaaaaataaatgttatgccaaatatgaacaaggacactactttttggataaatgcaaataattgaatataaatgtttatataggtctaaatttgaaccaaaattttaactgaactataaagaaacttaaggctaatgattatcatcttcaattatctcttcattctttttgaagaccattgaggaaatacatagcagtatctggatgcctcctaaatcctttttctcacgggcatatagctggattacatttcctctccttattaactagggatgaattctgaattctgccgtttgactgatttctggccaaaaaaatatggaactaagtggtctgcatcatttcctgagcaggcttagtcctattagctactgttgtttcaactaatataagttgttcaacattttattagtttccaacaactaatcgcataattaattaatcatatttaaaagtcattctcattcatattgcaaaatatgaatatatggaaatatgaaaatattcatggtagaatatttttatttctgtatggtattttcttttaatatgttcaattgctagctttggcaatatgcctatgccatttcaggctgctttagaggccaacacactttcctttcttaatgaaaaaaagtgaagcacagaatggtttctgccaacctcatatgcctcattcttctctaattttttcaaattcattttactgcctcaactggatgcacattattcccagagatgctaaatgacattattaatttttgattattaggatggtctttcgtgttgggattgctcctagtgaaaaaacttctacttcttgtgatcaaatttgggggaaatataaaaatgatagctcaagatttatgttctttgtagggtgtaggggaaggtaatgtgttacaaatggaaagcagtaatctagcactgtaagctgaggtacacatggcttttacatctcaggaatgtcttcgttccaatacttgtgtttgaattccataggaaaaattagcatttaacaaatgattaggtataaaagagagattttaaagataaagtatttatttatcgtagaatgtttaactgaattattgacccatacgtccccgttctgtcactgactccgttgacttatttctattagacagtcattaaatcattaaatctcagggtaatcagactgagttagggtagtttaggtcactgtaataggaaaccaccaaatatcaatggtttaaagttcagggacctgggacaactcaggggtcaccatcttcaacactctatttcaaaataactcattattaccattttagtcagcagaaaggggaaaccagacagaagtccacatctagagatttccttaaccaagtgaggtgagaattgcacatttcagttcagctcacattacgttgtgagaatccaggtacgggtctacatttagctctaactaggggagaggaatgctgttccttgctaggcaactgtgtcctagttcaacctcagttgttgaggaaaaaggggaaatggtgtaggtgaagacctagcacattaaacatgtgattgtaaacaatttacagattcatagattttaattgccacagtgattttaaaatgactgattagttagaatgcaccatggggtacatgagctaatgatagaatagaaacatttttacatttaaatatgcgttagtgaagtaaattgttcttaaaatatcaagagaatgaatatttattttcttaattcaaagcaaatctcagattaacatttctggttgttttaaaaatctgtatttttagtgatttcagtttaatgagtattaacattacatattccaagccaaacctttctggacttcaagctaaaggttgaatattttatacaatgaattactttctccagttttctgagaagttgcagtgtcttggtcacagaagtaaaatataaagaaaataaaaatgaaagcataatggcaaagtgtaaatttgagttatgagctgaaaactagcattgtgaagaccttgatcaaaaatggttcagagttcgcatttactatttggcatacgtttttcagtataccagttctagctagacagagaaacaaaatccattgttctttttttagaattgaaagcacttctatgttgttctattggtaattgattagttgctggaatataacaatagacctatcattgtcttcttccaaaattgtaaaatagcaaaataatagacacaagtaataaacaccacagtaagtactttaatatttactaaaggaaaaacctactggtttgcctgtgaagttttgatgacagataattagtaggctttctgacttatgtaaaagtaacaacataataaaaaaccagccccttcttccacatagttaatcatgctctgcctctgtttcatttgcatatttaaaaacttctttacagccgggcgcagttgctcacacctgtaatcccagcactttgggaggcctagatgggcggatcacgaggtcaggagattgagaccatcctggctaacacggtgaaaccctgtctctactaaaaatacaaaaaaattagccaggcatggtggcgggtgcccatagtcccagctactcatgaggctgaggcagaagaatggcatgaacccaagaggctgagcttgcagtgagctgagattgcgccactgcactccagcctgggtgacagagcaagacttcgtctcagaacaaaacaaaacaaaacaaaacagaacaaaaaaattacttctttactttctgctaatgctcccttaatgaagtttgaaaattattgaagaattttacaaagacaaccctatactcaataaaataaattaggttgtcattatttaaaaacacatttctcaaggaaaatgatgtttttctggtttataatttataatattaagatattttatatgtattgggaaaagatttgattttttttttcaaatcctgtgaactgatgttatttcctggtggctggctttcaataatcattaagggtaggagtaatcacataatggcaagaaaattgcctcatatgtttacttttataatggccagagttatagtagataagaattactatacacttgattctctttgctttgtagggctgttatagtaattgaaacagactcattttgttaatttcttgaccttttcacatcaatcttttatggagtcacttaggtgaaatggaggatcaagacattgtgtgcttcatttgtcattaatgatcaattgttctatccagaaaacaatgagttcttcttaaaacttttgaaatatatatctcttcatactgtatactattccttttgatgacaacagcgacctgtctggagcatttgctgcaaagacgctggctgcaaccagggaaacacagctggggctatgcactctgcagagtcagtgagagctgagaacaggcaggggccccacccacttctgagttggaggggctggagcccagagctctcaggtgcaggtgcaatcacccagctgagactgtggacctgggcccccctcctgctgcatgctcaaagtgtgttctcccaatgcctggcctctccctgcttccagggcctgctccaatttcagagcaaagctgtcatcaagccccgagcattgtcaccacctggctgtgtgttcccacactcatgtggtgctgacataccagccccttgccacctcagcccactctggactttgggcaccaatgagcatgggagagaagccaaggtggggctgggggtggcctggagcgggcctgcaggaacctcttgggcacaaacagcctgggtgccatgaatggcagcagaaggcagacaggctcctgggtggaaagggatgggtctggtgaaaccccaccttctagccaaggattgcctgaaggctggtgcccagcctgccagttccctggactggagtgagaacttatggtgctttctccaggctgcctatggctgcccatggctgcccatggaccaatcagcaatatcactttctcccttctgaagcccataaaaaccccagtctcaaccagactcaggcagacatcaggacaacctgcttgaggataggagctacccactctgggtctcctcgccactgagggctgcagacatcgggacagcctgcctgcatataggagctgcctatttcaggtctcctgagagatgtactgttgctcaatgaagcacctctttgccttgctcacccttcagatggctatatacctaattcttcctagatgtgggacaagaacttgggacctgctgaatggcaggactgaaagagcagtaataccagcagggctgaaacatgcctccccgcttgccacattgtgggcaatgagaaggagagaagagaagcgaagtggcccttcagggatcccagacctaggagctccctgagccagggctatgacaccgtctttgggactctggtttctgttgtctccaatctactgggtgccaccacgttctcctcatccagacatgggtgccttcagtggaatctgcttgcagtgcaccagatccagccactggcttgtatggagctggcatctgtgctggcacctggggccacccttcccaccacagcagccagcgtgcctggctgtgcacagtggtggaccccacactcactctcatccccaccttgctgctctgcacctggctcacccttggcaggcatgggatctgggccggtagaagaagccaagtgaagcctgccaggctgagtgggtgaaacaagcccagtaggcctgaaaaaaattcatgtaaaggtgccaccagccacagaggcttcctactggaaaagcaacatcccaaggatcctgtgacattttctacaactgtaaacaaacgtttgtatattttagaagcatacacacgaccaaaaatctcaaattgtaacaaatcttccacatgcattgtttctcttttatttggttccttcagtttctatttttgacaaagatataacaatgatattagtgtcttagaatttgcatgccccatgtgatcattcttccttcttgctctactatctttccttgaacaaagagctaaacaaagagttcttaaaaagctaatggcatttcttcattctttattgttgaaacatcctccacctctctttctcaaaattatctccaactagcttcattttttggtgggggtgggagggaaatgaattaagtccgggtaatatccctattacacagaaatattccaattataaactttgattttttaaccattcaagtgattaggtagtttcttcatatctatttacaattgcatatctttgtttaaatcattttctacaatttgtttttcattagaaattgagaaaaatgtgttaatcttattcataaaaattcttttctcaaattcacattatgcaatgaatgaaatagactatagagatcatttagttggcctaataatcatttcaatacttgactccttaagcagcccttaggaactatgtccttcatacaaacataaacagatttcagtccacagtaactgggaccttgaccaattgtgcttcctgtagttgaagatctgagaggcatactctcattgtcactgcatgttcatatttactaagagattttcggtcaattatctctttatatattttagaaattagttacaatgtcagagtcattaaattccttttatatatctttcatttaaaccctacagaaatagcaaaatcctaatagtagttcaaacacatactacttgagattacattgactcccataggtgaagtaagttagccttctgaagaatgagaatgacatttgaccttcatttcaggatgatggactaagacttatacacactgaaattcacttgtcatcagttttaaaagtaaatatcatgaaaaggtcaacacgtctggaatagatcatagagtctaaatgtgaatattgattttgagtgggaaatgcattatattacacaatttatcaaaaaatttgccaaatacaattaattgcaaaattttcaaagatatatgccacctatataggtaggcctttgttttttatttaaaaatggaaatgtatcaacttgaatattaaccattgcatgatttagtgtcacattcatgttaatttttaagatttgtatatttgcaagtgtaatttccataacaacctaaattcaaaatttatactggtatatatataataaaataagggcaaatatccctaagttatatttgttaacctcttaagttgatatattgctaaactcagagaatatactataagtccttttcaatttctattattattaaaatttaatatatcaaattcaaaatcagaatattatacatgtgaacattctgaaattttgaaaaactttaactcttcttcaaaagataatcttaccactttctctgttaaaataaaaaattgctagttggttgattcatacgaattagttttgtaataaatgacaggttgaaagttttacacaatttatacttaaaataagtttctcaagaagctttatattaaagaataaaattagagtatatttaacaaaggattagcattatacctcttgatatacaaaacagaaaaagtataatttataatcaaggcattcatttttgtaaactatgaaaatgcaagtaatattatcacagtggccaaagaaatagcaagtgagcaggtctagttaacatttcattattaaagagaattaaaattaccttatgttgaggaacatagccatcattttttttttctttttagagacaagatctcattctgtcttccaggctgtggtgcaatggctcggtcatagctcactgcaagcaatcttccatctcagccctcagcctcctaagtagctgcgactttaggtgcatgccaccatgcccagctaattttttttttaattattttgtagtgacagtgtcttgctatattgcccaggctatcattcttataaaaccttccaagtttggacttacagattttgagaaaagattttaataagatgaacaatagtttggaaagaatgatttgtcttgattgcaaataagttaatgaaagctgtctgaagactattaaaataatgtaaaacaaatgcatatgcagagagcataactcgattgctaaaattgttttctattttaatttagatttgttgtccaatgtaagagctggctttacctgaagatagcctttcctgtctttttatggcactattaaaaccttgcctcaaacataataggtttcgcccatttaactattgacaaaatgattctgacaatctttcattacagttttgataggttccctgtgcacctacatggaatttaatttctctttcacatttccaaggttatacacattttggcatttgctcatgtagcagagtgaagcaagtcttccttcaacaaaggactcaagtccaaacagttcaacttacatccactgtttagaatttagcacaaacttttcaatacaaagagtgattttatacgtcccattatttcattgtattgtatctatgggaaattttgatccaagtaaaacatacagtaggatacattaattttattttattagtaatcaatgcaaacatatttgagacaaaatagcatactaaatggagtcctatggtgatgagtctggagaagtagggagagttggactgtgaagggacttactgagtcatactaaaaactttgttcattatcacagagaaatttgaagacattgaatggtgttaaacaggcaaatgacatatgcatatcctcttaatggaagtcactttgtgcttccacaatctccatggaaagtagaattttatactatttaaatcttgattcaaaatcatcacatttttatcaccaatttataatggataagtcattcatttcccaactcctccggtgcttaatagctgtgccatttacttaatcttctaagaatgctttttacctctggtaaacttttcacacatgattttatgccattaagtaatgtacttaaaccaaaatcacatgcacaaaaatagagtgaacagaaaatgtatatctggcaattacaaacaagggaaagcagaaattactatattaatgtcaaataatgtataattcaaaacagaattctgattacctgtacactcggtctcactaaaaaaaaattgtaaattttcaagcgagaggaataaatttgctactttaatatatccatatagtttccagcataggtaagaccatataatttattgtccaaagcagggcacttttgagagtgagaagggccctctataataattaaggtagggcagtagacaaacagggatgggtttatcaggacctaaccccgttgtaagtccaggagcatactgaatgtatattactttcatacccatagtaaagtaaaaaaccgaaagtcaaaccatcataaatcagggatcttctgtactttagtaagtttaaaaaatttctccagcgcattcttatggatttaagctttaagagccaatgactatgagagattagaacacactattttaatgagaacaatataataatttaagcaaaggaaaaaccaaacaccttagattgcagtttttgctttcaaatatttggataaattgtttatacttcagtttttgtatcctccagatgaagattctttaaggaactgaatagaagcaaaactcttagtgacagaaagcacgcattctttggaacatacgtaaaaagcagtgtctagtcttttggcccttcattaattttcttatctaaaatccatcctaagtattctggaagaactagcatctctctcctgattcatgtcttttttaaactgtttttcttatttaaatatgtaaaattagatcactctgatgcaattactccaagattataaataatcggagttctagtgggtgttttttttttattcttcccttcccatttttattaaatcctctcatagtaggtagaaaaacagtatcttaattggtactgatttgcaaatatattgaactcaaacatgtcaaaataaattagatttgtctcttagtacaaagaaagcaatagagccagattgaatcctagtgaaattttatagcatctatttacaaacacttttatatcctaaattgcctggcttttaaaataattagaagctttatttgacacatacaacatttacttttattgttacttcttgaactcaacaataaaagtagattttaaattgtaattgtttcatctatatttatacggtaaaaactgggtctaacatttagacattgcaaattatgttattctactatagtcattattcagaaaattagttaatatatactcagttgaaagatttattgtaatctatattttcaaaaaacacttagaaatattaaaaggatatatatgggccaggtgcggtggttcacacctgtaatcctgcactttgagaggccgagatgggtggatcatgaggtcaggagttcaagaccagcctggccaaggtggtgaaacctcatctctactaaaaatacaaaaaattagccaggtgtggtggtgggcgcctgtaatcccagctactcaggaggctgaggcagagaattgcttgaacgtgggagccacaggttgcagtgagccgagatcgcgccactgcactccagtctgggcgatagagcgagactccgtctaaacaaaacaaaaaggatatgtatgaattagtttatatcttcatgaggttatattgtaagtattgtgcatgcgaattccaaagcagttaactttttcggtttgcatttaatctgcaaatatttactttaaaccattttggagttattttgatcagttttcttcttacaaaagtgcagttatttgtgatacatccaatacattgtaatattattcagcaataaagtgaaatgagatatcacaatacaaaaagacatagaggaaacttaagcacatattgataaggaaagaggccagtccaaaaaaactacatactgtatgatttcatccatgtgacattctagaaaagttaaacatatagaggcagtaaaaagatcattggttaccaggggttcaggtgaaaagtgagatgagtagacgaaaaacagaaacattttaggtcagtgtgaaggaagttcactaataactgatcctaagggaaaactctcaccgtgtggaagatagcacacagtgtcactatgtgaaccagccggaataggaactcaaatgcttccctccactgcattctgggctgcagtattaccagtgcctgaacctggtgagagacatattcacacacaagttatatgaagtggatttattaatagttactctaatagatgtgaggtgatatctcattgtagatttaacttttatttttctgatcattactcatattgaacatttttttcacatatttactggtcatttgtatgtcttcttttggaactatctattctgctccttggtccatttttaaatcaggctattggtggaagagatatctgcactcccatgattattgcagcattatttataataggatatggagtcaaacaaaatatctatcagtgaatgaatggataaagaaaatgtgatatatatatatatatatatatatatatatatatatatatatatacaatgaaatattactcagccttaaaaatgaagggaattcttttatttgggacaatgtgaatgaacctagactttagtattctattttgtctcaaatacgttcatttgtctcaaatctggaggacattatgttaactaaaatgcatcaggcacagagaaaaaaactgcatgttctaatagtgatctaataaagctaatatatatggaatctaaaacagctgaactcatgaaagtagagcgtaaaaaaatggttacatggggctgggtaggaagggaaggattggggagatatttgtcaaaagatacaaaatttctgttagaagaataaattgaagagatttcttttacaacatggtgaccatagttgacaacaatgtacaatattgtacattgctaagggaatagattttacatgttctcaccactaataaacttgtgaggtagtcaaatggtagtttaatttagccattctacagtgtatacgtatttcaaaacatcatgttgtacaccataagtatataaaatttctatttgccaattaaaaaataaataagaatacaaaaaattctgagaccattgaacttttctgggaggaagtataaatatactgaaatgcataggcattgtgccagtatttttatcttaatttatttctcaataacatttttattaaaaacaaaaatattattaattttgaaaatacacagctgttttacatgtaaaatttagaaggtaaggataatgcaaatagtaacaatgaggaaatatatttataaaacaaatattatttcggattctatttcagttttagttgaggtgattttggaattttagtcaaagcctgtagattttgtttaaaacggccaagaaagttagaagcattgccgttgtggagtaaataggaaccaacactgccatcatggatatgcaaggacatcaaacccaattcaggtcaagccttgtgaaagggcctttgaggaagcccttactgaaggccattatgaaaacatgaaaccactagcctctcccatgttccagttcatatctgctaaataaccatttcctttagcatcctcttagccatctttggaaaatggccatctagttggtatctatctcaagctacatcagtaagctgtatagttccattactgaagctgtttcaagtgtttcttttaagagtgcagtttgtcagttgtattggcagtaaatttagctttgaaagatagtattcttccatttcagacactcacaattatttgttataaatcaggtgcgaaaagcttaaattggaagagagctagtgatgcatttttttcataaatggatgaattgaagatttatgaatttaatagagaaaatatttttttagaaaaccttctgagaaatgtttcatttggccataattcattgcttctgaaattgagcaatagattttgattatactcaacagaaagaagagtgaatgataactcacattatatcaggttcagaatggtagaactagaaaagacattagagatagttaatctgctttaaaaatcgtaaactgacagcccatagatcaaatgtagtcattgatgctttaaaaaaataaattcccattgatcgttcataaacatatacaaaattttcaatttcctttattgatttacaaatcacaccagacttgaattattgtacagtagttacatactctctcattcctaacttccattcctctccctattaatttatattcagcccattttattcaatttggttatgttcctaccttctctgtccatctggcttaatgaatcctgatttataccaactccatcatttgtattcaagacatatgtgactccaaagagagtatgcaatttgcctccatcatgtaactggtactttccacaacctaaaacaataataaaataatattatttttattaatattgtacattgtaatcctgccaaaaaatagaaaataattgatatttttaatctaatgctcattatcatggaggttcatttaattctttttgggagaagattgtatttgtatagtgttttagttctgatagaaacaagtgtactggaacaattaagacaaaggttaatgaggagaaattttgtctagaagtaaatctgttgtaaacatttactaacaaatagaattttaaatgcttttagtggtatgcataggatttaaatgtcttcttaaattatgccaattactttttttagtattatttctatcctaattgtgcagttaaggttagcaaaaatgtacacgtgcattttttaatatttgaaagaagacatagcatttttcttttctgttttgttttttttgtttgtttgtttgtttttgtttttttgagatttaaactcgctctgttgcccagactgtagtgcagtggcgtgatcttggctcattgcaacctccgcctcccaggttcaagcaattctcatgtctcatcctcccgagtagctgggactataggagcacaccaccacaaccggctaatttttatatttttagtagagatattggtgaggctggtcttgaactcctgacctcaggggattcacccggctcagcctccaaaagtgctgggattacaggagtgagccaccgcgcccggcccgacatagcatttttctcatgttaaagctaaaggtgcataagttgcagacgtcttgtttccatactgtataaggaatagcaaacagatgaattatggaaagtataaaatttagcttctatcttgtgcagtaacaagatagacaagtaaacaatttaagtaatgtctacttccacaaataggaattcagtttttgaaaattatcccctaatatgactgacatattttcttgtattaaacttttgataagtagtatgtatcttgatctgtcataaattaacaatccattgttcaaatattagttttgtgttgtggcataataatattaccatgaacttaatgggttaaaacaacacatatatcattttgaatttcctataggtcaggaatccaggcatgggttagctgtgtcctctcctttttggacttacataatcttttaatcaaggtgtcatccagggctacggtctcatctgaggctcaactgcagaaagatccacttccaagtacatgtggttgttggcagaaatcagtttcttgtgggatgttggactaagggcctcgattccttgctggctgttagtcagccatcaccttgagtttcttgccacgaggactgctccatatggcagcttacttcatcaaatccagtgagggatatacccaaaaagttggctagcgagaatctagtcaagtcataatcttatgtagtatgtccattgaatttacatgagacgtatacatcacatgaacactgagcaaaggataaaatgcccccattgaccagagttggttaatgtgcttatgcatgtaccatggggattggcaaagccttacccaaagcacttgtacagagaaggaaagaggcaagattattgaaaacaatatttggatgttatcaaaagaaagcaaaaagaaaatgcaggacagtaaaataagtaagtaaataaactagtaaattaaatatctactttacacacttcattttaaaatgatacagattggttcttattcttcagcaagaagcagttattgctcatgcaatgaatatatggaccaccattaggtgctagagtatctgtgagaaagactgctttacatttagataacctagtcaattaagtgtatggacagcagtaccaaaaacaaagcaatttggaccagatatttataaagcctatacttcagactaaatttgtatttcaggattttttgtaaaaggtttcaatgaaagcacaatgtaattgcataatgtagcttggaagaactaccgtgtacattcttctattaagttcaaaactctgtcataaatatggataaaaaaataaaaataaataccaccacacacctattagaatgtctgaaatccagactattgacagcaccaaaagctggttagaatatggggcaacagcaactctcatttattgttggtgagaatacaaaatggtacagtcagtttggaagacagtttggcagttgcttaaaagactaaacagtcttactataaaatccagtaatcatgctaattagtatttacccagaagagttgaaatcttagagtcacaaaaacctacacacagatgtttatagtggctttagtcataattgccaaaacttggaagcaaccaagatgttttttatttatggaaataaactgtgggtacattcagaccgcgaaatattatgtagtgctaaaaatgaaataagcaatcaagccatagatgttgaggagcattaaatgcatattactaagtgaaagaaggcaatctgaaaaggttacatactgtgtgattccagctatacaacattctggaaaaggcaaaaccatagagacactacaaagatcagtggttgccagaggttgagttgaggggagggatgaatatacagggcacagaggattttcagaacagtgagaataccctatatgatactacatgaaagcggatacatgccattacacatttgtccaaactcataaaatgtacaacaacaatatgcaccctcatgtaaatgatggactttcagtgataatgggtcaatgtaggttcatcatttatcacaaaggtagcagttgggtgggggatttgatcatggaggaggccatgaatgtgtgagggcagagggtatatcagaaatctcttatctttctctcaatttttctgtgaacgtaaagttacatcaaaaattatatttaaaaataaatacatcatcttctctaaacctgcagacctcctccagtaagtgaacttgccaccaaagggaccatggttggtgtaatttctgctgctgccattaatcaaagtattgtgtactccattgtttcaggaaatgaagaaggtgagtagacttttagtttgtgttctcaccatcaaccagtaaacttagatttggcctaatttcagattgaattgaaattattatctattctattgttttctaataaaattgtgcccatcttaaatgtaattgttaaccatgtatcctgaactcgattaaaaatccagtgatgttagctaaagtgattttttcccttaagaaatattaagtaccttaagaaatattaagtatctaattaatgaaaccttgcccttttcctcatttggtaatattttaatgacatttcctcaaaattaatgcatcatgaaattttcagcttttggccatgatcattgcctacagtagcttcgtccgccccagtgtctgaaccatccatgacccttactccatgttggtcataccttaactaatcctgaaggaacttcaaggttgtaaataagttgtgaattttaaaaagagtcacatccatgttaaaagctatgcatgttatatgattcccaaaatagtcaaattagacatacaattcatgattaaaaataaaaatataagtttttgtaatttaagaatcataggaatttgcaggcctctgggaataaggtcatagctcaatctttcgcattaatttttgttttacctgttctccacaagttctcctctgttttcccttttggtatgttagatagcctagtatattgtaggtagtcaggaaatagttaatatacatgtaataagttaatcaatagtaaatattaaagaaatgagtgaatgtaaaagagtttgcaaggaaattataaaggccctgttaagctttttaatgacaaactattactaggtattgctgcccgtgtagtgtagcaagtggtcaatatcttacttttattgcctttctttctacattattactgtgctactatgtgtcctccctaaaaataactaaatttcctttttccttggacttcgaacatctgactaaagctatgatttctcaacctgttccgtcccgaaactttctcttttgattctatttgtccttttctttgaagacagcagagtggctatatttattaacgtctgtcccccacagtgactgttgtacatttatttatttattcaacaaatatgtactgagcatctattatgtattaactactcttctagccactacagatagaacaatgtacaaaatagattcctgccctcatggaagttaatggtccagtaagcggagattaataataaaaattattaaacaaagaaatatatagtattataagggattattaattacatgaaaaaataaagtaaggagagaatatggagagcataagagggggagatattataaagtttaccaaagtgccctgattttcattcaaatttatttaaataaacagacacagggcaacattaaattatccatttttttattttctctcaagtgttcttagcaaaacactaaatctacaaaataataatattcataaattacaaagagtataataatccagtaagttcagaaaattttggttaaacaaaattagatggttttctttgaaacaacttctgaaagcctttagtgtgacagaagaccatctgaatctaaggtaaagaatatattattcagtgtttcccaaatgtaattgaccatagaactttgttttccaggattatctcaaaacaacaaaaacaaaaaaaccctacaatttcaaggcagactttagcgaagtattgatgttgatcattcaaagagctggaacagtttccaaaagccagcattttgtcactttcatgcatcactctagttataaataggcatttttagtgtttttgaaatcacagtgccttttaaagagaatttctttccttatagcgtaaagacaatgaccaggtaattgtattttaatttctagatacatttggaattaataacatcacaggtgttatctatgtgaatggacctctggattatgagaccaggacaagctatgtacttcgagtccaagctgattccctggaagtggtccttgccaatctccgagttccttcaaaaagtaagttatactacttaaagcttttaccagaattgtatggtgtctctgctaattttttaaatgaaatacctatgtctaaaatatcattctcagtggacaacatagaaagatcattaatactctgagatgattgcctattcgtttaaacagctaatatatgacaaggcagggagtgatttcatactcctgaaatgtcgagataataaaacaccgttttcaaattgtgtatccaatattgttaaaataccaccattgtctgtgtatgttaaataataaaacttagtcccactgtgaagctctggataaaccttgggaaatagatatttttaatgaatgacttctagaaattgcctgaattgtgtggcttcttgtatttacatattttcttcgagaaaagaaaaaatcatcttaaaattagcgactaacatttattgtaatttatatgtagcatcatttttcatttttaatttacactttttaacctacacttttaatctatgaaatgagaattactaccctgttttacaaaggcaagattttgttaataattaaaaaggttatttttttaaatgacagtaaacaaagcgtcacagatttaagcccacgttctgtgactccgaacttcaacatttctgtggcatatagtttacccccacagagaagcatataaaagccaatttgtgaagggaactgacacagatttaaagatgttatcaataatgcaataaatgctattcttttcccatctattgaggtaatactcttttgcatttaagcaatcatctttttgtaatcagagcaacccttttaaaatctagaagactcaagataatccagtttaagttaactattaatagaatagaggcccagacagagtgtgaaatgagaaacaggatctgaaacattcacccagggactatccctggacatcatttcaaggcatttcagcaagcgagcgttcttagaagggagaagagggaaaaagaagagggcagaggcataaagcaagaacccaggcagtgtgagagaaaagaaagcaagacaggagcaacaggcagaagatgcaggacagaattttctgtatcagtttggcagttgatcataaaaagaaatcactccttttcatttatcgtgaacctcatttactgattcagtgtagagagctgctcagttccttgtagagatacaaccaaatcatttgaaaaatcagattatacaggtgtctttgaaattaaaggaattgaattgtcctcaataattatgcatcactcacataattaaattgtttaaaaatagcagatgaattctttgagtttctaaaatctttaaactacaggcaattatgtttttaaaaatatagaggatgcttccaattgtaaactgaattggataaatgaggagtggaaaggttggagtaactctaaattatataatgtaacctattttattgcaaatgcaaaaatgaggaagattaattgaaaagtgtacctgcactctttccttgaaacaaatgaacagtttaagaaagaaaaattttaggttgtagaactttctcaagtgatacctgtgatttttatgaatagaggtgcattaagttcttatatgtgaatacaactagctcccattactttaatttacatgtaaatctgaggctaataaaagtttctctaatgcacatgtgtatacttccatgtgccccagtatgcatgtagaggtgaaaccaattcctgaattatcctgtcagaaatgcatgaagtctaaaagctaaaatatttactgcctgattctttgaatattgttattaaccttttatgattgacctttgcctcctaagtttgaaataaaaacccatatatttctaattcaatctcattaattaataactgttaatggcctatagtcaatccccagcccattagttatgcaaatacaaccattatgtaaattgaggttaattagttagctaaatattcatctctgcagcagaattagttgccctaccacatatcatttgaataaggataataaaaatcagaagtgtaattcattaaagaagtattttattgtgacttctttaccaaaaatttgttaatgaaattattttcaaagtaaattgtgcaaccatgatgtgattagatttaatatttaaatgcaaattaattaaaatgtaaaattttagagctaatttcataagtttaacactaggaatatttaaatattttaacattttacttggaacatttcaaacatacaaaaattacagagaatattacggtgaacctccatgtatcaactccctaattcaacataatcacgccctgggaaatagttgttcctctatgctctcaactacccactattgcattattttgaagcaggtcagagtcataacattcaatctgtaaatattttgatatgtatatcttaaggactcttaaaacaattaaaatatcatgattactgctgccaaaagtaacaaattatttgatatcaatatatatccagttggtattaaacatagttcatattaaacatatccagttcacattgaacatttatttacatcagaatcaaaataaggtctatacattgccattggttgataggtctgttaagtctcttttaatctgtaggcttcaccactacgctcttttattcaccttgatatttatttgtgcaagaaaccacatttctgaagcctggattgatgactgtctctccaagtggtcatttcatattctttctgcttccttaatttccaggaaataagtagttagatctggaggcttgatcatatccaggttatttttggtttgtttttaaacaaataaatcataggtgatattcactccttccttaaacattaaatctctttgattctctttttgtgatatagatagtagcaaccaccaatagtaattttctaaatccattatttttttatttttattacttctatattcattagccaaaatatttttataaagaaaaacgtctccatagcaaatactcagtaaccctgaggtccaccaactataggaaaaacaagaaaaaaaaactttattctttccttttattattgattttcaaaataatgagttgattcactatcatactcaaaatgggaatactgagatgacaaatatgtttagttttctgggtcatatggtctctgtcggaactactctactctgctgtagcttaaaagcaagaagagataatacgtaaaccaaagggtttggctatgctcccataaaattcattttactaaaacaggctgtctgtgggctggatttgaccaaagggctgtagtttgcccacatttgttctacgacttacttttacattacatggtacactttttttttgcactgctcatatgtttcctgttgtgagcaatgcttctgcttcatctcttatattttcccacacatctaattgaaagtgatattgttttatccctcttaataacacaattcagtcattttgttatcagtaacccattcccaagtaaagtccttgatgcaggattatagagacactatttcctatgttttggtgcattaagaaaagcttatcttagggctttaacattgaagaccaatttgactggataacttgactcattttctttttttaaattaaatttttcattccattttcttattctttgaagcattactgtaaaaaaatgtgtaatgacaaactggtcttatttctgaatttccaaataattgcctttattttttctttagagttcagtatttttgtcaatgtatttctacatgttggcaattctgggtcattttctatatatgtagtataactgttcaagtctcatttagggattttttttttaattctagacttttttttttttattaatgtggcatctattctggtgttactggccacaagttcttatgctcttgtgcaatagaaactgacagaaggctaagaaaatttcccagactccaggcgttattggaacttatgctggagcacaaggaaagcagcccggaaaagagaaagtgctcttgctgcctccctggagatagccaagagagtaattttaacaggcctagccatgaaaggagtgacattaaagcatgtagaaatgggaatttatagcatttgcacagtttgatgacttgcttcttcatgtgtcacacgtctcattaacatgttacatctccgtgtgatttttttttttttttgagacagagtctcactctgttgcccaagctggagtgcagtggcgtgatctgggctcactgcaagcaccgcctcctgggttcacaccattctcctgcctcagcctcctgagtagctgggactacaggcgcctgccaccacagtcatttttttagccttctgtgcatgtgggtattgggggccaacttccttgagtaagatgtatggtagaatgtccctcatcttagtttctctaggtaacttatagcttgcacagtcttgtggtcagtggggatggcatgagtgaggtgatgctgccatcaccttacagtggtgcaaggtctggtgactagtgtgactgcatgaaataatgctctagtagaggtgatctgaacccaaagttctatccctcctctgtctcactgggagattcctagtatacaagtgttgaatcttctcttatcttttcatcattttctcgctcatctctttgtattagagcacattactgtaaagaatttttgcaacctactcatctgacaaagggctaatatccagaatctacaatgaactcaaacaaatttacaagaaaaaacaaacaaccccatcaaaaagtgggcgaaggacatgaacagacacttctcaaaagaagatatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaagctagttcaaccactgtggaagtcagtgtggcgattcctcagggatctagaactagaaataccatttgacccagccatcccattactgggtatatacccaaaggattataaatcatgctgctataaagacacatgcacacatatgtttattgtggcattattcacaatagcaaagacttggaaccaacctaaatgtccaacaacgatagtctggattaagaaaatgtggcacatatacaccatggaatactatacagccataaaaaaggatgagttcatgtcctttatagggacatggatgaaactggaaaccatcattctcagcaaactatcacaaggacaaaaaaccaaacaccacatgttctcactcataggtgggaattgaacaatgagaacacatggacacagaaggggaacatcacacacgggggactgttgtggggtgggggaaggggggagggatagcattaggagatatacctaatgctaattgaagagttaatgggtgcagcacaccaacatggcacatgtatacatgtgtaacaaacctacacgttgtgcacatataccctaaaacttaaagtataataataataaaatttaaaaaaaaaagaaatacctgagactgggtaatttctaaagaaaagaggtttaattggctcatggttctgtaatctcttcaggaagcatggtgctggcatctgctctggttctatggagacctccggaagcttataatcgtggtggaagtcaaagggagagcaggcacatcccatggcaaaagcagtagcaagggagagagagagtggtgggggaaggtgccacacaattttcaacaaccagatcttgtgagaactcactatggcaaagacaacaccaagccatgagggatctgtctccatgagactgatctcccatgtcctcagctgcagcacccgattggattaaaaccttcttccctagcaatactcattgtctcagtgattgcccatctgtgtggcaagcagcagaacctagaccaaaaccatcatgttccagtaacagagtttaacactctgaacaccattactctcgaggagaattgaaaatggtcacgcgaattaaaatttagaagtgactttgtatgagtattcctttataggggagggttgttgtaaagttgtacttgaattcacttcaacagtatacttttccccaaaatacaatggctggggaaatatatgctttcccttctcaagtttaacattggcaactacagtaaaaaacgctgcccttatgttggcctagcacagcaaatccatgtttgagacatatcagataaatgtagacagaaaaagagcaacaagcaattacaatgactggagtattacattatattacagctacatctagaaaggtctgtgcttctataagtatgcaggcaaagagcctgtgactgttctttgcctgcataattatacccaaaccaacccaaaggaccagatttgggacacaggtgaatgccagttttcttaaatcctgttcggtaggattacctgaaggagtgatgatactgcaaaaggcaaaaactggacatagaccgcagaattcctataaaatgacaaactggaattaactgaagtatgctggcaaactgaagttgctgaagaaaagcataccagtgctgaagatgctctcattgaccatgtctgttttaaacccaggtctgacccaaagagtattcagccatttcacaacagtaatattgaagtaggaacttcgctacctaccttacatgccttttctccataatctccaaggtcaggtaatagaagtctgagtgataaaaatcaactgctagtgaatgaaggaggtggtggtagttaataaagaaaaaagtaaaaagaaatctcttacagcctcttccccaaaggcagaggaacttccattaacatatctaagctggggaaggacattttacctttaaatgaaatttggagtattagattcatatattgaactagagaatcatttttaaattctttttaaagttacctttaccatagtactattaacaatttttttaaaaattataaaatttcttgagcttttattcaacagcaggaaagatattagcccatattagcaggattaaagagatagtatgaaagaaaataatagagttttataattctatattttcatattaagaatattgtttcagtgagactgtagaacagaatttagtggatattgttaaaatggatttagtctgcgcaacgacagaagtttgtatctgttttgtttattgatgtatcccaatagcctaaaatgcatggcacataaatacccccaataaagatttgtccaatgcatgagtgagtctggaaaattaaggccagattgtgaagcgttttaaatatcaagctaacagtatgcaaatttgtagcatacataccactcatacaatccacctgatggctgactgctaactaagctccagttctgcccactcccacctcaccacccctgatttgcagccttttcataacagtggtttagtcattattacagatggagacagtacactgttttaatcatgggaatgtgcttaggagcttcctcccagtacttgaaattgcagggaatctgaaaagctttggagttttctctctcttcaattcagttagaaattaggtgttgatttttcattcttcctgcactcaaactttctggccctctagactccctacattttatctcttcttcctgtctcattctgttaagcatccgtattttcttcctttactcccatattgaccactaatttgatcaaataattatcttccttttacaaagtgttaatgaaacaccaggagtttggtctaggtcctgctgcttgctgtacagaaagccaattactgagaaaacaagtattgccaaggaagaaggctttaatcgggtgttgaagctgaggagatgggagttcagtttcaaatccatctccctgattgactaaagctagggggtttatgtagtagggaagaaacgtaagagtgtaagaaaacaagaactggggaggagcaaggaggcctctggggcagtgatctggtaagtttcaaataactgaaacttttttcagaggcctgaaggtcctcctttgctgaggaaagagctcagataaaacaaataaaagttttaagctttagcagcagaagagccaatctctgtgtttatctgaaaacaactgtctgtgggactgttggactagtttcaaaaggaaagacaaatgtgaatgcgttgctatttctttttttttttttttttttttttttttttgagagggagtctcactctgtcacccaggctggagtacagtggcacggtctcagctcgttgcaagctccgcctcccaggttcatgccattctcctgcctcagcctcccgagtagctggaactacaggtgcctgacaccacgcctggctaattttttttatttgtagtagagacgaggtttcaccatgttagccaggatgatctcgatctcctgacctcgtgatctgcccgcctcggcctcccaaagtgctgggattacaggcgtgaaccaccgcgcccagccgaatgcgttgctatttctaatacattatttcaaaattatgagtcatcttttcttcctatccatagtctctttctttgcagaaaaactcaaactctcctgggtttttaggatataatgttacttggtcccaaagaagcttcaagaagcctgtacccagaacatctatagaagcttatgttaatatttgtgccacagagtcattcccattcttttatgtagagcaaaagcagtaacatgcaagtttacagcacagattgatttatgtaactccataattgaagtggcaatttttgctttatggtaaaattataattatctttaaacatgaaaaaagaaagccatagctttctataaatatgtcattgtgttttgattcaataactagactttcaatcaggaataaattacaagacaattaagataaactttaaactgagggtaaaacaactcaaatgctattgatttcattttatgttttagctgtagggtacaagcttgtaatacatttcattcttctgacttttgtggtttctaacagaaggtctgtgacaaataatgctaatgactctttacctatgattgactgacttaaaacaaaagtatccctgctataacttgggtaacaatattgtagcctgtcacatattattttttagtcctaaaatcccaggaatgatcatagccttatatttatagtacaaatatatggccactgttttagaaactatattaataatgtattactttaaaatatggagaggagtttatgaaaattaacacgataatatcattaacagcattttttctttcagaaattttaggcatcttatataaatatatggttgaaaaaattatattttcaatgaaacaaaaatgtattccagtggactcatagcataaaattgtctgtccaagaaaaaattgcattgtgcacaataggtttccttggaaatgtgatttgaaacatggtatacactattattaatacatttctgaaaccaaatgcattgaggcagtgctcttccattgatcccaaattggtttgctgaactgatgacaatgatatataatcagacttttcaaaatagaaaaatattacatttctgcatatatgagaaaaaatatatatttcatgacggaaacatattgctgccatgggcaagcaaaattaaaatatttaagaatctaggaatgcataaaatagttctccttcttatacctaagaataagcctggaactaaagagagaagatacagttttcttcattcttggaaacgtacttataattaatatagtaaataatttagattttttttctaagcctttttagtccaaatttaaattgggattcaaaatgccattcattgaatgccaaatattttggcaaacttatgctttccagagagtattaattactgattaataatgaggccccaaagtgatacaacagtcactctaaacctcttgctttagaaaaactcctatttcagtagaggcacactaagccctattaaatgcaaatgaaactatgcacagaagaactggaatctattaagtcacttatgttacagaaataacaacctttgcagaaatagaaaacagatgcaactacatgaataacataagcataaaatgtagtttaacattgatagatatgagggaaattatcagaattaattcttcattattgattatggttgtaggcattggctatccccattctgttgtaatataatcaaggtcaggtctgcacttaaagtaataacttgctaaagatttagcatagttattagattggtttttatttatttttatcacttatggataatgcaattttttctgttagtaaaatatttattttcccaactttaacaagtagctgatcttactggttgactatcgaaagaagaaaaaaaaagcttctcattaaatagacgaaaataaattcagcattatgcttacataataaaaagaaatatggggaaaagtgccatatagaaaagatgtacataggagtgaacattcagaaggtttcattgtctcaacttcaccagtctctgaagttctactgggcatatcctatgtaactgcttttctgaatttctatattcattgcattcttttcacttaacctcaaggaatgtctatacctaaatgtctttgcttgcacaagtctctctttttaaaatgtcctttctacattgtttttcagatcaactcaattattctacaagggtcagtttaaaggtcatctcatttttgagactttgcttaatcattcattgtccctgtcatacaagaacaaatacatctggcctgtgagttctcctcaaataaaaagatgtagtattattcaattttattttgtcccagattttatcacaggtgctgtgtggatgatagcagagaagataaaaatgtgagatagatcccaaagaagagaatagtatagataacactatgaagatgaaagatgtatttcagaaaatagtaaatactccttttcctgcacaatacagaatttgtctagtaaattatgtttgatgccatgttctaatgctttcaaagaaacgctgttataatatctattgttgtactactccacctttttgatatttatcgtttatataaaagatcacattataattaaccatatattttcatgattgattttgtccaaaatggatctgattttgacctggactaattaataacagtataattttataattcttcacagtgaattgtgaattgtatcagatttgcaagaacatttgatgagttaaacatataaagtggtaataaaataatagatacatgggcaaacaatggaatttagtgtattccaaggtaaaaggtaaaagtggtaaagaatgactgggacaatgctcctttgattttgaaattagatattacttattatctttgacaacattacatggattggtaaaggttttgtgggtccccttgtaattcttcttactctttgactaatgttaacattcacacacacacacacacacacacttgcatttacatataaacaaaacttccaaacagactagtactttttaagttattatttcactttcaacaactctgttccctttatttttgaggcacatctaatatgattctgtttttttgtcacatggcccctgaaacattatttttgtgctacagagataatgaaaagtatgttaaattaacaaatatatatcacatatttgttctaagtgctgtaaggggatacgtatccacaaggtgagattagcgctttaaagaagtttctatcctggtggagaagctataacataggtataaacaataagtagtagcatgaagtacatgactaattgatatacaagagacatagacatgcatgatttgaaattagagtagctttgtcagtgaaaaacctcgaactctgcaaaacatttgaagcaatttattctgagccaaatatgagtgaccatggcccttgacacagccctcagatcctagaacatgtgcccaaggtggttgaggtgcagcttggttgtataaatttaaaattcttctaattggcaattggttgaaagtggcttcagaagacagtgaattgccctagtggtaaacaaaagttagtgaagagaaaaaggaagtagataagtaaaagaatcataaaatagtgtttctcataaagcaactgtttgaactacctggtgataattacctgagatactcgtttaataatacatatttttgtgatctcttttccaaacctacttaattaagatatctggaaatggaaaatggaaatctgaatatttactgtttttattgttgttgttgtttcttcacaactatttgaaatactgataggaagattaactgcttgcagttttttgttttgttttgtttcttaaagcagggaattaacatgagaaagttagctcagtatgtagaatagcttggagagagatagaatgaatgctaaaaagaattggataaataggccagtcccaaactagaactaggattgggccagtgagaggaggaaaatataggacaactgcaaaagagaagttggtaggacttgatgactggttataaagagaaaggaagaaatcaaggatgattttatacttttgatcttgggtgacatgaataagatctaaataaaaacttgcaggaaacaaggaactggacttccaaaggtgttcaagactgacaggtaggttttgaaaaaaaatcatatagcatgagtacttaagtcaaggaattgttatgccaagcgtcgctagtctcacgtggtacaaatgtaaaataatgaggcttaagtgagaaaaccaggcaaagaaagcatcaaaggaaaaagtatctcttgacctcccataagcacaaagaaaaaaacttaatttgcacacatctgaacacaccatagaaagggctcaagactagaaaccagggactggaaacactattactctacaaatataaaggaaatatggaaataaaggcaaacaaaaatccactggcagtgtaatgataggagattccctgtcgaggcaatgatctctttaagaggagatgagctagtgaagcttgtatcagggagaaatgctgtttagatccattctgctaactcagatccaactgtgtctggaattggtgggttcttggtctcactgacttcaagaatgaagccgcggaccctcgcggtgagtgttagggttctaaaagatggtgcgtctggagttctttccttctgatgttcgggcgtgttcggagtttcttccttctggtgggttcgtggtcccgctggcttcaggagtgaaactgcagaccttcgcggtaagcgttacagctcttaaggtggcatgtctggggttattcgttcctcccatcaggagttgttcattctacccagtgggttcgtggtctcgctggcctcaggagtgaagctgcagaccttcgcggtgagtgttacagttcataaaggcagcgtggaaccaaagagtgagcagcagcaagatttattccaaagagtgaaagaatgaagcttccacagtgtggaagaggaccccagctggttgccacagctagctggggcagtctgcttttattccctcatgtggccccacccacatcctgctgattggtacattttacagagagctgattggtctgttttacagagagctgattggtctgttttgacagggtgctgattggtgcgtttacaatccctgagctagacgcaaaagttctccaaaaccccagagcactgattggtgcatttacaaaccttgagctagacacagggtactgattgatgtgtttacaaaccttgagctagacacagagtgctgatttggtgtatttacagtcccttagctagacataaaggttctccaagtccccaccagattaggtagatacagagtgttgattggtgcatttacaaaccttgagctagatacagagtgctgattagtgtatttacaatcccttagctaaacgtaaaggttctccaagtccccactagactcaggagcccagctggcttcacctagtggatcctgcactggggccgcaggcggagctgcccgccagtccggcgctgtgcacccgcactcctcagcccttgggcggttgatgggaccaggtgccacagagcagggggtggtgctcgttggggaggctcaggctgcacaggagcccacggcggggggacactccagcatggcgggctgcaggtcccaagccttgccccgcagggaggcagctgaggcccagtgagaatttgagtgcagcactggcaggcctgcactgctgggggacccggtgcaccctccgcagctgctggcctgggtgctaagcccctcactgcctggggcccacggtgccagccggccgctctgagtgcggagtccaccaagcccatgcccaccggaactcacgctggctcgcgagcgccacatgcagccccggttcccgcctgcgcctctccctccacacctccccgcaagcagagggagctggctccggccttggccagcccagagaggggctcccacagtgcagccgcgggctgaagggctcctcaagcgcggccagagtgggcgccaaggctgaggaggtgctgagatcaagcgagggctgcgagggctgccagcaggctgtaacctctcacaatgaccaaattaagctgtcaaaagaaaaaaaaattattgtcccttgaggccccatctcatttgtctttctgaggctgtcaagagagaaaaatgaaagactgagtttgagaaaaactcttccatttagtgaatgagaggaaaagaatagccatttaagagaccagtggaaaaaatgagtacaatttatgtagtgatgacctgttagccaaaggagaagagggtttcaagaaaagtcaaaaatggctgaaacatcaaatgttgcagatactccagaaaaattatgactaaagaaagtatgttggataatagttaacttgggccaacaataactatagctagtgccaaataaataataaagggcttgtatgtggaagaaaacatgggaattaagtaggtagaagatttcttggttttatcttcacaatttaaaatttaatttattcttaaatattccctaattttgttaatgtttacattttataaggcatgcatttcaatttaatgtacacattgcttcaatgcaaaagcaaaaacagaattttatgattcagagataagaaacataaatttagcttgtcattctttttaatcattattcagaacacaagtctcgtagtcagttcttcccaatctaattcattttttattcccaggaactttcgtaagttcaattaatcaatcttgttcctgttcttatcccttttggtatcttgtacctaattagtcccctatgtaatatcttaaaaataattacagacaagcagtttagaggaaatcattattttaaaagctgtcactttcaattttgaaagcctgttactagttatttacttacagcatatgcttgccatcaagactgtttaatagagattgctatatttgtgttttgttttgttttgttttgtttttttgagacggagtcttgctctgtcacccaggctagagtgcagtggcacgatcttggctcactgcaaactccacctcccacgttcacaccattctcctgcctcagcctcctgagtagctgggactacaggtgcccgccaccatgcccggcttattttttgtatttttagtagagatggggttccaccgtgttagccaggatggtctcgatctcccgacctcgtgatccacccacccccagcctcccaaagtgctgggattacaggcacgagccaccacacctgacctatatttgtgttttattaaaatacacaagaaagttggatactttaaccagtttagtggttcagttttgcttctaaatgatccctatttgatgatatttcataaatgctcagatatgcctgagtttaaaggacaaacagtaaaggagaaattttatcaaaaatctatactagggaaaattctatgtaacacagattattaaaccattaagttgttcccatttaaaattaccttaatagaaaagcagagaaaaagtagatacataaaaattgtatatatgaaattacttaagatccatgattttggtatcagacaggcctgaattccatacccagttctgatctttacaaacttctctaacctttataatcttcaactttctcttagggtaaatatgtctacacctcataagggtatttgagaattttaaggactatcatatcagaaaagtacttaacttattgtaacataagaaatactctataaaaaggtattttttattactactgctagctgtgatatgttcgaaccacacaaaattataataagcacatactaaatatgcttcatctactcctttagataagtgtacagagagatatctcatattttcctctgaattctctgtattaccagggattgtaggttgtgacatgttagaaaagcagccaggcatcttctgagggctttagatttgaatacacctaccttgattgacaaccggataatgtatatacataaacaaagacaactttcttcaaaaaaaaattaaaatgatgtaaaatccatgattataaaaaagaaaatatactaaaatttaatacttgattaaattttgcaacacaaaatgaaaaatctacatttcataatgtcttttgggaggaaaaaatccagtatcttttccataaatagggaggtatggtgtccattctctgctatgaactaaattggtcattccaaactatttttggcatggttagtaagttggaaacagcagaaaccacttctgactggcttatactaaaggaatcatatcagaagaatacttggtggcttgtacagcaagagagaaattgaatagggtctaaggaaaaacaaaaacatggagaggcttcagcaatcttagaaactcaagtagcaattcctttttgggcagtgccattaagaaagctgaggtcaatgaccttcaagcaactggcagtcagttcaaggatcacacatctgaaggtgagagaatctgattggcctggcttgagctgtgtatccttggccaggggtgaagtgaagagtacaatagttggcatttctattaaggactcatggaatgtggaggtaatagtaaaccaaggagggaaaatggacttctgaggccaaaataaaggaggaagtgatactgtttaggcaaataaaaaaaaagtcatattagggctgaaatgtggttgaatgaagtgcttggtaaggttggtgtagaggggtggcatattacttgaaacttacagtgctaaatttttactttatgtcataatggaattttaatttccatttatactgtgactagtgctcaaaaatgtaagtagctgattacctcaacttttgaaggtttatcaatttgtgttgcttcaaaaactattttctcctctcagaagtttgggagaagattaaagataatgcttggacttaatgacatattgcaagaactgtgaacccctattttacaagtattaattaagcactttccaaaagctcaatttaaaatgttcattacactaagtagttgtagttaaattgcttccacttatattacttctaaaatttgtgcaaaaaatgaattatttaatatgttgtataccatatgactaatgaacacagcaaagatatatagataaataataattagactgtgtttttcaaggccacttctctctttattcattgcttcttggttgaatcttcacgagtaaatccaatatacctagggaaatatttcgcaaacaagcaggaaaattcttattttatttcaggaggaaaaaaaatgtatgctttactagcgtaagccagggcttgttgatggaggaaaagaaaatgaagatttgcacatagtatctccacaggttctttagatgaaagagatattttagaaaaggcatagaaaggaacagataaagttcaagagtttcgtgtacgtatgctttatgacttctgtttccgctctacttctagtcttccatcataacattaacattaactattttaaattagaaaagcagtacttatcattatatacaataaaaataaaatacgaaaagaagaaaattaaaataatctatcatcccgtgattttgatttttttaaattatatatctttttcaattatattgtaatatcctaatatatacttatatagtatctatacatacacttatatgcacttttacataatttatccactatttttattaaaagatgcaaatgttttgaaaatagaatatatgccataacacttttcactttttatagacaattctaatgttttataggtgtatggtgattataaacatatacctgtttatgatgacatttaatcatcacagtaatcttattgtttgtctacagtttatacatgagaaagcaggcccttgtattcaaccgccttgtgcaagatgaaaaagtcctcaactttatagaaatgggatttctcatcttgtatccatactgtttttactttgcctcaagctgttatgaggtgagcgaaagagatattttcaaatgaaggcatatagaaatacttccactgggaggctttaattccaaccagattatctacatattccttaaattattttcctgatgcagtttagaagtaggtttgctttccctgtccccattctagcaatctatattcttggcttcctgggtatttataaaaacttagaaagttttagaaatttcccagtgaaatgttcatttttcttgtggtcctaggcatagaagtatatacctaaatacctaatacctaaatacaaataaattatttttttcactatagaaataaaccgccttgctccccactccccataaatcacaaatccaaggattacttcaggtttttaaaaaatgactcaaatttaaggccataaagtgaaatagttacatctatatgttgttacgggttcagtctgaatcttatttatgccttctcctagttgagtaattttagacatgttatttaatccctccaagcctcattatcttcattgataaaatgtggacaatcaataatatgtacaatgttattacaggagtaaattgaaataatgcacagaaaacacttggtccagaaacttctcagtgattagtattaccattaaagctttctgtcagtgatgttgtttgcacataaaaagagcttgagagctcccatatttgtattaaaacagaattttgtttttcctaaatttgtcatttgggaacatcctaacacatttctgtttttaaatgtagtagatccttcgaattttacattgaaaagaacacaataatatgcctcttgtaggcagaatgatgcccccttctcttgagacatctatgccctaatctctgaaatttgggaagatattaatttacataagataagggacttcccagatgtaattggattaaggatttaatatagggtgattattctggactatctgggtggactcaatgcaattacaagaatccttataagtgaaagaaggcaggacagtcagtgtcagactgatgcaacagaagaatccactggccattgctagattcgactgatgaaaggacactaagcttaaggaatgcaagcaggcagcttctagaagctagaaaagacaaggaaacagatacagccctagaggctctagaaagaaatgcagacctgctacgtcttaattttagcccagtgagacccatttggacctacaaactatacagtaatacactggtgttgttttaaaccactaattttgccgtaatctattacagaagcaataggaagctatggtggtatccgtgtgtgtgtgtgtgtgtgtgtgtgtgtgtgtgtgtgtgtgtgtgtgtgtgtttgtgtatttgcattaaaggacagaggcgcctatttgagcagcattaaataatttagcacattgtttgaaaggcatttttttctcttccttcaacaataccatagacatttataaatcctttaattcatttgtaataactcttcagttgatatccaaatatagaaggggcaactgtacttgtctgtcttttgaaatagacgtatcgttttattcaataattctttattcagtactactatttgattgcctgtattctagaagctgagcaaaagtgtctaatggaatttacctttgctgttattacaaatcttgttttaactagggagagaaacctgggcatgaatttaaccatgcctgggaatgaagtctggctcttctgtataatagttgactagttctttaatctccttgagtctcagtttctttatctacaaagcagaatgaaaatacctatttcatggatttgttgcaaggtttttaaagaaatattggaagtaaaatgtctaatgtagagaaactcttcaagaaagagtaacgcaccttccattcctcccattaaatatggaaaaccatatttggtttgtgtattaggccattcttgcattgctacaaaggaatgcctgaggctgggtaatttataaagaaaatatattttatcttggttcatggttctacaggctgtacaggaagtgtggtgctggcatctgctcttgatgagggcctcaggaagcttccaatcatggtggaaagtgaagggagagccagtgcgttatatggccagagcaggagcaagagggagggggaggtgccacacacttttcaatatctagatctcttgagaactcagagtgagaaatctctcatcaccaaggagatggtgctaagccattcacgaggggtccacccccatgatccaagcacctcccaccaggccccacctccaatactagggattacatttcaacatgagatgcaggggagtcaaacatccaaaccgtatcagtgtgttcatttctttttgatggattcttctcttatcttttagaaacagctcctttatagtctcaagaaaaaaaagaacatagtgttaatatctgttgtgtgtgtgtctgtgtttaggtgcatatatgaaagttcaaaactgcccatgtgacaataactacagcccatgtatcttttcaagtgcttagcaaattgcatttccacaacacaatctttttgcatctttgattgtttttctgttagcttgtttatttattttagtaaatttattcatctttttttatttaaacaaagcattagttttggggcataaatatgcttttatttttaattatatgtcaaagaattcagaggtcatttaatggtctattcagacataataattttgtcttcctcagctatgatcctgcaattcagtgtacaataattcctattcggcttgtattatcagtggaatagtcttaggtcaaatattatatactgtctgattttcttgaactctcagcttttgaaataaattttctataaatttgtggtcttgtgtaaacaaaagtatgcatatttaataggacacagtacttttcatatgttttccaatagttatttcattatgatttcataaaattattttacttgcactaaaaatatgtattttccactacattatttgatgtgtactatattcctatatatctcatataaaaaccattttcttttaaaatttagtgctaggaaattttgtttcaatttcatgctattggtatttttttttccttctggtattagtaataatgttactaatattttctccctcctgccttgagagccaggaatctctgaggcatatatgaaatagtaaagctaccatgtatttaatgccttacatatatttgctcatttaatctggttatttatgtaaaattactatcatgttatgaataagaaactttacctcagagagagtaagtaacctgtataaggtcacacagcatacatgtggtattatcaggttagacccaggctctgcttccaaagtttatgcttaaagttttattgcccagattacaactactacagttttgttgatcattatagtcctgtaatatcataatagctgctttttgtagagagctagtgtttaataaataaaaatgatttaaaatagtgtctttttttctcacagaaactgagctaaaagtcacagtcatttggttgcagaggcttttaaatgtatccgtttgaactcaggaataacaaaatgttggcagtaccaatgaaaacaaacaattttgcatccttaactcctattttggtgattacaatttgcagataaatttagtcataaaatctttccaggaggaaaaaaatgttaaaatggattcaaaaccaaaatttaagtaatacttagaatattactgttttttcctgattatttcctcatgactatacagttggcattctgtatccatgggttctgcattcgtgaatccagacaaccagagatggaaaatattcagaaaagaaatggatggttgtgtctacaatgaacatgcacagaattttttgccattattccttaaacaatatagtatgcaactatttatgtagcatttacattgtattaggtattataagttatctggagatgattgatatgggaagatgtgtatatgttatatgcaaatactatggccattttctatcagggacttcagtatatgtggattctggtatcagaagggggtcctgggaccaatcccccacagatactgaggaatgacaaagtgtcagtgttgtcattttcttcatgaaaagacttagccaaaatcaagtattatatattatacaaatacgggccgggcacagtggctcacacctgtaatcccagcactttgggaggctgaagcgacagatcacaaggtcaggagtttgagaccagcctggacaacacagtgaaaccccgtctctactaaaaatacaaaaattagccaggcatggtggcgggcacctataatcctagctactcgggaggctgaggcaggagaattgcttgaactcgggaggtggaggttacagtgagccaagatcgtgccactgcactccagcctggatgacagagcgagactgtctcaaaaaaaaggaaatatgaatgtcacattttggagccagtagtgacagcagttatttactcaattcagttattaacctatcagccaaacacatacacaaaatatttcttctagatacaagcaattaatattatgcaaaggctaattaattaaatgtccaagctaaatttgaaaactattgaaatgaaccacaaaagatcaatctatctttctgcctagccactgaaaatgaatagtatataaaaatatagctaaatataatctctgcagagcaaaagctgagaagaaccagtgagcttctcatgctaatacagttaataatttattttctaaatgttttgtaagtatattttgttcctgttaattctgtctagtgggcacactataacatatttctctcttttctctcaaattctactttatatttttagtgaataacttaaaaatacacaaattaagataaattattctatttgtagtaaaaatatgtatttccacctgtatattcaaaaatatgtatctataaaccccttagtaagaacagcttaagcatttatctcagatgatcattttgttttaaacattaatttgcctatagaaccagatattatccagaatacaaactggaacaggggaacataaagacaattaataatgatataaaaaccagaatcttcaagatgttttcaaatagcccatcaaattccaaaatggtttcagagtcaatattttcctaaagttaaactttttagagaaatctgttgtttgtaatagattgcttttaattgaaacaacatgcagttgtttttatttttttttatatactttaagttctagggtacatgtgcacaatgtgcatgtttgttacataggtatacatgtgccatgttggtttgctgcacccattaactcgacatttacattaggtatttctcctaatgctatccctccgccagcccccaactccacaacaggccctggtgtgtgatgttccctcccctgtgtccaagtgttctcattgttcaattcccacctatgagtgagaacatgtggtgtttggatttctgtccctgcaatagtttgctaagaatgatggtttccaacttcatccatgtccctccaaaggacatgaactcatcattttttatggctgcatagtattccatggtgtatatgtgccacattttcttaatccagtctatcattgatggacatttgggtgggtttgaagtctttgctattgtgaatagtgccacaataaacatacgtgtgcatgtgtctttatagtagcatgctttatcatcctttgggtatatatccagtgatgggattgctgggtcaaatggtatttctagctctagatccttgaggaatcaccacactgtcttccacaatggttaaactagtttaaactcccaccaacagtgtaaaagcattcctatttctccacatcctctccagcatctgttgtttcctgactttttaatgattgccattctaactggtgtgagatggtatcttattgtggttttgatttgcatttctctgatgaccagtgatgatgggccttttttcatgtgtctgttggctgcataaatgtcttcttttgaaaagtgtctgttcatatcctttgcccactttttgacggtgttgtttgattttttctggtaagtttgtttaagttctttgtagattctggatgttagccctttgtcagataggtagattgcaaaaattttctcccattctgtaggttgcctgttcactctgatggtagcttattttgctgtgcagaagctctttgtttttttttgttttttgttttttggtttttttttgagacagagtctcgctctgtcatccaggctggagtgcagtggcgccatcttggctcactgcaagctctgcctcccgggttcacgccattctcctgcctcagcctcccgagtagctgggaatacagacgcccaccacaatgcccagctaattttttttttttttttgtatcttttagtggagacgggatttcaccatgttagccaggttggtctcaatctcctgacctcgtgattcgcctgcctcagcctcccaaagtgctgggattacaggtgtgagccaccgcgcccggctagaagctctttattttaactagatctcatttgtctattttggttttcggtgccattgcttttggtgttttagtcatgcctaagtcctcagtggtattgcctaggttttcttctaggtttttatggttttagatctaacatttaagtctttaatccatcttgaattaatttttgtataagatataaggaagggatccagtttcagctttctacatatggctagccacttttcccagcaccattcattaaatagggaatcctttccccatttcttgtttctgtcagtttgtcaaagataagatggttgtagatgtgtggtgttatttctgaaggctctgctctgttccattggtctatatctctgttttggtaccagtaccatgctgttttggttactgtagccttgtagtatagcttgaagtcaggtagcatgatgcctccagctttgttctttttgcttaggattgtctgggatatgtgggctctttttttgttccatatgaactttaaagtagtttttcccagttctgtgaagaaagtcattggccgattgatggggatggcattgaatctataagttaccttgggcagtatggccattttcacaatattgattcttcctatccatgagcatggaatgttcttccatttgttggtgtcctcttttattttgctgagcagtggtttgtagttctccttgaagaggtccttcgcatcccttgtaagttggattcctaggtattttattctctttgaagcaactgtgaatggaagttcactcatgatttgggtctttgtctgttattggtgtataggaatgcttgtgatttttgcacattgattttgtatcctgagactttgctgaagttgcttatcagcttgaaggagattttgggccgagacaatggggttttctaaatatacaatcatgtcatctgcaaacagggacaatttgacttcctcttttgctaactgaataccctttatttctttctcttgcctgattgccctggccagaacttccaacactatgttgaataggagtgttaagagagggcatccctatcttgtgccagttttcaaagggaatgcttccagtttttgcccattcagtacgatactggctgtggatttgtcagaaatacctcttattttgagaaatgttccatcaatacctagtttattgagagtttttagcatgaagggctgttgaattttgtcaaaggccttttctgcatttattgagataatcatgtggtttttgttgttgtttctctttatgtgatggattacgtttattgatttgtgtatgttgaaccagccttggatcccagggatgaagctgacttgatcgtggtggataagctttttgatgtgctgctggattcagtttgcgggtattttattgaagattttcacatcgatgttcatcagggatattggtctaaaattctctttttttgttgtgtctctgccaggctttggtatcaggatgatgctggccccataaaatgagttagggaggattccctctttttctattgattggaatattttcagaaggaatggtaccagctcctctttgtacctctattagaatttggctgtgaatctgtctggtcccggactttgtttttggttggtaggctattaattattgcctcaatttcagagcctgttattggtctattcagagattcaacttcttcctggtttagtcttgtgatggtgcaagactttattggtcttgctagcagtctatcaattttgttgatcttttcaaaaaaccagctcctggattcattgatttttttgaagggttctttgtgtttctatctccttcagttctgctctgatttcttgccttctgctagcatttgaatttgtttactcttgcttctctagtttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatttacccagtagtcgttcaggagcaggttgttcagtttccatgtagttatgcggttttgagtgagttttttaatcctgagttataatttgattgcactgtggtctgagagacagtttcttgtgatttctgttcttttacatttgctgaggggtgctttacttccaactatgtggtcaattttggaataagagtatctttgtggtgttctctgtttttcctgaatttgtatgttggcctgccttgctaggttgaggaagttctcctggatgatatcctgaagagtgtttctcagcttggttccattctcctcatcactttcaggtacaccaatcaaacatagatttggtcttttcacatagtcccatatttcttggaggctttgttcatttctttttactctttttttctctaaacttctcttttcactttgtttcattaacttgatcttcaatctctggcacccttttttccacttgatgaaaatggctattgaagcttgttcatgtgtcatgtagtttcgtgcatggttttcagctccatcaggtcatttaaggtcttctctacactgtttattctagttagccattcgtctaatctttttttaaggtttttagcttccttgtgatggcttcaaacatccttctttagctcggacaagtttgttattaccaaccttctgaagcctacttctgtcaactcatcaaagtcattctccatccagctttgtttcattgcttgtgaggagctgtgatcctttggaggagaagaggtgctctggtttttagaattttcagcttttctgctctggtttcttcccatttttgtggtttttatctacctttggtctttgatgatggtgacgtacagatggggttttggtgtgggtgtcctttttgttgatgatgatgctattcctttctgtttgttagttttccttctaacagtcaggtcccttagctgcaagtctgttggagtttgctggagctccactccaaactgtttgcctgggtgttaccagcggaggcttcagcacagcaaatattgctgcctggtccttcttctggatgcttcatcccagagagccacccacctgtatgcagtgtcagtcggcccctactgggaggtgcctcccagttaggctacactggggtagggacccacttgaggaggcagtctgtctgttctcagagctcaaataccgtgctgggagaaccattgctctcttcagagctgtcagaccaggacatttaagactgcagaagtttctgctgccttttgttcagctatgccctgcccccagaggtggagtctacagaggcagcagaccttgttgagctgcggtgggctcctcccagtttgggcttccccagccactttgtttacctactcaagcagcagcaatggtgaactcctctccccctgccaggctgctgcctcgcagattgatctcagactgctgcactagcagtgagcaaggcttcgtgggcatgggactcactgagccaggtgtgggtatagtctccttgtgtgccatttgctaagaccattggaaaagcgcagcatttgggtggcactgtccccatttaccagatacaatctgtcatgacttcccttggctaggaaagggaaatcccccaaccccttttgcttcctgggtgatgtgatgtcccaccgtgctttggcttgccctctgtgggctgcaccctctgtccaaccagtcccagtgagatgaattaggtacctcagttggaaatgcagaaatcacccgtcttctgcgccaagcacgctgggagctgcagactggagctgttcctattcagctgtcttggaatgggggtgtctgttatttgatttttaaatgcttaaaaatctgttacctcatttaatttacaggaataaaatagagtaatttattttatttaagaggacccttgggagtagtgaagtggtagcaattacaatttaatttaacatttattgaacacctacagtattagtctgttttcacactggtataaagaaataaccgagactgggtaatttataaagagaagagatttaattgactcacagttccacatggctggggaggcctcaggaaacttgtaatcatggtggaaggggaaagagaagcaagtaccttcttcacaaggcagcaggaaagagggagtgtagggggaagcaccccttataaaaccattggatttcgtgcaaactcactacatgagaacacattggggaaaactgcccccatgatctgatcacctcccaccaggttcttccgtcgatacgtgaggattatagttcaagatgagatttgggtggggacacagagccaaaccatatcacctactatgtggaagtcacaatgcttccataattaatatacccgtaaagcttaaacaaaaattgtcttaaaagaaaaacagcataaaaaattgtttgtgtgtttttaaagtgaggaactgacttcaatctcctgataccaacaaattaacaaatataaatctggtattccaagcatttaaaaaattctctgcaataggactgtttgaagaatctataaatcatttatcatgataacaattttaaaaatcatttaatgtgttaggcaacgatacgtaacaataagaaaagcacagtcctttcctttaaggtttgaggaaaatatagtctagtgtatgttttttaatcagactaaacttctacattcccaagtacaggaataaatatttctgtgatgtatatttactggcaatgactagagaaatggcttggaattaagaatattttagatggagagaatgtcaggaacagaggccagaaggcagtgacaagagtggaggtaaacaggcttgagcccttgactttataggacacagtcaaaaaagagtataaccaatgtgtgatcaaataattacagcatattttgataagttccacattaaaggcatgtgcatgcagatggattgaggagagggtattactatagcatttggaaactttccattttatcttaactcatctaattcctctttctcttgttatttaacttggggtttctcagcctcatcactaatggcattttggcccaaatattttgtttgtttgtttgttcgtttggggtaagagcctgttctgttcatcacagaatatttctcagcattcctgacctctactcatttaattccagtagcactacgttcccctatccacactgttgtgactaccaaaaatggctctagagcagccaaattgatcccagttgagaacacttttaactcattggcttcttattcagtaaggctttctttgaaaatccagtgcagtgtaggcactagattagtcatgtggataaatgaaatggattcatcttgaggataatagggccttcctaaaaagaaaaaactagcatcacagtcttgattattaaaagtaagggaagggaaaaatcaaactaaatttggtcttaaaaatcatagagtcaagttgaggttaatgggtatttaaaatcactcttctgaactccttctaccatgtttaaatgtctaaaatagaacagaagtgctattcaaggaggtaactatactaagacttacattttcccctgagcttgactacataaaagtattattttctctttctttaaaacattgcaagaaggtatctcacattttcttacctcaggagtcatttttaaaacttctggcttactaaagccaaaagttctagccaaagaaaagattgtcccatagaaaattggagaaaaaagttaataatggaagaaaaataaggcagggtgccccaaagcacacagaaaaattataatgtctcttaaccaaaacactttccaaataacttttttgcctactttgtaatttctttcactgtttgtggttctctttccaatacttgcattgtttagatgagccagaagggagactggaggggaatactaggatattaggcacgcacgttgttcccttaacattatttttctatctgtgctttcctttctctttctagtatctttcttttgttatgtgtttgatgtctacattaaataaaggatacaacatggaaaaaaagtttttgtaagtactcaaggagataaaaagcaggctatcttaaaagaatttaaatcagagttgcttccaagcttctgccttgaaataatcaatatccaaatttggtggaagaacatggtacaatccttagtggggaagcacgtgagccaaggaaattgatgatgtcatgtacattgtatacacatgaataaaaaagtcaaaaagaacgctgttctagtgatttaactataggtgtatacttatttgcttttccttttcttactggccaacatttattttacattctttaagtagacacactacaatttcttataattgtcccagtgacttctcaagtggataatctggtgacttctccttcccgagacaaggagcaagcacatgacccaaactaggacagtcaggtaatgtgtccccagggtatgattcttaagcctagtgggttgttttttggtttgtttctttaaaaaaaaaaaaagaggaataaggggtggggtaaaataacataaaagaagagagtttgctgttatttcatctgcaagaaaatcaaacatctgctgctttaaaggctctacaacttcctgattattttgtggtaccaaaagccttctttggacttacttcactttgatttagtgagctccctcatatccttctaagagttaactttttgtttcagttaatcataatctcatgattataatcaaagaaagctaacaaattaattgaatatcaacttttttgttcaacaaaaattaagaaattttgttacaataatatctgagcggaaaaattacctacaaactgaggcattatagtactgatagatgtaggagatacaatttccatctttaagaatattgaaatctaataagaataaaatcatgcttataactaaatgcaatgtaaaccaagctctggaaaggttatttatagaaagaaacatttttagtgcactatagcatttcaaaggagggatacataacaactgcctaaagttatcagggagaagcaaaaaaaaaggaagactagtctattttacattatggaaaataaaagttaacaattttttttattctaacatctaagtcacaaacttaatgaaaacacctttttcacaactttatatttatttttagttgactattacaaactatcctacataattagctatatagctaacatcataaatttcaaaattcatgatacagtattgttataaatcgcattataactgtttctcttttgtgaaaagaactaaatgatcgtggctttttaaaataaataaatgtataagttcttttaagtctaaacaatgttcttgagattttgtttgtgtgctggttgtgaagtattctggaattttgtattgtatagtcattagttttcatataaataaatatcatttaattaaaatattataattaagtataatcatctctccccattatgttcaggttatataatcatattttgggttatccataggccttttcccacaaaccacttaatatctgatacaggccactgaatcaaaggagctttcataggaacaatttggtatttgaatcttaaacttatatgcacaaagtatacatataagtatggatatgaatatacacatggtatttttaagaattgtcggccaggcatggtggctcatgcctgtaatcccagaactttgggaggccgaggtgggtgaatcacctgaggtcaggagttcgagacaagcctcaccaatatggagaaatcccgtctctactaaaaaaacacaaaaaattagccagccatggtggcgcatgcctgtagtcacagccattagggacgctgaggcaggagaatggcatgaactcgggaggtggagcttacagtgagccgagatcgtgccactgcactccagcctgggcgacagagggagactccatctcaaaaaacaagaaaaagaaaaaaatgtacatatgaatggtggttggtttaacatttgatttaatgtatcctatttgtattttgtgatgtctttgttatatcagaatgcaggacacattagaaagacacgacaggggagcagatgacgtttagtcactcaggtgagacaacaacagacttaagtatatgggcagctgtggagttgagagaaaaatgacacaagatatatttattaggtgatgatttacctgcttatgaggctgacatgtaggatttggttaccatccagatatgaagttagggttgggaggtaagggaacaggtcatgacaaagttcttgttctttgcaaattgtataacattttaaatgactcatcccatttaaagaagaaaatatacgtcatcagtatttttccgagacctctgtcactctaagagttctgaaaagaaatagcacatttgaattgtatatgtttctgaatgaaagtgcaaagaagttattggaaaggtgacatattctaaaattcctttttatttttaaatttagagctgttcgcattttttattctagagataaaagtggtctgctactgaactaaaaatgatttcattttgggtgaattctgatttgtggtggctgactaaggtacaagtcagagccctggcactgcaggatagagaagcataatctgctattagccctatttcgctgttggttctctaatctgttgcgctagcatgattttcctcttgattctacctcttccaggtcacagatgacaaacagagaaaagctgaatgagtagcagcaggataggagcaaaatcttgaggttaactcactgttctgtctgacctttccaagggcaagcaaaaaaaaaaaaaagactatttctaagttcttactaatacaagctattcattcattaatttattcaacaaatacaaatgtatacccatgatgtatcctgcaagtaggctggtgttaattacttaaaattgtacaggaggcattaaacacaggtaaaacaccaaaataagggcatccttgataaatagtatgtacgttaattgccgtttgttcataactgaaatgaatcagaaaagtcgacttatgtaatacattagcaatacttatttgactatttttttacaaaatgaatagccacttatttcccattttatttggtttataagttatttttatacatattaaattgttttttaaaaggtcattattggactagtgacaagtaccacatttctcattaaaggtgtgatgatttgagggaggttctaacatttgatgatgacatatcatttatggtacatttactgttatttaaatggtaaaatgcagcatttatgagtcataatcatatcttcagctccattgttttcaatgaatgttagcctctaacattgacagtttccaaggcatgataaaacttgttttccatttgtggaaataaacacctcacccgaacactgttacttttagtcttaaaacataaaagttattgtacaattttaagctaaagaaatgccattgctgattttatacttaagaataaatatatattcatataatagtttatggcagtttctactatttcataaggggtttatatatttgtgtccctttggtataactggtattgtgtgtgaagtgtttgtgaacgtgaacagtagagttgtttcattaaaattaacagggtgcagtattttagtgccaaattaaatcaagtaaagtgaactaccaggacattgtaattaaaagaaataacagcaacttaacatttttataccagaagcatcattatcagtgtcccctgaatttgggggtgctaggcatggcatctagaaatggcttttgatttattttcaatgtttccaaaaaaaagtgcagcaaatatttacttcagtgcattttttcccccatgaataaccaccaataaaaaatgcatcgtttcttgtcctccaggcaatacagctaaagtatacattgagattcaggatgaaaataatcatcccccagtgtttcagaaaaaattctacatcggaggtgtatctgaagatgcaagaatgtttacttctgtactcagagtgaaggtatgcggaattatgttaatatacagaactaaagtaaaagctcaggttttgcagataagctgtaagcctgtagtttgcattaactgcatacttatgctgtataaacaaaagcctgaaacttggagctatattagtttagttatctaaactcaatacagattatatcaggtaaacactaagcaacttcttgagtttcattttactatgaaaatggtaacaaaatacttacgatgttttacattgaataagatgttgaaatgtatatcttttcttaatggtttgtattcctccagtaggataactcaaaagattctcaaaatgaaatctctaatgacaaatataaaattaccacttctaatagaagaaatagtggaataaattaaccatttttttctgaaattgtgaattttaaatgctgattgaatgaaagtaaaaaaataacactaccagttttagtactttactaaaagttacaaaaaccttgatgtctcagagaatgttggcttacttggaatttcaaaaatgcagtatctaagaccaaagttgtaagttttcaatttttttctttatttatcatcaaatgtttattactaattactcttataatagtttataatcaaatgtttatgactatttctaatcaactgtgtattactaatgttttattactaagaaaaaattttaaagattgaattttactgaggaaaaagtttagatgctaaacattttggattctcaattgcggagttaattttggacagcatttcaatggttaacttgtaaatagctgtaaattgcacataaaacctaaacatctctggcaaatctagcttttgattgcttctagttttgcacatgagtaattgcctttcttttcctattaccaggagcaccatgattagagctcttcttacgtgtagttttatcacctatcaaacactctcagtaagaaaaaaaattcaacctaattgggttgggcttgcaaaatagctcttccactatgctaagtacagacccctgacctgaatcaccagtttaactaaaagtagtccacaaatctgtcattcattacatttaatttatgttgttatccacaagtaggaatcctttgtagctgatttttatcttattttatattttagtctcattaactcttaattgatttagttctatcatttagtcaaatatgtttgagtacctataatgtgctaaacactgttctagaagtttgatatagagcaattgacaaagcaaacaaacaaacaaagtttccacccgagtaatgcagacaaactagttgaagaaatgaatagatgagtaagttatgtagtgataaattctaaggaaacaaaaaagtttgataagggaagaatgagagtggtgcaattttagataagaaagttaagatagttctttttggataaaactgaaacagtgacctgaataaaggaaaagatcaagacatggattcttaagtgagcagcattctgggatttctctgtaaagccctaaaggtagacagggagctggaggctagtgtgaatgaaaaagtctggtaggaaatgagatcagaaatgtacctggggctagaatatgggattcgttctaggtgtgttggaaagaaagcctttgaatgatttaaacagttatgacatcatccaatataaaaagattattgtagatgctgcatgggggatgttgggaatgggtaacacagtgttttggacaagtagagtttaatgcatgacgagtccaggaaaaatttgacggtagcttgaacgacgttgataggctatggagaccttgagaagggggttaaaggatagaacatataggatttgccgatgaatcatacatgggacattaggaaaaatcaagaatgacttggtggtttttgtcctgaacagatccccatacctcctccactgcctattgtgatggcagtaatcaaggtttgggaggctttttcaatacagaaacctaattcttggcaaggcatttgcaaatgctgatctagacttgagagagaaataaggggccaagatgaaatcaccctgaaaatgggtttgacaaaaaaaatacgaagactaagctttgggaatttcagcacttagagatcaggagaagaagggtttggggatactgagatgttgctgccatgaggtgacaggaatacagggaaaatgcaaggtccctgaaccatggaaagaacaagattgataaaagaggatcgttgactgtcagatgctactgtgattagaatgcccttgtggatttttacatcaccacttatgttactaatcctatagtgtgatgtaggaaaaaaagataagccaaatgttaaactagtccattaataaaggagattactcaaaaggcatgtgatgactataacaaggaaatttagtgggtggcattatctgatgggatttacttcagaggaattgggacagagtgtcaaaggagacagaaggatgcttgccctgtactcctgggctctgtgctatgtaaattatggtagccactactgggagatctacagaaagcagcatcttttgtcgaggatggttagagggagaaagaaggaatcaaaaagtataggtaatactcagagggaaagttgaacatttaggggattttgttgatgatggtctgtgatttccaagggattctggcgaaagtttggtagtagtgtaaaagtcaggtgagaaactgagtcttaataaggtgtgtaaagacattgcattgaaagaagcatcagggtgaggacatatgccctggacagaatgcatggacttcttcagatgaagtatacagtgttgggattgattgtgtctccagactactgagaactctaaggaaccctcccccttcaaactatcagtgggtaattcagactagggaaaggggtcctttctaggaaaccaacttcatgcaatataatatactaggtactttatacaatagtgagagaaagaggggagagagagacagacagagagagggggggagagagagagagagagagagagaaagtttagagagagagagaaagaatgtgtttatgcaagtgtatgctataataataaagtcaagtagcagagcgcaaattgtcttgtggattcaaaggaagaaaacatttcagttggtgaatgaacataaaggtttcctggaggatgaagaatttaagactagcactgaagggtggttagatttttttttccaaagtgaaacatatgtgaggaagacacagtctaagtagaggaaacaaactaagtaagccaaaactcagaagaaacaaagtgcagagcgtatctgagtgataggaggcaagggatttacgagcggaagggagtaataaatacttaatgtttaacaattccagttgctgcctttagccttgaagcctgaaatctcctttccagaatttaatcagagcatgagttaagcagttcttctcattttatacttagagcaacaaaaatattaatgcaaacagcactgaatcaggaccagttcagctgtggtgtttgaaggaaggaaagatgattttaaaaatgggaagtagcccatgattgtgaaagaggtgtttctaccaattgctatacaatattaggtaatggtagatcatctaccatgcatacaagttaattttttttggtccatgatataacgcagaatgataaaagttaaatgtaaatatgtgctttgtgtaagaagggaaagaagaaatgtgacatagaataagattgacaaagtaagataagactttgaaatagcagtgaataaggctatattagcttaaaagatgagtagtgaatttggggcattatttttaaaatatgctacaggtaaagtgacacaataaaaacattgttgaagtgaattatccaatataagtaataacataataaagacaattgtatatctgctctgaagtggtatacctaatatacttaaaaacttaggttctaagttcatttttttaaagaaaatatatactgtgttcttactctgtactgaaaatatggaagcaacaaaaataggctctctctacccttacagaagccacattctagtaaactagaccacccccccccgaaaaaaagtaaataaataaaaacatatgttataattaaatctagatggacaaaatacctaatttagtttcagttcatgtttatactatagtgagtggaaaataatataattatctgaaatttaggtgaaggtgagttttaaattattctgtttgtaccactgagttaatttaggtgaagtctctggttttaatatactcacattgtctgagtatagtagacaccattagttggctatttctcctacctcacactttaacagaatttcagttttatttaggtattatttttggggatcatgtgcttcaggggaagtgaagcctattccaaagtggtgaaaaatggctggtcagagccaatcatgcctgtcctgttacctttgcaaatgattggtttgcacgtggatatgtgagtcatttttgagcagtgattgttaagggaggtctcctgaggattttctaggacaaagatatatacagacatgtagatacttgatttctggctcaataatttgaaggctcatgtcacatttaagtacatgaattgtatcaaaagtgcacagaacaaaaagttatctgagaagatctatatttactatggtttcatgctgggtatctgtgtcacaactggttctacgaagttgatttccgttagtgacaagtaatcagtcattttaattatgaggagtgcgaaaagaaaatccaatggtaattcgtttttctttagtctttaaaacaattagttaatatcagttaaaatataactcttactatatacttaaaataattgaaaccaaagacttgatcatgtatttgtacacccatgttcatagaagtgctatttacaacaactaaaaattagaaacaacccatatggggccgggtgcggtggctcatgcctgtaatcccagcactttgggaggccgaggcgggcggatcacgaggtcaggagatccagaccatcctggctaacacggtgaaacccccgtctctactaaaaatacaaaaaattagccaggcgtggtggtgggcacctgtagtcccagctactcgggaggctgaggcaggagattggcatgaacccaggaggcggagcttgcagtgagccgaaatcacgccactgcactccagcctgggcgacagagcgagactctgtctcaaaaaaaaaaaaaaaaaaaaaaaaagggaaaagaaacaacacatatgttcatctatagatgaatgaataaacaaaatgtgatatacacatacaatggaatattatttagtcctaaagggaaataaattctaatacatgttacatcatggattaatgaggacatcatgctctgtgaaataacctagacatgggcaaatattgtatgactctacttacctagagtaggcaaattcataaagacagaaagcagaatattggctgccagggtttaggggtgaagtgggaggaggtaaatgggaagctgttgtttaatggctactctgttaccgtttgggaagaagaagacgttttgagcatgaatggcagtggtatttgcagaacaatgtgaatacacttaatgtcaatgaactgtacactgaaaagtggttgaaatgctaacttttgtgttacgtacattttaccacagtaaagaaaaagaggagagagggcatcacttttattgaaagaatgtgaacaccttttttaaactatttttaatttataaaatgttttaaactttaaaattttttaaactatatttaatttaattcattcctttgaagctcttatgaatgtgaagcttatgttcaaattcagaagtaaagatttatattagtcaatttatttttcttgactatgtactgcgtttttaaacattttatttcataaaacaccagttgcaacaatatgggagtgatgtgcattgtgggaacatgctaatcctctcagcctgtcaggaggccatatagaatctgcattaccttgtatgttgaaaaagcctccccacaattctgagtcctccttctctagggcaggccattagttgaacatcattaactgaaatgtcctacaccagcggtccccaacctttttggcaccagggcctggttttgtggaaaacaattttttcacagacaggagtgcagagggggatggtttggggatgactgaagtgcatcacatttattatgcactttatttctattattattacatcgtaatatataatgaaataatgataaaactcgccataatgtagaatcagtggaagccctgatcttgtttttctgaaactagatggtcccatctgggtgtgatgagagacagtgacagatcatcaggcattaggttctcataaggtttgtgcaacctggaaccctttcatgcgcaggtcacgatagggtttatgttcctataagaacctgatgctgccactgatcttacaggaggcagagctcaggaggttatgtgagccatgaagagtagctattaatacaaatgaagcttcactcagtcacccaccactcacttcctgctgtgtggcccagttcttaacaggtcaccgactggtagttgtccatggcctgagggttggggacccctgtcctacactaatgaaaaatgactgatgaatatggttacatcagaatagcagactcctgcaacaagggtgctataaatgactgagtgaagcaatatgttaaaagcaaatactcacgacatctattaaaaaatatatatctcaaaggagcagtatccagaatatagaaagaactgtaaaaaagcaactatgtagtcaacaaaaaagaaatagaaaaagtgatgaatacttgtaatatttgtaattttttgtgtgaagaaggaaagttgaagctaggcctttgaacattaactttttgtttctgctgggctttgaagaaatgttaatggataaatattccctaattcataataataactgtggtttatttgtcattattatttttctgagaactgtgaaatgtcatttacttattttagcctacactctttaaataaataaataaaatgaataaataaaataatatcaattaaaataaaacaagtaaatttaaacattgatttatgcagtagatgcaattatttcttattgcacttttgggaaaattgaagctcagtaagtctggataactttcctagtattactcagccaaatacccagtgaagttggaatttaaagttaggtctacctcagttcaagaacttttcttgtaacctcttacattgcttcccaggagaaatgaggcgtagaatcctgctagaaaataagagaacatactaactttctgtgaaaaattaggagacaagtaaaaaggcaaccgatttcttttcaacttgagatgaactgtgtaaattgtgacaccccctgttaaggtaacaagtaagatttgattttaaaaacacttttcaaattgttaactaatttttccagtttattgcatgttgtcttaactgcaaaaatagcatttattgcaaatacagggagatgttaaatgtgatcaagattaattttaaaaaactctgaattatgaagatattttccagaagttaatgcagtgaggattaatctcattctttacaagttgcacatatggaaaaacagtgtcagaagaattgagttataatgttgatttgatctctactgaaagttaaaaagattttgaatattctatttttgaattattaaagatgccaaatttaagaaatttatggactaaaagaaaataatattgtgaaaaagcagcaagaaaaaagacttaacacttaatggctgattgtttattacattttcaaaagcacaaactggtgatgagaggtttcagcagagtgatgccgtagatagaaaaaagccacagtcatggtcagaggatgcaaatttccttagtagcaaaaggtatagaaatgtacaaggttaacaatgtagggtaatacataatgtttctagacagaggttagggctcctgggggctcctgggggctcctggtctctagccctatacctgctcacctgggtcttaggtaaaacatctccagcacatttctgaatttttaatgtattttccccaagtagcatctctttaatttacagagaacagtgcatcacaggagcaataagtaaccttcccaacatgtgcagctaattgggagtgaggctacaatttacagcctggcattctgcttccgagaccaagctcaaccacgtttccagtggaagagcactggactgacattctaatcacctggatttagttctgggcatgctcttatctctctgtgagactttatgctccatcactctgtgccacagatatcttctcacataaatattgctgtagaagcaggtgccctttaaaatctttaagctgatggtttgcttatttatgtgttatttactgttacaatgtcaagtgtcctgtgacaactgttatacttgagaaccacattttagaggtcaaatagcgtagattacttagttctgaaatcaaaatcaccatttatgttttacagtatttgtggtttatgttacttgaaagctagtgagttattttgtgacaattttcttcctagttacatatagaacagatgcaaacaagaaccagcctgaagtaaaggtccaataaaacactaattttggttccccattgccaagtatgaggaaactctctcatggtttcaagggagaggtgttttcacaaggtcttactaatcactggtttccttccatctatggccataccaccctgaatgcgcccgatctcgtctggtttccttcatgttttggcacggtgtttgaccttgtgtggtttgtactttgaacaaagcaaacatatgtaggtgtctgagggtgcattgccttcttgactatgaccctgtaactgaatcactatatgtctagtttagcacttaaaccaattatactgttatcgtttatctgtgtgcatgattttcctactagaatttaaatttcatctaagcagacattatgttttcccatcaacttaaagacattatatattgggcttaacatttcaaattggtgtttgtttaaaattttatttattgattttaatttagtttattttatttcaataatttttgggtacaacaaacccccctgacacaagtttacccatatagcaaacctgcacttgtacccctgggttttaaaaaaagtttagcaaaaaagtattttggggagaacaagtggtttttggctacatggataagttctttagtgatgatttctgagattttggtgcacctgtcatctaagcagcatacactgtacccattgtgtagtcttttacccctcaccttcctcccactctgtcccccgagtccccaaaattcattgtattattcttatgcctttgcgtcctcatagcttagctcccacttgcagatgagaacatacagtatttggttttccattcctgagttacttcacttagaataatggcctccaactccatccaggttgctgtaaatgccattatttcaatcctttttatggctgactagtattcaatggtgtatatataccacattttctttatccactcattggttgatgggcatttaggctagttccagattttttgcaattgcaaattgtgctgctataaacgtgtgtgcaagtacctttttcatataatgacttcttaaaattttatttatttatttttacatatactcatgtcttttaacctgtttaacatatgttgcatgaatgatcatttcaaattagtaaaatacattttacattaaactcttttgggctgattacaacacagaataacatcaccctggacttccctgtgggtttcacttcttgccaaattagaaactcagacttgatgacagctttatgaatgttatccatgtatcatagttttacatttatttagcctcactggtgacatcaaatgtgaagattttttttttcctgaacaactgggctatttttgttatatgatcacaggctatactgtacttaatattttccttttgtttttttccaccgacactcaaagtcaaatatttgatccatctttggcaattttagaagatgaatgcaatacaaattgtggtatactgactttctctgatttcctttatatattttacgtttactctctatcatcttttctttcaattatttttagattatatcatatatttttagaaaatacttcacattcattttgaaattctgtggcacaaatgcagacagatgattacaaaaaaatctattctgtttctacactgtattctgtattttatttttaaagaatatatcgctgttactatagtcaccatgttgtacaatatatccctttaccttattcctcctatataactgaaacttgatattccgtttcaaatagtctaatcctgcattttctcctgtactagttgagaaccataaaaaacattaccagttgctgatacatagcatttctccttattagtctgaacaagtaaaacattcttgttatgttcttttaatataagtggacaagatgaagtctattttagatgtcagttgagtatacaatgaaataattctgcatatgttttactcttcttccccctctccacacaaatcagtttgtttgttattgtagaagggacaccaaaaaatatcattctcctagcaaacaatttatgcctattaatttgaatgtaatttaattaaaaattgctttaattcgtattacttataatagaaatcggactacttttcccagactataattatctgaagaatgagggaagcttggatgtttcaaaatcgatgaggccggtcccagtggctcacgcctgtaatcccagaactttgggaggccggggcgggtggatcacgaggtcaggagttcaagaccagcctggccaagatggtgaaacccagtctctactaaaaactacaaaaaattagccgggtgcagtggcaggcgcctgtaatcccagctactcaagaggctgaggcaggagaattgcttgaatccaggcgtctgaggttgcagtgagccaagatgccaccacggcactccggcctgggcgacagagactctgtcttggaaaaaaaaaaaaaaaaaaaaaaaacatagatgtaaagctgctctgataactggaaacttttttgtttgtttgttttgatatggagtgttgctctgtcacccagggtggagtgcattggcatgatctcggctcactgcaaccttcacctccctggttcaagcaattcccctgcctcagcatcccaagtagctgggattacaggtgaaagccacacccagctaacttttttgtattttttttttttttttatttttagtaaagacagggtttcaccatgttggccagactggtctcgaaaccctgacctcaggcagtctgcctaccttggcctcccaaaatgctgggattacaggcatgagccacaacgaccagcctggatactttatttttaaagtagagagtttaaggactttttatgaatttgaagagccattggacatgatacatgaaaataaagtagtttatttggtaaatggccaaataattttgcctttcctaaacttgctggtggctcatatattttaaagtttgagtgcactctagcagtattagaaatttattaaatgtctttgtatctctcagatgattaaatgtgtaacaatccaaggtataggtatggaatactatttttggaggtaagcttgcatttacttttaggaggttttataagttttagagtagtgatgattgtgtgtactctcctatattatgtttcaaaggccacatcctccatcatctgtagagcaagaatactgacatttggttctccctttgaaaatctcagaatttttctgaaagtgaaggctgcattgcaaggcacaattcagaagataaattgggcaaataaaaattacttttgtctgaagatgtcctgtaatgtcttgaacctccattaactttgtgctgtactgacctgacacaggagatctataacacgaatataaggggaaaaaatgaggaaaatgagcttttaaaaattgtttattcatacttctataaatgtatcttaattttgaattgtctatcaatatttccaataagaacggtaaagtacaagagttccttaaaatgcgttatgaagaaagtttagttccaaataagccataagaaataaatgattcttcctattagtttcaattaatttaccttaagggaaacccgcaggcctggagagagattttatgcataaagagaatacaatttgcactggttagttgtaattcactgaaaatctgagaattgcagagactttaaaatttttttatttttccttttttttcaaaaacaggcaatgaaatgcctggattcacaaaaatgcattctagtgaacaaaaataacatctaaactaggcatctccatcaagttgatccagaaactttatgtggtagctacactagtttttataaagataattctctctttaataatgtttcattttactcatttccaggatttctccccctagacatttatggtctcttagaaacccagtaatctagaaaaggacaaaagtcagtgaggctcatagtaatttgaaagactatcaacacctgaagccaatagaccccaagatatgttgaatgctgatatcaaaagaatttttttgttcttttttttgagacagtgtctcactctgtcgcccaggctggacatgcagtggcaccatctcagctcactgcaacctccgcctccaggttcaagcgattctcctgcctcagcctcccgagtagctgggactacaggcatgtgccaccaagtctagctaattttttgtatttttagtagagatggtgtttcaccgtattagccaggatggtctcgatctcctgaccttgtgatccgcctgcatcggccttccaaagtgctgggattacaggcatgagccactgtgcccagcctaaaagaatatttttgatgtataatttttattacaagctgcatacataatgcaacctgcatatgcaaaatcacacagattctaagtgtgcagctagataaatatttacaaagtgaacacggtagtgtaaccagtgcccaggtcaagaaacagagcattaccagttcctgctccacatccccgtaagaataactagtatgacttccaaccataaatttgtttttcttgtttacgatatttttatagacttaggaaaattgtattttttgtttagattcattttctcacactatatttgtgagattcatctatgttattattgcatgtagtaataattgattcattttcattgctctagagaatttcattgtacaaatatattacagttaatatatcctatatactgtccatataagttgtttggggtttcttaatattacaaatatacttaggagtagaaattctaggtaaggggatattcataagttcagacttaatagatagataatatcaaactgttttcaaaaatgttttactaatttatatcccctcagcagtatctgagaacttcagttgcttcacaatttgattttgtctgatttttttttttagtcactgtgatgaacatgtgatggtttcttgtgcttcgtttaccattccctagtagttaagatagtcaaatgtctctttatatattttttgccagtatttgtatcctctttatgtggcgactattttggtctctttctaacatttttctctggacattctgttgtttgttttgttttctcattaagtctttagaattctttatatactctggattgcatatctttattcaatatatgtattggatatatcgtctcccaaggtatggcttgcattttcaccctattttttatgctttttcatgagcagaaacttttaatacaatttattattttttcatgttgagcaactttttgtcttgtttaaaagctctttgagtaacacaaaaacatgacttttttaagtttatttccaaaaattttatttcatattttatgtttagatttacagtccatatgggatttttttgtgtgtttggagtgatgtaggaggtcaagatttttttttttttatttcccatgtggatatttaattgaccagcatcattttctaaagagaccattttttttctccactctacttgacgtgttctctctgttctaagtcaaatggtcatggatgtaaaggcttatttctgaatactttattctatttcattgacctgtttgtctttgcatcattctgctatctgaattactatagttttataatatctgatagtgtaagtcttctgcttatttttttgtcttcaaggtttgttggcttctcttggctctctctgtgtgctcattaccaaataaggtttagaatcagcttatcaatttccacaggagatatatatatatatatatatatatatatatatatatatatcaaacttaactgctagggaattgaaaacaaaccataagaaaccaacacatgttcatcacaatgactaaaaaaaaaaaaaaaaaaaaaacagacaaaatcaaattgtgaagcgactgaagttctcagatattgctgaggggataaaaattagtaagacattttggaaaaagtttgatattatctatctattacatctgaacttatgcatatctccttacctagaatttctactcctatgtaatttgtaagacaaatttgtaatattaagaaaccccaaacaactgatatggaatatatatatatatgtatatatacgtatatatatatacgtacatatatatacgtacatatatacatatatatatatatatatgtatatatagtgttggaatgtttatttgtatccaattggtctacagatatatttaaagagaatgtcagctatacaatattgagcagaggtgaacatatttttggtctgtgtttaaacaaaccagcaaaatctcttcttctatgaagaaaaactgcatgagtgggttgggttaggggctggagaaaagtattaatagcattttttaaactatatattctcttctttcttacaacccatggtgtatggcactgccaaattaaggagtagatgtcaaattattatagtatttctgtagtttttaatgactgttttctttttttgaagatcctgtattcttttattacctatgttttaggagttagtttttgtttttttgttttttgttttttatttttattttttggagatggagtcttgctctgtcgcccaggctggagtgcggtggcgcgatcttggctcactgcaagctacgcctcccgggttcacgccattctcctgccttggcctcccgagtatctgggactacaggcatgtgccaccacgcccggctaatttttcgtatttttagtagagacggggtttcacccgtgttagtcaggatggtctggatctcctgacctcgtgatccgcccgcctcggcctcccaaagtgctgggattacaggcgtgagccaccgtgcccgacctgtttaatgagtttttaaaaatacagggaagagaattgaattttcatgagagtactgtagaaacaaagaagaaacgtgaagctgtagagacacaattttagaaatgtatattacatttctaaaaatgtttaacaagcttgaaattaaaaggaaaaggaaaaagattattcaactttctgttaattttaagttattcttcatggaagataaaataattctgacaaaaggggataagctagtatttttcttattggttagcatagtttattccatctaaatattagtcttctctttacttaatgttaaggaattctcgatatttaatgcttggtaaaacaatgccacatagtgttcttgtcatttatagcaagaatgcatgttttaggaagacgaaatactatattacaggtggtagtagctgagaggtgccagtaatcaaataccttaggttggatctgaaagacagggtggtagggagaatgaaagtcagtatgaactagcatatgtgtttactttggttcttggtttcagaatccaggatcatgagctagtatagtatcatttggacctgaaaaaattgcataatcatgccaacatgtcaaaaacagattcataaatccttcaaaaacgtaagcacagacacagtccttgctgatgttttataatatagggcgttgataaagagcccaaaatgggcaataaaaataagtgaaagggaacagcctgcatcttagaaaaggcagttggagggatttcgacactcagcagagaacaaacatcataggaaaaagtaaacagtgtggcttccagacccagaaggcagtgagctctgaacatattcactttgagattaagtaacatttgaatagaacaagaccagttgatactgaaacaacctcttttgaggaatgggctctttttgggctcaatattctggttcagagctaagatatgagtgtaagatgcggctgagcccaaaggtgccaaaaaaaaaaaaaaaaaaaaaaaaaagaggcatacatgtgggcaggaaacgactagcagctcctgccccaaaaacatgaagtcatgataggaattactacaagaacattttatttaagtcaatgttgattaaagtttaaccaaatgttatgggtatgctaaatcggaagactgtgaaagaaaggttaatgaatataatatataaaggacattataaaaataaagttttgatatatttaagtctaaccgttttccaaaagcataataaggacaaatgtgaggttttatttaaccatgagtgggctgtgtaaccaggagtggacaggtttcttaatttctgtaagcaacaggtctgcagagtgatgacaacactagctaatgaattttatctgaatataaatgagaaaatgcacataaagcactgagcacggttcgttcctctctctgaacttagacattctctaaatagacattctctcaatagatctctcaatagtcattgttacctgttacctgagttgttctttttccctgtaagatgatagtaatctcaaaatcaaaatgtttcaaacagcatgcacagtgcatacatgttattaaaaacacagttttattgaacacacagccatttttctttgcccttaaaactgaatactgggcctctctttccagaattcaccttcagcattagtatagaatgctaatttgtcttcttaatagtagaataaggaataattataagaagctgaatacaacataatagattcctccattaagtcaccagatgagttctctttgagatacaccttagtgtattatttacatgaaaatattattccactgaggaatactcaatataacttttctaaatccttgtatatgttaaatgagatagttggttctcttatatgaatactgaccagattaaaatgtgtgaggcatatttatatgttttaaatgagtagtattatcttagcaccatgttataaagtatttttgcatagaattttcttgttgtcaatggttatctgtagcttgatatttttctttctgggagtatggtaagcttaagaaaaaataaataattatctctatatgtacaggcatgaagtcctgagaaacaaaccctaacagcacagctggaaacacttcaaacagtcttcaagcagtatcagtataaatttatccagagaacagtttttaaaataatatttcttttttttaaaaggcatattgaaggttttttggtccttataccacagtatatcataaaatggagtgaaattatattatactaattaatgtacatctgctaagtggaaataaatcttgaagttctcttaattaaagtaggaaaaaagggaaaaggcagtgaaatttattaaataagttttctttagaaggagggggcacaatctatataaaaaataagcccagcctgggaaaggccagcaagttaagaatgtttatagagagaccataagtaccccattgtatataggtatggtcaacattgccatttttcaaagtaaatgtattgatagaaagttctgaatggcagaaaatttatttttcattattaaagaatgaattacctataaaatattgaaaaacgaagcagctctttctctggcattaatgaatcacagcatgacacataatcttttctgccacctcctgagagtattaatggtatattatgttagtaatcatcatgaaaattaggggtaactaatgagaaatgaaaaataatacaatgagaatgtgtatctcacctacatttataagggtctgattagcattaaatgcaattaaatcattgaattatctttcaacatgaaatttaatgaagtagcatcactaataaggatacaagcaactctgtgtcctgccagttttgtcttctgctttgtcctgaaaaagaggtgtagagataaagctgcttgtcttaatctaattcctactggacttaacagtatctacacagagggaaaaatgtgagaaatattagattgtaatttttaatgaaagctatctgttcagtacaggtattatctgtttctgaaccaaggaacctgataataatcttcagcccaccacatacttttctcagtacagtcagttttttggcgaactctgcatgggggcttggagttaaagactatatgttctgctcaccaactgtgtgatttggggtcattaatttaatcttccatggtttagaaatggcacccacggaatgacttttattctttctaactaccagaattaagaaatttttatgataccctctttgttaaagggtgtaaaacagagcagggcactgagtcaactttcagatgatttcttacatttcccagatcttcctcaaatatagtcttctgtctcttactccttttcagtacaaaactcaacctgcatttaatcgccccagtagttgtcagtgtcagcccctgcagatttggctgaagaacaatttggtttagagcaagttggccaaaggcaagtaagttaaagacagattgagcagtgctattttttggccaaatcaaataaaaacaaaccagtttgttttgttttgttttgttttgtttttttacaaaaacaggccaggcacagtggctcacgcctgtaatcccagaactttgggatgccgaggagggcagatcacctgaggtcaggagttcaagaccagcctggccaacatggtgaaagcccgtctctactaaaaatacaaaaattagccgggtgcagtgacacacacctgtaatcccagctactcgggaggctgaggcaggagaatcgcttgaacctgggaggcggaggtggtggtgagccaagatcacaccattgcgctccagcctgggcaagagagtgagactccatctcaaacaaaacaaaagccttttaaatgtgaatgttatttagaaactatctttcaagctttggtaatgttggtgttctctgggggttattttacaacaatttatagatgtgtatgtattcacttaaaaacatacatatcttccttcctgccatacaaaggacatttgtgaggaactagtgtagatgacctgcttcttggtcagtgttttttaagtggcagagcagtttcctccctgcagtctaccgagtatcagcccttagcacagggatttgtaaaaacaaagatttaacgaataagaaaagagaaaaaggagatgatgatgcaaagaaaaaaatatatctctttaaataattttacctgatcattatgatatttttatcctactctttctgttgtatgatgtttaaaatagaaaatggttaaaacaaaaaaattcttaatggctggctaatgacaaaaaaatggattacaaagctataggatggcatgatcctagtttgctggaagaatacacacacacatatacatatatgaatacatagaatacacacacatatgtatgtgtatgcatatgtgtgtatatatgtgtgtgtattcttatgtatttttatatgtatacatatgtgtattctttcagtaaactaggatcataatatcctatatgtatatgtgtgtatgtacatatatgtatatacatatgtacatcaaaaaaacataaaggaacaaacaccaatgtgttaatgatgcctgtaaatggataaaattataaagtttttgtattccttggtccatttgcatttaatggtatttttctaaaaagcaagaagcacaaagcattttatatattaaacacattataaaagactattggccatttacatttttacaatttttcatctttacacataatacagaacattaataattagatgtaaatgatttgggaatattttaaaagaaaaacagagggaaaaacaaatacattctaataactttgcaaagagatatgcgtgtattacaattccatcagtggttcatgaaaaataaccatatttttaaaaaatagcagttggggtcaggcacggtggctcacacctgtaatcccagcactttgggaggctgaggtgggcagatcacttgaggtcaggagttcgagaccagactggccaacatgatgaaacccccatctccactaaaaatacaaaaattagccatgcgtggtggcgcgtgcctgtaatcctagctatttgagaggctgaggcaggaatgttggggtgatcagacccaacaccaggtagtgggggcgacgaagtccagcagagtcaaaggaatgagaaaaagacatttgagagagaaagtgggactagggggccatcacgagtgtggaagctgcaaaggccccgagctctgggagcccatgctatttattggtgcccaaacaaacaaaaaaggtgatgtggatgtgggggttgaaaggaaacagtgtatcaagtgaatgagaaacatatgtctgcttgagataaggggagtgctagaagcaaggagccagcaagtctcacagacatgcaagccctgcctcagcttctctgccaacactcagcttttctcccaacactcagcttttctcccaacagaggagaattgcttcaactcagaaggcggaggttgcagtgagctgaggttgtgccattgcactctagcctgggcaacagaaacaaactccatgttaaaaaaaaaaaaaaaaaagcaagtgggcaattcataatattaacattttaccaaattatctcaaaatggaattgtaatgttaatcatcctgtatagtaaattgttttggggccaactcttcagataaaaatcactgcaatctctgaccatggatgcttccacaatatttcatctcagtcctgatcagatctgtgtcatttacctgttgtaatttttttacttagttcccagtatattttgtgaaccacaattcacatcaaaacatcgcaagggttaaaaatatgtataattttatgtagacaaaagtaatctagcatacacattttagaaatattattcttaagaatataaatacatggtggcttggtttttttcaatgattaaaaattatgtatgtctaataatttagtccaggtgtgaacttcaaaagataaattttattatgtgtactcagtttttctctttgctctattggcataaacgtttttggtcatgctcaattactttctgctgcctaagctaagaaaattttatcaatgattatttttactttttttatttttatacatttaggggttacaagtggatttgttatatggatgtattgtgtagtggtaaattcccaattttactgtaaccatcgccctaatagtgtacccattaggtaatttctcatccttcaccctctcccaccctcccacctttctgagtctccagtgactgttattccactctctatgtccaggtgtacacattatttagctcccacgtataagtaagaacatgcagtatttgagtctggctaacaaatcctgaaattttaggtagtatagctgcatgcagcaagactatttcactgaaattttactggtgttggagccatttctttttagcaaacttgtaagttggtactcatgacacaaaatacatcatgttataaaatataaaaataactatatatgtgtgcatgtgtatacatatgtgatatatacatatgtgtgtttttaaacacacacacatacacatacagagagagagagagcacgagggagagctccaaaataccatcaatttaaatgaaggacactgaggacagacactgtttttttgagggttgtttatattaacatgttacaattatataaattcgaggagacagatcttattgtcccatgtacaaatagtaccattctagtccataaatacagtcttctttacaattagtgtcattataacaatactaaaggcattttgtttggtaataattactttcatcatagccctatatatccagtctattttgaaaattataaatttattttccaaggtaaaacatttataaattgaattatatttgcctcgacatactcttttactatgaaagcaataagaaaggtttttttaaaaatttttgtaatagagctttttgtttctgtttgtaaatttattaggtaggcagtaaaattgtcagaatttacagaggattcgacattcagatttaattttcaattgccctgctattactttcctttgactttccattaaatttagaaattaaaagatgaatagacttcttatacactattcatatttgaaatcatgttacagtaagttcattttacagtaagttcaagtttgcttcgtgaaccctgtgttcttaaaatattaaattgttttatctctaggtcaaatgacttgtactgttagcatattaaaatacaagtcttcctgctctgttgcaaattttgggcccatgggttgaatctgtggccatgtaattttaaaatagatgtttattatgaactgtgaagtcttcattatatgtaatatgcataacacctattttatttgaatttctaaatattccagtggtttctcagtaaaattttcagaaattacaagttaatattgaacactgcattggagtacaaaatatttgttttacatgaagaagatttaaaatgaatgaaaaagtacaaatacaaaatgcagaaattacaaacaggatttatcagcttatcatgaagcaaattttaagtatagaatataaagttacggctagccgcgatggctcaagcctgtgataccagcactttgggaggccaaggcaggcggaacacatgaggccaggagttaaagaccagcctggccaacatggcaaaaccacatgaggccaggagttaaagaccagcctggccaacatggcaaaaccttgtctctactaaaaatacaaaaattagccaggcgtggtggtgcgcgcctgtagtccctggtactcgagaggctgaggcacatagacatattaacaaaagaaaacacatgtataatttgatctttctatttgagagaaaaaaattagtttgaatgttggttttgaatcacaaaatgctattaatttttaccaaaaatgcctatacttaaattatttatgaatggtataccttttacaataattctgtaggtatacatcgtaaatccttcagcattcaaatcaaattaaataacatgcttgttatttcaaacttccaaacttctatattattccttagttacattagtcttcattaatccaaaccaaattcagctactgcttcttggctcccaccctccttataagcatcttattatatctgtatcattataaatattttctatttaagtgcttttgctttgctatcaataaattatatagcattcagtaaagagacatcaataactatactttcctcagtggcagatttattctttagcaaatattttctaattacattctactggccatgagacttatgagatccaaagacgattcagaaaatggtcctgcttccaaagaatttatagccagtgacacgatgcagaaagtgaaaggtacgtttaagtgtacaaaaagtgatttaaaaaaaaaaagaacaaatagaagagatcaggaagatagctacaaagtattcaaagatctcagtagtaaatgcaatagtaaaacaacagctaaccttgatttaggtttactttgtaccaggcactgcattttacacccgagtgaatattcacagccaacttattcagcatgtcctattttcctcattttacaaatgaggagcaaagccttagagaatcacttgcccaagctcatgtatctaataagtggtagaactaaactcaaatctttcaattctaattattgatgtctcaaccactatgatagtcttctatagacatttaagccaaatattatttgaccactgactgcacgtggtaccacagtgaaaaatatgaactgaaacaaatttgacgtataatggacacacaaaattaaaacgtgtcataataaatgctaatatatacacacacatttatgtaacataacaatgaaaatatgtaagtagaagcagcactccctagtagagataagaacaccttcagaaaaggggtcatttaagctgaggtttgattgctttattcagtgttttattatatatatatatatacacacacacacgtatatatataatatattatatatttatatatatactatactatggcatacacacacattttatatatatggagatatatatatatattcaacgtgtgtgtacgccatagtatagtatatatatagactatatatagaatatattatatgagtatatatagtctattatatatagactatatagactatatatatagaatatatatagtctatatatatattcaaagtgtgtgtgtgtatgccatagtttactgtatgtatatgtagaatatatatatatatatatatatatatattcaaagtgtgtgtgtgtgtgtgtgtgtgtgtgtgccatagtatagccaagaagtgaacatcatttggcctagcagacaaaagacatttcatttaaggtagaagaaacaatgtatacaaagaaatagaaacctgaaagaacacattcttcagaaaaacaaaataatatggttctgggaagtagaataaatgtaaagcaaaaagttggaatcatgaactttaatcagattgagaatatttaaaggacttgttttaacattcatctctggcaagtgggagctatcagtaatttttaagctatcgctagagttaaaagtgagatctgatgagagcctgaaattggccagtgtaagcttggcctaaagtattatacagaactgagaaatattgtataggtagaaatcagaatgcttgctgatggactggaagtagggaggagccaggaggtgagattaaaccgagggggaggatgctgaaattttttagaacagttcagttcatagatggtgttgcccttcctatgcaaaaagaaaaaacagaaggagaaccacatatgatagtcagaagagggacagcaaggtgggagccaagaagcagcagctgaatttggtttggactgattgaacctaatgtaactaaggaaaaatcaggaagttcaaaaataacaagtatgttatttaatttgctttgaatgctgaaggatttaggatgtataactacagaattattgtaaaagataagctgtttaagagtggatattttcggtaaaaattaatagcattttgtgattcaaaaccaaaccaacatttaaactagtgtttcctctcaagtaaaaagcataaattacatgtgtgttttcttttgttaacttgtctatataatagagcacaatttttttctttttcacatggttgaaaagttagaacaattagctcagagtttattttaaagcatctctgagggaggtataatcattttattattagcaataatgacggaaaaagcaaaaccatttatagggtaatatttattttacaaaacatttttaaaagaaaggaaaaaataaaaaaggaaacttcaattataacatacatgcaagtcctgcttgttttgtactctcaagccttctatggttcagaatttaccatataattttttaaaataataaaaggaacatttggcttttctttagtttctttctttaattttctaaatagatgttatcctgtaattttttgcaccatgatttaaattaagagtaaattttgataaattctaaccgaaacccagccctgtaaaggtctttgtaattcaaactatgatggcatgtctctattattgttgcactggcgtgtttccattattacattgctgtttctacaatgagttgtattttactctttagaatctctcagaattatattagacttttacttaactctacaaaaagtaaataggtatgttgaacttagaaattattaatattgcattgtagtcactgtttgacattcttatgcaaaatcaaacacttgagcttgcatatttaaaatgtttcttttctctttctctccttgtttcttcttttttttttttgcaaaagttttgaatagccctaaaagtagatcaatctacctgacatttttcttattcatattttatcatgttctgggtatattgtctttaaggactttaaaataaagatttctttctggtttctaaaaatacaagagttggccgggcgcggtggctcatgcctgtaatcccagcactttgggaggccgagccgggtggatcacgaggtcaggagatcaagaccatcgtggccaacatggcgaaacttcgtctctcctaaaatacaaaaaattagccggatctggtggtgggtgcccgtagtcccagctactcaggtggctgaggcaggggaatcgcttgaacccgtgaggcggaggttgcagtgagctgagatcatgccactgcactccatcctggtgacagagcaagactgtgtcaaaaaaaaaacaaaaaaacaaaaaaaaaaacaagactcaagttaaagtggttctaacctgccaaagctctgttatttttgctttttgcaaacttgacatagtgaccttggtaggtggaaatgtgagatttgagtatttttatccagacagtctaaaacactttcactctatttcagggtaagtgagccttcaataccgttaaatgttaaaatgggtctaattgagaagctaaagttaaacttggcattactgaactttaatgggtttgaaagttcttaggacatcactaattatttcactaatatttctgcatccatggtattcatttaggcaacagaggggaacagttatttaggctattagaaaattaatggtctcccctactcccctgtatgatagaggcaattatttggtgattttcttttaatgttgtacatctgtatccattaaaatttccagatgaggtcttagaaatgggtaagtggtttcctgtatctaagctttcacttaaaatataattatagcaagtataattataatattcatttctgacttttattcttttaaaagaactctagactaacttttttttttattttgttcactaagggaaactcataaaagtcagtgaatcaaatcttccagagtcacctctcccagatattaatgactttgttgtgaactgagcataaatgtttgattatagagaaattggtggaaaaagtaatatcatattaattctttagtaaattgtattcatttagcgtttccacagtgagtcagttttaatttttatgcattaatttaacccaacttgttagacatctccttattactattaataaattatagaatatatttatgaattatttatgccattactaaaatatctctatgaattttcccaaaatattaagaaaacaatacttattatatttacagtacgtggttctgtagtttctatatgacatgtgggttctaggtgtgagttacttgttatttatcctgtttgcagtttattgggcttcttaatatctgtggataacaatcttttatcagttctggaaaattctgttctattctcgctttctctctttctgaaactctgattagatatttgccaaaattttcattctaaactccatatctcaaactttttttttttgaggttgttcatcttcgtagctctgtgaaacattctgtgtcatttcctttgccctatcatttcatttactaattccctggtcagctgcgcttaacctgctaacaatcccatcttggggtatttaattctaatttttttttatttctaaaagatactttttcatttcttttcaacgagtctcattttttattccgcattttaaagctctttattattgaaatgtattaaccatatttgctttatattcagtgtctactaattcaaatatttaaagtctatgttgttatgaatttgatttttttatctcaacggacttttttatgattgtttcttgtttgttttgataattattataacttttcatctttcttggaactttatttgttagaattattttaggcatggcttgcaggaggggtttttgaaaaagcacctgcttctgtcaggcaggagaccaggccattttcagtcatagatgatttctcttaaattctcaggttgtggtttttctgtccattcaggtggagatcaggcctattagactttaccaatggaatattatgatttctccttgagttgggcaaactggtggccggcaaataatggctgcaaactaaaatgaggggctgtatttcgtcctagattctcaaagaagttttctcttcactcccctcaatagcaaagtttaagtttacagttttcgttgcagtttggggtgatagtagcagtggtagcagggggaaaagtaaatttctcctttactcttacggtgagaatttaactttctggggagggaaatcttaatagactcactttcatgagtaggcttggggccttgcctcctattgtctgagctactgaaaaccagacaagttaaattttaattttacccaggtcagtaaaaaaaacaaaaaaattctaaatgaaagctcccatcagtactatggtttttatattcttacctttacttttgcattcagacttctatagcagaataccatagacttggaagcttatatacaagacaaatttatttttcctcatagttctggaggcagggaagcccaagatcaaggtgctaatagattaagtgcctagcgaggccgtcctggttcatggatggctgcgtttctagtgtgtcctctcatggcaaaacggaacaaaggaagtctctggggcctcttttcaaaaaggaaccaatccgtttcatgggggctctgccatcatgaacttaactgctttgcaaaggcccatccttcaaatgacatcacattgagtattatgtttcaacatataaatttggggagaaataatcagtccatagcactttgtttttgactggcatatttattgtctttccatcttcttgatggatctaggaagatttcttagaatattttatcgaacatttgttgttttatttttaaactgcagttttatccctggtatttagtctcacatgtggaatgtagtggctttaaagtgagacttatcccactgtgctaacaaccatatgtgtgattatgaacaagttactaatctctctgtgcctccatttcttggcctataaaataataatggaatctactcaatggaaaggatgtcatgagataatgtaataatatatgtatttacatagcatctggcaaattgtaagtgttcaataaatgttagcaaacagcggaagcagcaacagcattatacaaacaacataaatggacttggtaatttaaagaacaccagactgattgttgatctgagatggagtccagcctcagtcactgatgttagcaaattaaatggcatggcaggggcagagatctggctgcggttaaggcatgattgtaaagtaaggaattacagatggtgattctataaaaattttctgaggaacttaactgtgaaaaataggtatggaagtttgggggctagtgtcacgagtgtggactcagtaaaagaaaagtttcatttcattttaatgagagagacataacgtgttttatagtctgtagaggagaggtgaaaaggacagagatcaatagagctgatgaagcattaaatgcagaagggatgggagtgattcagattaaggcataagtaccttcagtgagagatacgtgtcagctgctcctctgagatttgaagaaagtagtcaaagtaagtacagatataggtacttttttagttatgtgatgaaaagctgagagatctcacatttgatatcctcaaattttatgggaattagagcttccttatctctggagaagactgaaagaatctgtgaactaaagaaaaaggcaaacttctggagtgagaaagagaacttattacatatagcaaggatttcctaaatagacaaaggcacagtgaaactcagagaccatggacttacagtaacactagtctgactgattatttaatttctctgcgccctcttcagtcaccaggagtaaactgatggttagtttggtccaagaggagaaagatccaggtgttgtggaaggagagagaaatgagaacaatgtgatcaactctgacttctatgataaagcagaaagggacataaaccctgaagtaatgggagcaaaaggcagtttgcagaactgaaaattcactgatatcaaagaagaggtcttaactaagtatgatgattaaagttgtggtcagaatttagacatgaaagtttaatatataaattaaatatggagtgtttctttaagcggaatatctccctaaggcaaaagactaaagtgtgactgtagaattaaatcgatgcagtgaggtcgttcaaagactgatgaatgttattcatgcctaatactttaaaaataagttgctggatgtgtcatctcaatgaatactgaaatttgtaaagagggaggaagttgaagtagaaggggtagactgagagcaagataccaacatcctcattatgtttggcaacaaggaggggtagagtgtgtactgtacaaaagttcatggatttcaactgaggaagaggttttgcaaaattgcttcaaaaatgagggggaagccatgcctggctaattttatatttttagtagagacggggtttctccatattggtcaggctggtctcgaacttgtgacctcaggtgatccgcccgcctcagcctcccaaagtgcctgtaatcccagctgctggggaggctaaggcaggagaattgcttgaaccagggaggtggaggttgcggtgagccaagatcgagccattgcactccagcctgggcaacaagagtgaaactccatctcaaaaacaaaacaaaacaaaacaaaacaaaacaaaacaaaacaaaacaagaactggaagcaataaaggagagctggaaaagaaaattaagaaaagtagagttataagggagttacaattgtgtgataatatgtctgaagtaataagggtctaaattgattgcataaatttacatattcatggataaacataatatgaaaaaatgttaaaccttttgaatcaccattatgacaacttaggtaactataatagttacactggacttggtcatatttatatttttgtgtatatacacacacacacacacacacacacacacacgtatgaatatatataaaattttaaaatactatttttgggcatccttatttttatcttatgaataaagaaatctgaaattttgagttattagttttgttgttttgtttttttgagacgacgtctcgctctgtcacccaggctggagtgctgtggcgcgatcttggctcactgcaagctccgcctcccgggttcataccattctcctgccttagcctcccgagtagctgggactacaggtgcctgccacgacgcccagctaatttttttttttttttaatttttagtagagacggggtttcactgcgttagccaggatggtctccatctcctgaccttgtgacccgcccgcctcagcctcctaaagtgctgagattacaggtgtgagccaccgcgcccggccttgagttattaatttttcaaagtcacacctgacattggagtccacctcactccaaaacataatgcaaaaaacaagcaaaaaagtaagtttaaaattatttaacaacaaatagagacaatatactctgtgctgaaactctcacttatttttcacatattgacccagatttaaaactgcgctctgaattttattattggtatctctggtgtgactcagtgtgtatttaaagatatcgtatcctgttattgattttatagaaagaacatttggttgttatctatgtatgatggtattgcatatgctccacatcaatcagagtcacatcttagaggagaggtttcggattttaaaatatgtatttgttataaattggggagactaaaaattaaaaatccatgcaattgctcttaagtatggcacccattggaattttcatcagtcactgtttaaattactagtattcaactgaacatacttgaggaagaggggagatttgaaaaatatgctaatgatcctggcaatcatctttgatgaatatctcctgaaataagatctctaagatcccaaagactatcatattcattcaaagaaataaaaattagagtccttactgtataacatacatatgacaatagggttttattttttttaattccagtagacaagatttttaaaaaaacttttatctcattcttgactattttctgcaaatattaaggcatttatatgaaaaatcataaaagaaaatagttatttctgagttaaattgtctagttccacacccaaacttttgcattaagtgataatttgtttcaggaaaggcacatttaacagaacactttaatattttaagatggaatatgactattttgtagttatcataatttaatatattaggaatattgcaaagtgaaattacctgcttactgaaattggaagttaatcagtcagaactgtgtaaagtagcttaatataccaagcaatcactgtggtgattttatggtaaccaccttttcttttccaaatgtgatagtgttgttatacagtatttattttaaatataagggcttagaatcttacagtgcaaaattgaatgaaagaagtcagacagaaaatagaacatattttatgattcagtcaatgtaaagttttaaaaataggcataactaatcaacaatgttagattaggaaagtggttttccttaagaaggtctcagattgtgactccaagtgcatgaagtgcattctggaatatgggtaatttttttttttcaagagataagagtttcactatattgtgcaggctggtttcaagctcctgggctcaggtgatcctccagccttagcctcccaaagtgttggtattacaggcatgagtcaccatgcctggcttgttttgtttcttgatgtaaatgctggtcatgtagatgtgtgtattttgcaaaattttaatgagctttacatttataatttgtacactttttgcatgtttgttattcctttataaagtttacattaataataaaaagtttgtttcatagaaatatccatgttaataagaagatagagaataatatgtaaccaaatctgactgatctgacattaggcccaaatttgctcattctatgtggaagaaatgtcttggataccttgactcagactttgacttattttagctgggaatatgcctttttctatcttatgctatcctttgttgagtgattataaacctgtggttcaaagtttaagtacaaaaaattttgatactgtttttctttctttgttcattttctttttcctttaagtgagaatgtgacctaacattgataactaattactattactctaataccaaaactgagctctgccatgctgtaagccatataaactatctaaagtgattagccggtagtttgagcttgtcctcttctaaagataattttaggtttggcacagtggctcatgtctgtaatcccagcactttggtaggccaagatgggaggattgcttcagtcaaggagttcgagaccagcccaggcaacatagcgagaccctgtgtctacaaagaattagccaggcgtagtggagtgcctatagtcccagctactcagaggctgacatgtgaggctagcttgaacctgggagactaaggttcagtgagccgagtttatgccatggcactccagcctgggtgacagagaaaaaaataaagaaaagagaatattaactccctagaaaattcatgaaacagctgatcctgaagtgaaattatctgtgttgagtagtttaaattaccttttctaacaagtagatatgattatctggaaacgttttaaatggttcacaatatatatagaatttgaagctaaatcaagttgatgctgtatttaatacacatttgctatgatttactattttaatcatttgtgtctcaactttactacttattatgtagtctttcattatgtaacttaaattaaaattagattgaattgaaatttcagtttctttgtcacatcaaccacttttcatttgtcatatttggctagtacctactgcataagacagagctggttaagaacatttctatcatttcagaaaattttattgaatatcactaatttatataagtaaaacaatatattcctcagttttttatattgttattagataagactatttttgtatgatgttattttgtgtgattgtattttgtattttgtatgattcttagcaattcttagtaatggcagatcataaatgcatactcatacttaataataatagcataggtaaaaataagaataatcggataataaaaataataatcattgttataacaaatgaaaatgtataacttacatatctagtatcatgaataaggtatatatagtcttttatcaagcctctaaaactctcctatctaccatttattttccaagtatttcactatgaaatggttctgaaatagacattctaaaaaattacccctaattagacaccataaagccagcccaatatatgattctcatagctgtatttaaaaacaaatgaaaaaaatctaaacaatgtgttagtcctttttaattctaaatggtaggaaactttaatatgtggatcataagtacctatcaccaggaacaaatatgtttaatcgggatacaggatgattaaaaaggaagtcggatagtattctaactctaattagagaattatgttatggcattaattaattagaatatttttatgcatctctaaatttgttataactcaactttattttatttcattcgagatattttactacgttcttttatatttatcctccttaggctatatactacatcaaaaataccatcacactgtatgcctattacagcaagacaaacattaggtaaacaaccaatcccatctttcaaccaatttggatcagcacacacagttgaactcaacaaacctgtaaaccaaaagtcttgattcattgactctgttagtgtctatgtctgtttattttttaaaatctatttttaaaattgacaaataataatagtacttacttattgggtacatagatgtttctatatgtataatgcatagcaatcaaatcagggtaattagcatatctgtcatctcaaacagttatcacttctttgtgttgggaaaattcgatatccttcttctagctatttggaactatatactattgttaactgtagttattctacagtggtatagagcactagaacatattctccctatctaggacattatgttacatgaaataagccaggaacagaaagttaaatgccacatacatgttcttattcatatgtggaatctaaaaaaaaggtgatctcataaaaataaagtgtagaatacaagatactggaggctggtaagggtaaaaggaaaggaggggtagggagaaatttgttaaagggtacagaattatacctatgtcccttttattcatacttcagcagttattatcattctaatagcaaccattcgaaactgtggacacaaagtctattaatctacataactatatccagaaaaaacagacatttaggagggctttattgtgttattattacataagaaacctcattcttacaaacaaaagtaagccatttcataagggttatcttttcctgcttaattataatctctttttttttcccctccgtctaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtaagtagataaaacttcaggaaagggaagtagctacgatactagccataggtcagtgttttcagtttatagaacttctaagattaatttaaaacgggttttcaaaaacataattattattttcactcagattgttagtcactatagtttaggaatatgtaaatatattgttcatatatatatatatatatatatttacaaaaacaccgtaaggtgtttatttttcttgacctttgagaaaaacattataatatttgaaaaaatatgattgtaacagcaaaggtataagcactggatttctattttgtcttcaaagctcatgtttaatatagggtgtccagtgctacataaaaattttaaatgcttcacagagttatactatagaaattaaactatgaaattatttgtttaaattactttcagcattttgtaattgagaaaacaaagaaaatgtttggggacaaattttgttccaatagtatttatttctttgttctatcaaaattcccaatgatgacattgtttagccttgactaagttatatttggctatagtcaataatatcactgttctaattttcacttaggcagtgcagaagtttagtgatagatcatttgaaagggaagtttgatattagcttgtattgaaaatatttaacaccagtgcatatatcctgtggactctttaccaacttgaaagcatgggttatttggagttttgtctgatgaatctaatacaaagtatattcattagaaatatttgtcacataaaaacagatcaagaataagttgtcttttgttctttacatcataaattttcattttttcgcagttcttctcatttagttccctggacaagcgtaaccttcatatacatgcagacatcaatgctttatttttcttcttagataatggtgaagaacaatcaccatgattgtggccaaaacagtcctccaggagcattctcatttttaacagtaaagctgcaatagagtaaatgaaggccactctaagccaagaagcttttgacataggagatattaagtttgacataaatttttgatcaaattaagatcggtaaacactttttattagattccacatatgaataagaacatgtggtgtttaactttctgttcttggcttaccttgccattacctttataacctccatttcaaacctcccactctttgtccataacatttaattaacattgcagctaaacccatcattcttttgttcctaccaggatgtccagtccaattagccgaataattttaacttccattgtgttctctcatgagaacctctcatgttctctttcttgtttactggatttataatgcattaccaattataataagcagtacatcatataaaatttaactttcttgctttctttctctatgtcatattcacttagcaaaacctccactttggttaattccaactgtctcctttctccagacctatatccatgctgattatgtctgcaaaaacatacaaaattctataattagtatcgttgttgttgttgctaagaaacaaggtctggttctatcacccaggtcaaagtgcagtggtgtaatcaaagcttattgcaacctcaaaatcctgggctcaagcaatcctcccacctcagccaccctagcacctaggactgcaagcactcaccaccatgcctagctatagtattgttacatgacggctttgagtgtgaattgtccatgtcgttggtgttttgaacaaagaattgaacaaaacacacaaattaacacaggaacgaaacaaaggaacaaagcaaggaaagtgggcatttatttatttatttatttattattttattattattatttttgagacggactctccctctgactcccaggctggagtgcagtggtgcgatcctggctcactgcaacactgcaacctcggaaagcagggatttattaaagcaagaaagctctccacaagttgggagtggactcaagcaagtgactcaagggcctggttacaaagttttctgggttttaatactccttttgaggtccctgtgggctaccccttatctggatgaaggatttggcctgaggctaaaggctgagctgaattgacccaaggcctgagtggattgatgccctaagcaaatgaaaggatggcccctgcttggcccacagccactccaaggcactttccctttccatctgagacatgggggaagggggaaggttttagggagagtagcctttgatcctttgttactcaggtggggtgtggggagatggtatttttgtttgtttgtttgtttagctttaggaagttggcattaattggtttatgttccctgcccccagacccaggagtttcctgtttaatccaccattagaaaactatcatgaattggccttagattccctgaccccagaccttggtgttttccctttgatttagctttaggaagtcagcacaaattggccttaggttccctgcctccagaccctgttctcctgcatcagtatcaatttaaattaatgactaaaacaaaccctccaaatgagcttttgctttggtcagtaatcactctattttgcctcgatgtcctagaaaatcttctctgctcctgaatctccaataccttgtcctcattctcactatggcctgattaactggcatgctatttcacagaaaaataatactaaagcatttagaaggacacttctatgactcctgccactaaatttacctaccctccaggatctagaccaacattctttgccttctttctggctcctttagatgaattctgtttttatctaaagcctgtacctctacttatgcagtagattcaattcccactcgccagctctaggagattgcctcagcagctctcccatttcttttctacattattaatataaatttcctccttatatcagattattctcacaacaatgctttttttctatcttccaaaaattataaaacatcccttgatctatatcaccttctagctgccatccatttttctattcttctttttagcaaaattctatgttagatttgacttatttctcactattgaaccctctcttaaaccctctcttaaaccctctaatcataagagtgttttctctccaaacactcttccaaactattcttgtcgatgctaccaatgacttccatgttaggaaatgtactgatgatgccagtccttatcttacttgaaccatcagcaatgcttgactattaccctcactatgctttcagaccacccaccatactcccttgtcctactatctcactgtttactccttctcagtctccttcactggttcattttcttctcctgaccttgtagtattgaggtttctcagggctcagacattaaatctcttttctatctgcactcactgacttgttaagctcacttagtcccataactttaaaatatcatctacatagtaaaagcgctcatacttacatctttacactaaagatcattcctgaacaccagatttgcatatttatctgtacatgtagcaattccacccgaatatttttaaaaggtgtttatttagtgtttcctaatggatttctcttcttcatcacatttcttccacctgtagtcttcctcattttatttgatgaccaaatcactttgagttccttaggcaaaaaatttcttgactcctttctctcctaaacctcacattcattcccttagtaaatactgtatatctatctaggcagctagctaacctatcaacgaaagtgtcctaaacaccttttcattattttgttgatgaaatgagaagtatgcatagagtacatctgctgtatgtggaagatggttgcctcaaggaaaagcactatgcaagctgaacaagctgctttttttatggactaacatttttatatgaaagagcaacttagagacaaaatatggttattcaaacttaaatatttggtaggcatttacacaaaatggatgaagggagcctgtcatttcattgaaaacaaccaactaatgataatactgaagctttgaagcacaaattagaatattaaaaaaatgtacctgtcactgtaaacttgactagcttccgaatatttagactttcttgatgagtcagtggttgtattaaataatgtgatttatttattgatattgtgtaatgaagtgtgttgatatttacaatatctgcagtgttcagtaaacttgtattttccaagtggccaatgcaggatgttaaaaaattatgcacgtgtaaaaaatcaattcaaagtacaatggccgggtgtgttggctcagcctgtaatcccagcactttgggaggctcaggcaggcaaatcacctgaagtcaccagttcaagaccagcctggccaacatggtgaaacctcgtctctattaaaaattcaaaattagccaggtgtggtgatgggcacctgtaatcccagatactcgggagaatgaggcaggagaattgcttgaacccaggaggcagaggtttctgtgagctgagatcacgccatttgcattctagcctgggcaacaagagcaaaactccatcgcaaaaaagaaaaaaaaagtacaagacagacaaatagattgtagtataactgaacatggtttcagatttcatgtggaaactaaattttggtatagtatttaaaaaagaaaatacataattatctaaatggactattaaaacacctcttttatttaataaaatgtgagtttgcagcagagaccagttagttagttaggaaagacagttcaagcaggagatgatgaatatctctaaagttgggttgtccaatatgctagctatcagccaaatgtagctattgaatatttgcaacatggctaggtcacacggagatgtactataagtataaaatacacaccagatttcaaagactttgataaaaatatgtaaaatgttctttacatgttaaaatgatattttactaaacatatattaaacatattgggttaaatgtgttattgaattaatcttattatttttatctttctaatgtgggtgccagaaaatttaaaattacatatgtgatttgtattcgtggctcacattgtatttctattggacagcactatttaaaatttatgagagtatagaggaagaaagaaaagaaacttatgagaataaatggaaaggacatagaaatagtaacatgtaaatttccaaccattgcttttttaattttgtgcttcacaaatgttatttctcttctttttaacaatacctagtaatttgaatccattacaaatatcaatctcaatgatgatggaaacatatttataaagctttcattagttattaagctacagaattaaataatttcacagagaattattaaatatttggtgtaataaactgacatgcaaatttctggaaatatttgcatatttgcagaagctatactggaaaagtagcataaataaaatctactaatcttaaacagctaaatatccttgttatagatgataaaacaaaccagagttaggatgtagaatttctgtcaaagaccaaatgtaaactgtaatatcttatttcttcatttgcatagtcaaaatgtgtgtgttctacataaaccagacattagcacattcaggagatttaaaaattttaaagtaatgatttagaggtaagtgtgggacaactactcccggtagtgcgacttctgttaatttatcagaattaaatgttttttatttttatatccttaaaataaaatataaaagtatattttcaaaatgtattaacatcataaaatcttgttaataaaatgtaaccttaaaatggatatattctagataccttaaatgttagctcctactatttcagtcagaattttgcacaaaatctcacttttttttttttttttttttttgagacagagtctctcgcccagactggagtgcagtggcgtgatattgactctctgcaacctctgcctcccaggttcaagcaattctcgtgcctcaacctccagagtagctggaattacaggcatgcaccaccatgcctggctattttttgtatttttagtagagacagggtttcaccatgttggccaggctgctctcaaactcttggcctcaattgatcagcctgcctcagtctcccaaaatgctgtgattacaggtgtgaggcactacgcctggcttaaagtattttgaataagtaacctatctttctgatgaagagaaagcagtgactatccttcaaatttaagaacattcattccttcccttccactaagtttacgttggtcagaactccatcatatggctccactaaactacaaagaaggctgagaaatcgactgtgtgttcccagtgggaagacagaaagagctggatgaacagctaaccagtctatacttctgattaccaaatatttatttcattattttccacacaaatagaacaaagtcttatcaaagttaacacctggatctcagatgtcatgctgttctttttatcaggtctagagggaacttctgatgttttagtgatccagcaaacacattcacccagtatagatgatggaaaaatacagaatatccactagaaattcctatttgaagaggacagtaatggtagacatatggaattgtccaggccaattctgaaatcctgttgggtatatataatgtagatccccatcccgggagcaggagatttccttgattaaatcctgtttctaccctaagataggaaggcttatgtttggtcttcctctgaggctgctgaatctatcctccactagttactacttagttcctttcccacttttgtttttgttcacatcatatatcatatttgtaaagtgtgaccgatttctggtatatacagcctgacacctgattgtatggtttttcggatctatatcagtaaggacctggcagaaaattcatgcacatgtgaaacatttttttttttaattttaagtctccgctgcaagagtcagataatttgaagacagtttaatgaagggtctatttttgaaggcctgggcaggatgaatgtagggaaataagagacagtggaaaattcaagggatactaatagtacggatctgtaacagtctgtcagccagaaaaggtgggttgaagcacatgcttaccagaccaggagacagacatgtgagaagaggacagtttgacagggcagacagtcctaacaattctccactgaaagaaccagtaataaagagttatttctcctactcattttcttctcttttccagtatcctgctaatgttccctactactcaccctatccataacccacatcatggtccaggagctttctcccaacagatggtggaattaggaagtgcttcagcactagtcccactgcaaaagctcctctgtcctgaggccaggactccagtacttctgagtccagcagttagaggagatgatgggagcttcagggaacagagaatgaggcctagtgattatacttctcgttgggataacaccctatagttactacttgttccgggtggtttgatttttatcaaaacttttttttaaccgtttctggcccaatgttaaaagaaagaaaaaaaggaggagagggaaggaagaaagaaggaaggaaggaggggagggagggagggaacagttatgcaagtttcatatacatacttctagaaatttttatcatgtaattttactgctaaaaactcaaaaacaataaaacaaaaaatatttctattcaacttctatatcctctttaactcaagaccaataagaaaagacaaagtgatacaaaaactgtaatgatccctttcgctagttcgctagtgaagtagctagtgttttgtaaaaagataatcaagactcatttacatgttgaagggaaatttagtcatttggtcccagacacctatgacgggttaggggtacaaggttagaactgccagcataaactgcttgctcagaagtaataatcagacctactcctgtcttaatacagtcttcagacatgattgatcatgctcacacaatggtttgatagatttctaactagttgcaaacattttacaaaatattttggatttctttttttcctgaaaaactgaaatatctaggaaatctggattttgtttcccacactgcaatattccttagaggtgagtagtagctgacctcttcagcagagttatgtgctcttggatttgttacttacacttctttctatcatttcatacttttggctacttttctcatttaagttacctgcctggttcctgaaggcatttgagtttgtgacccctaatggggtctctatatgtaaagaatctggagcctataaaaacatgtgtggcaatgtgaaattactccctactgtagattgtattgagatacggtgctaaatatgcctaactcagagtgttcaatttatgattctggtacaaatgcatttatattttaatagtgtataaatgtatgtgcatgataatatatggctttttagaatttttatatcagtattggataatagtaaagagcacaagctctggtgtaaggcagactgcatttaattaggattaagttattaaatatatcctcaatttattttttttgttttaaaatcgaaatgatattaataacaacctgattctgttgatagatttcaatgagttaaacctgtagaatattgaggaaaagatgaaatgccatgttgtaagcacagaataaatatttttatttttcttctatttttcaaatataagaacatagaagaaattcagtagattttaaatgaatgatacatagttatcaacagccattaaattagctcatttaacccatatgtaaagttctaaatatatacctctacctacacaaatttaaagttggttaaatagacaagaaaactatatgtgatgacctcatagaatgaattattctaaccagtcatatctcagattcttagttataatgaataaatgatttctcaagacttgtaaaatataaaacgtatttttcattatcttgggtgttccttaacaatcaaattaaaaaaaaatgccacccttcatgtctcagtaaataaccaataaaacaaacacataaccaaaaacaattgaaatcactcaggattcttaatttctaggtaaacaacaaatagtttctcatgctcagtctgccccagttagtctccaaccccttgtgtagatcatataattaaaaatgtatatatatttgttcctgaatttgaaaatcagaaaccactgtgtctatgcatagtagggaagaggtaatgtgggggttttctgattatggaaatttcagtgagtaaaaattaaatgaattctgttttttcttctttcaggtctccgtggtcaatcagctggatatgcaagtcattgtttccaatgtgcctcctactctagtggaaaaaaagatagaagatcttacagagtaattgattttgtctccttatatatttatttttatatgaccatgatttttaactgtattttttaaattttattttagattcaggggatacatgtgcaggtgtgttacatggatatattgcatattggtgaggtttaggcttcgagtgtgccaaccacccaaatagtgagcactgtagccaatagctaatttgtcagccctcatgcccctcccatcctccctccttttggagccctcagtgtctattattttctttctttatgtctgcatgtacccattgttgactctcatttataaataataacatgcagtatttgaacaaccacaattttaatctgagtgggtcattttaatcattacaatgttcagattaaacatatagtttaagagtgttttaataataatttagcttactgttttctcaaagtctaattggaaatatgtgaagattttgagagtgtcttcaaataaggataaaaattagatgtgagattttattattcagaatgctttgatgtatcagaacctcaaaatgctgcatatgagaaatcataacattcatggattgaatatataccttgattttgtggctccaatttactcaaaaagcagtctggccagtccaggaaatatgtcatttctcaaagcaatgtgtctaaatgcctagagcttagtcttttaaaaccaagttgactaatattaagcaatatatatgttttaaattattgtaaaatatgtggcatgtccctctgcctccttaacagtgtagactcaccatggctgagtatgttatagttaactccaatctagttgtgattatttattaaactgcagttcttatattttgatactgtaaaagatgtttaaaatatctttactattttacccttaattaccctaatttagctgccattattttaaatttttttttctttttttggttacatgaataattctttaatggtgaattctgagattttggtgcacacaagcagtgtacactgtacccaacgtacagtctttatccctcacctccatcccaccctttcccctgagtccccaaactccattgtatcatctttatgcatttgagtcctcatagcttagtttccacttatgagtgaaaacatatgatgtttgttttttcattcctgagttacttcacttagagtaatggtctccaataatggcaaatgccattattttgttcctttttatggctgaatactatttcattacacacacacacatacatatatatatatatatacatatcacctttttttttaacttttaagttccgggatacatgtgcagaacatgcatgcttgttacataggtatacatgtgccatggtggtttgctgcacctatcaacccgttgtctaggttttaagctctgcctgcattaggttgttcttctgtgtcttctgttgatttcagtttgacagaggtcaattatcgtcactgtcaatttgcctctttagcaaaatatcatcacttcagcttgccagaagaagctttaaagagtcagataactaaacttttagtaattatatgccaaataaaatacagtaggcacggattaaagcatatgtgattttcccataagaaaagcatatatgattcataacaattatttcaggatagttcacaaatttaaccttttggtgtcatgtaaattgttttatgagggtgatggttatcaacatttatgcatggaatatcaattgtacagtgtcttgtttatttctgcagaagtagtttatatacactgagccttttcaaaataatagctgattatactttaaaaataattagaattgtgcctaacttttagctgctttaataaaagcctattgagacaggctttctctgattccgttgtctattatgtaagaaatgatacccagcttcaaattttaaccctttattctagtttatttttctacaaagcattatctaatgttattattatagtcaatttccactagaatattatctctacgaatgtatgagacttgtgttttatttctataactccagttatatagtagacacttgatacattttattgaaaggatgttttacaagcaaatcatgatgccattttctttattttgagacaaaatttatcaaactgaaaaagaaaatagcaaaagtatagttttgcaggaatttataagattttaatgcttcttaagtagataggatgatataaataggaaaaatcaggtaactttcaggtcttgagagaatcgtatcattgtgaaggaagctctgacttcataaaactttggatttaaaacatgaaattgggcaaataatttaatcttttcaacctcagtttcactgttaagagctaataaaacatatagaattattttgaaaactgaattatataatgtatctaggacaatagaaagtatgactattcggtgaatggtaaatattccatataaatggagctagcagctcaaagtcagtagacttaggtggagagtggctaggagttttgtacattttatttattaagcatttggtaatggaatgcagattatggtttcagacacagagatttagatcctattacagctctgtaacctctggacaagctacttagcacctagagccacttttattcttcatgaaaattggaataaagacctctatctcatgttgattttaaaagaattaaatataaatctgcgagtttattaagcagcacatacatgccccattccttttgttgtgattaaaaaacatagtataaacattaccatcttaaacatttttaagtgtacagtttggtagttttaagtatattgacattgtttcaaaatagattttcagaacttcttcattttgcacaactgaaatttggtacccattaaacaagtttccattccagccttacccctagactctgggtaacaaccttttgtcttcctacatgtataaattttactactttaaatacatcataaaagtggaaatttgcagtatttctcattttgtgattggattatttcacttagcatgatattcccatgattcatccatgttacagcttagcatgtgatagaatttcattcctttatagagctgaatagttctcaatacataccacattctgttcatctgttcacctctcaatagacatttgggttgtttccccctcttggatattgtgaataatactgctatgaacataaatattaaaatatatcttttatatcctgctttcattcttttgagtgcattctcagaagtgggattgctaaatcatatggtagttctaatttaaagaaaattgttttctatagcagttgcaccattttacaatttcaccaccagtgcataagctttccaacttctcaacctcctatcaacactttttattttctggttctttttccttttttatacgtagtagccatactaatgtgtgagatgatatatcattgtcatttgatttgatttctctgatggttattgatgatgagcatcttttcaggtgctattggccattgtatatcatcttttaaaacatgtctattcaagtcctttgcacatttttaattgggttacttgatttattttagttgtttagttgtaggagttgtttagatattagatactaatcccttatcagatgtaagatttgcaaatattttctcctattccataggttgccttttcaccctgatgattgtgtcactaattgggcaaaaagttttaaagtcagaggtagtccatctgtctatttttgcttttgtttcctgtgctattggtgtcatattcaataaatcgttgtcaaatccagtgttacaaaacacctctcatacgttttattctaggcattttatggtttggaggtcttatatttagatctttaatccattttgagttaatttttgtatatggtgtaagataagggtccagcctttttttttttacatatggatattccattttttcaatactagttgtttaagaaattgtcccttccatgtctgatttcattttgtagattttttttaaaacctatgtaaatttagagttttcttaagcagaaatatttctgatctctttttgaaacctacattagtagatggaagtggtagtgataagaactgtaagacctgagtcagcactgtgaagccccagtgctccccctatccatgtctgggatgagtgatgaaaatacacacataactcaggtagccatcggggtgccaaatagttaattaaatagaagaatttattgttctagtgacgagaccagtaaacacattaattccctgtgacattcttaggtgacaagttagttatcatcaaagccatttctatatttcccttgagacatccctatccgatgaagtggaaaactggaatgtcatgtgatcatttttttttttggtagaccaatattttaggcaaaaatataaagtttccttggtaagtatgtaatcagtacaaatgaggacacttgatgaaaggaaaaataatgacctgacatatccattttacaatggagcagattttacaaagatcagtacactttgatagctaagaccgcagtacctggaaaatggaatgcttgtaataaatcttagctgctgtaatgattactcctcacctcactgaatcagctgaaatgactatactgaaaattttttactactttttagattttaagcttataaaattgaccaattcccctaagtaaggaaacatatacctttttaattagattaatatattcaacaaattccagtgaggatctgcatccactacagatacccttgaatatctgtgctctgacgtattttaagttgatcttagaattcacctctttgtaaggcttgtggttttttaaattacttttttttaaattaaggtataggagaaacagctgtgagaataacagtagggacacgtaactacaatggacaaataattggcaaataattgtctaaagaagaaactatgaaatgtttgcattttataacttctttctactcccagttcaccatgaaactcaaataagaggaatctgtggttctaaaatttaaatccttaagcatctataaaagagatattttgaaaattataaactcgagtttagaaacactgagttagagtatttttgtatgaatcggaactgacaacttatttctcagagttgctcaaacccatctcttaccttctgaataaaatatgaaaattcaattatagtagagctttactgaagtagttactgacttgatgaggaagagcctcaactttatgaaatatttatgtagcacctgaaatgtgctgtgtaatcaatctatagttcctagaattaaggttacaaaacctacattagaaatgtagccaggatatatattacgtatatagaatttatttatttgtatagtatatatgtatatatgtgtgtgtgtaaatatatatatatatatatatatatatatatatatatatatatatatatatatttctaggaggataattagaaggtctctcgggaagcatacctatgaaacgctaactgctagcacattttcttaaatcaatgtaataaaaacttggttttaaggggaaagtttgagctcctttttgtttcagagaacctaggctcatttcccagaccaccaaagactagctaggaagtcttgggccagtctatcaaactctttgagtttttgcatttgtatcttagagctggggatttattagttaaaaaataaatagttacagattgtaagcactggagattatcagtgaacagtgtgaagtccctgctgccatggagcttctattcgattgcataaaaatggcatataaaataacaatattaataaatatgtaatattaagttatgtagtgataactgtaataaagacagataaatacaagtatcaagtagaaaattttggaagagaggtgctgttttaaataggatggttaaagaaagcctttctgataagttgaaatctgagaagacatctatattaagtgatggaaaaagtcgtttgactatgagagaggaagaggcacaattcctgatagagaactgcagttatgaaaacccagagaaagagccatgcttggcttattaaaatatagatatcatggtagaaaatcagttctaggacctgatagatcacttggacgatttcaagttttattctgtgtgagatggaaagtccttagttagacccatctgttcaatatggtagccactagataccttaagagtttcttttgttatgtagtcttctccctagctgccatattctacaattaaattgctgtattgtctattacatgccaattttctctcagcatacttagcataaagatatagttggagttgaagatattatcaacagagaattgccatgaatgatttaatttttatcagataatgcagcacacccattttaatagtacaatttttgaaaataatgtttctgtaataggaatgtaatagctataaaataaactaaaagcaatcataaaaataaaatacaaaccagaaatataataataaatcctaccatttattattcaaggtataatttactattctttaaaaaaaggttaagtgtgactaagctttattcaaagccttggaaattcattgttttgacagaaagaaaatttatttgctactttttgaaatattcatttggagcattatttagtagagaagtaacctctgtttacaagaagaatgacttgtctttaactcattaggttaattatgattaaagaaatcatagttctttacagaactgaagataccccaatatgcaattatacaattaaaagctactattttataataatccttgtgcacattgcagtagcatctttaatgcttaactctttgaaatgtagaaaaagcacagatttaaaattctgtttttagttaaatatggcaggatttttaattgtttccaaaactttagtattgaaataatcacatggaacaaagatgattataaactaaggtgctccatgattttcagttctgttctatttttgagagttaaaaggttttattttacgtggattcttagttattatttggaggaatgttatcttagcccaatatgagtaaattgtttactttaaggattaatcatctgtcacatggctcaaagtcacaataattagtgttttgtctctgataatatatttcacgtatattaaggtaagcttttttttattttgtatgacttggattttccaaatttgtacaaatttttctttctttctttttttttttttttttttttttgagacggagccttcctctgtcgcacaggctggagtgcagtggcgcgatctcggctcactgcaagctccgtctcccgggttcatgtcattctgcctcagcctcctgaattgctgggactacaggtgcccgccaccatgcccggctaattttttatatttttagtagagacgaggtttcaccgtgttagccacaatggtctagatctcctgaccttgtgatccgcctgcctcagcctcccaaagtgctgggattacaggcatgagccaccgcgtccggccaatttgtacatatttttctataagcaaagttaaccaaaagcaaatcacttatcaagtaggttttactttttttcttaagattccattgcatattgattccgtaaagggtcctgtatgctgacatgtttgcttcagatagatatgtttcttattttaatggtcgtcattcattcattcattaacacatttctgaatgcttatagtctattataacagcttctgtttggaaaaaatatatatacatatacaaaataaatcaactttcttagttaacacttgccatctgagagatgtaatataaaaaaaagaaatcatatttgcacactttctccatgccttctcagcaacatagaaaaaaaaagattaaaaactaaagaatgaggcagggctgctacatttaggtggtgtattttgtcagaatcaatattctttctactttttatcttttttacttttttagtattcaaacttttggagacaatggaaagccaaaacaaacaaacaaataaatgaacattgaggacattttcattttgcttttaggtgaaaaaagtttaaaatctttgagctattgttgttttcaaaaagagataaatgagatcttcccagattaaaaatatattttattggaagatcaattaaaaacactatgtgtttagttttaaatcaaagataaatatgtttatgttgcctttatttgcactatgaaaataatacaaacaaaattttggggaaactattttgtttaagaaaatagcatgatcgaaagatacattaaagaaataaaattaattaatgcacaatgaatcatcgtaatgaaggtacccgtatattaactgaatctttgaattgtgcttcaaaattttaaagtgtttaaaatgttcttatcaacttatgatggagaaaaaataattgatacaggtatattttttcctgagatttgaaggtaaggggttattcatgttcaaaagtgaaattcacttataaaacactaaggaaaaaaacatttccagacaactttatttatgtttttattttaagatctagaaattaggaagaaaagcaaagaaagattgagcggttaatcttaacttgtattataatctgtttttctcccctcaaatatcattcagttcagtttatttttaagatcttttgcttgtaccaagtagaaaataactagaaaatagttgtagtgtaaaaataaggacatcattatatattattttatcaaaacatttgaatcacagttgctttatggagatctctaaaatacatagtggacatttatttcttttaaaattatttcctctcttcctcctctttttttttttataacctagaagttttgtcaaattgaacagcttgttatttttgtaattcaccccaactcatggtacaaggtagatatatcacttcctttagaggccactttaatcatcaagagtcaattcctctgttctcttaatcctatttattattcttttctatactttcttcaatttattcacaatttaccgcagtctgtactgctgttttttaatgtgagacataaactccacaaaatgtttatgcaagagaattccgtttgtatcagaaagtcataaattatattttagatgcttccatatatgtctaataaatattaaaggctaaatttaattttgttttaattttctaccttattccaaagaaaaacagaagtagtttacaatgattcacacagaaaaaaaggtaaaatacattaaaaatgagtgtagaaaaataaagcaaacagatgagaaagaagttaaagaaaggatcagagtaagagtaagtaattacagagatgctgcaaaggcctgtatagtccatatagagtagtcacaaacttgactgtcaccttgttagggccaaagtgaaagaagcaaacaagctaaacaaaaagaacagactcagttacaaaattaacaaaaccatatctcttctgggacaaaagaactctttcaaagtctaattccagattagaggaaaatatttttatcttgtgggataccacagagaggttaccatgtaatgtaatgaacaaaatgctccatggcatctagagcactacttaggatatggtctgggtagagtccctgtgggtctgtattaatggaggaaagaagttcagaacagtaggaactgtatgcctgtatttttatccctccagccagctgcaatgcctattgattaatttagctaagcttgtgtaaaaatattgataagcacttggggtggaactctctatgatgctagataaatataagccatttacctcaacaaaagcctaagtagggtttataatcatgaaatctgaagagttcttgtaaccatcacaacaggtagccaacatttatgacacgcttcatattggttagatttttgtgcatttaatgggtgtagtctccttaacctatcacagaggacctttgaggtaggtttgactacttttcccactgtacagataaattccctgaaactttgaaaagttaagtaatttccacaaagacacaataatggaggtttaattttaatctacgtctaccagccaccagcagatggagtttcctctgttacactgcctcttaggaggcaaacctaattaaaaacccaacccatcttttcttgggagtaaactgagcatgcaaaaccagaaattctcatcacatggtaattttaactcaactcattcacacagacaaatgggtaattgagattatggctgctgtaataattttagtgtaaaaaaataaataaaaagctaaatcaaccatgagtaaatacctgtcccagctataaaactatcagtaaacaccttacactacagtttttcataatgcaatttctagttgaaactaattgaagatgtatatacaggtaactggataaggtaatgctgtaaattgaaatttagagcatctaccaaaaataacttggttcaagaataagtaagttaagcgaaccaattgtttattgacacccttagtttgtgattttaaaataatgctatctgcataggaaaaaaaatcagttaaataaacctttcagcatttattctaagaaggttatttagataaactgttttgtattggacattaattagtatgtggtactatactaacatatgttacataaaatgtttgtattagctatattaacgtatttctttagaagttttctgtttttaaaacttttcctaaaggtgacataattaaatagacattaacaggagtatgttagagagcattcaaagtaaagtggaacaatatagccttaaaatgtaatttttattcaataattgtaattatcatccaaatttattaacatatttttcactttttagaagaccaatcacagccagttctctgttttgagaatgctcgacataatcagatactgttttgcttcatacttgattgtactatttgcattttaaatacgtatattgctaccaagaagtcagattcagggaaatttttggcattcattttttaattctttttttgtttgtgtgtgtgtgtgtgtgtgtgtgtgtatacacatacactattgatataacctagttgtacatatttttgggatatatgtgatatttggattcatatatatataatgtgtactgataaatcagcataattggaatatccatcaactccaatatttttctttgtattgggaccattacaattcttcttatctagctgttttgaaatatacaacacattatttttaactataaattccctaccgtactgttgaatactataacttatttattttctctatctgtatttttgtatccattaaccattttatcattatccccatctttcttcccctctcagcctctggtaagcaccattctactctctacctccatgagatccattttttagctcccacatatgaatgagaatatgtgatatttcttctttgcctggcttattccactttacataataaccttcagtttcttccatgtttctgcaaatgacaggattttgttctttttatggctaaataatatttgattgtatatatatactgtatttgctttatccactcatctgttgataaacattttggttgattccatatcttgactactgtgaatagtgctgtgataaacataggcatgcagataactcttcaatatattgattttctttcttttggatgtatacctagcagtgggattactgaatcatgttatagttctatttttagttttttgaggaacctccatactgttttccataatggctgtactattttacattccccccaagaatgtataaatgttcctccttctccatatccttacagcatttgttattttttgtttgtttgttttttgacaatagcaattacagttgggatgagataatatttcattgtgattttgattttcattgccttgatgattagtgatgtcgagcattttttcatatgcctattgactctttgtatatcttcttttgagaattgtctattcagatccttggcccatttttaaattggattatttggtttttatctgttgagttccttatatattctggttattaatctcttgttgattggatagtttgcaaatattttctcttattctataggttgtctctttgacaattgtttcatttgctgtgtaaaagcttttctgcctaatgtaatcccatttgcctatttttgctttcattggaaaatttatatttctttggagtcttacaaaatctttgctcacaccaatgtcctgaagtctcttcccaatattttctactagtagttttacagttttatgtcttatgtttaagcttttaatccattttgagtggatttttgtacatagaaaaagatgggaatctatttttatttttctgaatatggatatccagtttcttatcatcatacattaaaaattgtcctttccccagtgtatgttcttcacatcttggtcaaaaatgattggctgtaagagtgtggatttattttggagttttctcttctgtttcattggtgtacgtgtctgtttttatggtcatatcatgttttttccaaaaaagcaaattttctgtttcttgattttttgtgttttctttttggtcaaagttttgcttatatctgctctgatatttatattttatttcatatggctaatagtcatggattgggttgtgtcttttcttctaaattattgagtaggctgagcatttaatgaaccttcatgtacttaagttctttactaactagttttcctgattctactcagcctagtctcaacacagcaaccagtgtgcctcctttaaatgtaaggtagatcatattactttagtattcaaaaccagcaacagattcttatctcactcagaacaaaaaacaatgctcttacaatcctcaaagtccccacgtgatctgctctggccacacactactacatcagcacatttatacaagcagttagcaattctcttttcttagaacactcattcctagaatagccacagcacacattgttccctaaagtttttgctcaaatatcaaagtctcaatgatatttattctgaacacttttaccaattttatcaatccatgatctgttacttgtcttgttcaatttgaatgtaaattcttctttgacatcaaagattgtattttgttcactgatgtattccatgtgtctggaatggcttctggcccaggataggcattgaataaacatctgttgaaggaatgaataaatgaaaattttcctacttaacacttccctgagtgagttttgctataattttatgaaaagccctgaatccaatttaatttttttcatttttaaactagaaaatatagatttatatgaagactttttttatcacgaagttggggagaggaaatagggagttaaggagattttttaaaaatataactatattgttcttttattcccattataaagaaatataagcaatataatatatgaagaagaaagttataaaaggtaaactcaaaatcataccatccagctctaagcattattaacattacataaacatcattatggacatctttcttgatatgtgtgtgtatgatacaaatattatgggttagataaacatcattgcaaatctctttttctttgtgtgtgtgggggtatatgtatatatgtgaggaaatttatatacatataggtaatgaatatagatgtagaaaatacttagtatatagatatagatgataaatgaaaagatagatttttatgaaatgtgttctcaattaaaaggtatttagttttacttacatttataagaaaaagatacagaagcagttaagattaggctatatctctttttatcataagatatactttgtcccaaaagatctttaaaagtttaacaaaaaaatgctcaaagtgaagacattattgcatgttttaaatgacataatttgtttttagacttcttttattcatgattccctgctaccatgaaggaattggtacagttatattttattccacatctattttttttagtgaaatgattctgcagtattgcactgaaaatagaaaagaacccaagcacaatagatatgtttcttcactgtaggatcacacacaattaatctatgcttatatgaaggatttccttggaacatgtcaaatcaatgccaaaatgcactggagaaggcataaattgttagaccaaagtattgggacagagagccatctattgcattgtatttaactaggtactcctgtttgcgttttgatttgtgaactgattgattatactagtgagaagtatactttcctattccacaaattaattaaaggccttgaatgaatttgagacaaggaagaagcttattaatggaaatatttcagtcaaattaataaaaataagattcattttgttgaatagttactatgtgctaggaactgtgtaaaagctttatttcaccgaatgcacattcagccccatgtggtacattatttccttgttttctatttaaggaaacatggccagatgtgatgctcatgcctgtaatcccagcactttgaaaggccgaggcgggcggatcacttgaggtcaggaatttgagaccagcctgaccaacatggtgaaacactgtctctactaaaaaatacaaaaattagccaggtgtggtggtgcatgcctgtaatccaggcgtgagacaggagaatcccttgaacccgggaggtggaggttgcagtgagccgagattgccccattgcactccagcctgggcgacagaatgagactccatctcaaaaagcaaacaaacaaacctgagactttgagagcttaagattacttgtctaaggttatgcaattgaaaggcaaaggaaattaaaattgaagccagccagacatctgtactcctcaacattatatcattattgtttgtgcctcctacaaaatgtcaagagtataatatggtttgactccgaggcctctcttatttttgttaaatgagcataaatctctcaggaaaaaaaatctgaaaaacacagtccaaatgatgttagactagtctgtgtctctcagtacatccattatcttcaggttcccggggttgttttttttttttttttttccctttggagataaaatcttgctctgtcgcccaggctggagtcactgcaacctccacctcccgggttcaagcgattcttctgtttcatctcccgactagctggaattgcaggcattcaactattaactgatattttccaagtgaatttgctcctcctccttttttacacatcatcttttcttagtctacttcaaggatgtcatcagaaaagaaattgcgaagccgagagaccagtgggcgtggagtggtgacagaaaaggaaaataatgaatagtacttcaataagacagacttcaacagtactgggttacaaacatttaaaaacaagcaagcaaacatttcactatgattggtagtgtctcctggcatgcactggtagagccatttcctccaaagtttagtaacctcattgttctaataacaaggcaaaccaagcacatacaagactcttaagggaatatactttcagtcgagcaagaaatatgtcaattgtggcattagaagcaaaagttattttctgatgtatcaaaggactttagaatatattgcccttctccccctaaaaaaacctcaaaatatagactcagaaaagagcattgagtctacgaattttagaatatttatcatatatagtaattaaaattatttaaatttaaacatctgtaaatactgaattatatgctcttaatatttatatacttgggttaataatataaagtttttaataaggaatgagacatttgggaaatggtaataattcatactttcaattaaaatccagtcatgagatgggaaaattacttattgattaatattgtctctgctttttaaattaaatatcactaatttataccagatggtatatgttgtttttattcacctaaatagtgtctgagatttgcatgccatatttttatcttaacgtggtaatcctgccattgcaaaatatctccacattctcccgttgctgtgattctgcaaggatttttatacctttgggaaaacaggcatcctagtcctgcttcttagcatatagctacgtgtcatgtgtcacagactttagtgggagatgtaatttatgacaccaaccatgtgaagtcaagggttctaagaccccatgcctcctataaagcatagacagctttatttgtacagcatatttggcatttctcatgtaaaagctcaaatagtatcataaattcaaaaagcctaaagttaaataggacatggttggtgaccttttctaccgtattcagcttctagcatcattgggagctaaatgctgaaaaaatatagagaatgtttttcaagggtttatattcagtaaacattaacaaaaaactaggctgtcatcatttttcatttactaaatgtcttttcaagttaagagtaattttttactcccagaaagcccattggactgtcatgtttgtactttgtttgatttataggatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaagtaagtgctttttgttatctgtaacagctctttggttacaatagcaaccatagatgattctgacttgaggctataagtacttaaagtttaaaacccaccaaatagttactgaaagtgaagtgtaagcaaagaacctgaaatacctaggattctcatgccttaaagttttcaggtctaagtgtgggctacagtgacttcagagggcccattttctttatgggcatcagatgaccttttgtacttaagaacaaggaacagctccttgaaatcacctgctgccagctcctcactcttgctcaagggcactggctattaatgaggaaagcacagattcttaaagaggcagtttttctgcaatgattttcatatgcttgcattttaagaagaaatccacctttcttacaggtctactaaatcagcaaaaatcaatatctgcttttttctttaacttacaggtggagagcaggtgggataatcattcccatttaagttcatgctctatgtgaaatttcatcctagcaggaacttaaaaatttgagttataaatcctaaaaataaataaagtgcagaatcttaaagaaaatcctgctacttactttctttggatgttattcgagcacacttaaatacttaaaaaaaaaaaaattgttaacagaattttctttactctggtgacacctagtgtccaactgggtcttgtaatgaaattctatctcaatgaaacatttttagttaaaaatatatattgatatacaatcataatagtttatatgtgcctgtatatatagtcatgccgaactctatatgtgaaacatcataatttagtttttctttgtctatactttttaaacagcatataaacatatccatatacacatttacaaatatatctatattatgtgtatgtaaatttatttattttgtaaatatctattcaatttttattcaaattaataaattctgaatttagttttattttaaatgtgttcatcgacaaaatttcatcacttctattttggcaataataaaataatgatttaatatcagctaaaattttttaaaagccataattatttaacatgttactcatcaattctttttttttttttttttttttgagacggagactcactctgtgccccaggctggagtgcagtggcgcaatctcgctcactgcaagctccacctcccgggttcacgccattctcctgcctcagcctcctgagaagctaggactacaggcgcccgccaccacgcccagctaattttttgtatttttagtagagacggggttttaccatgttagccaggatggtctcgatctccttacctggtgatccgcccgccttggcatcccaaagtgctgggattacaggtgtgagccaccgtgcctggctcatcaattcatttttaatagatatttgggccatgtgcaaaacaggatactaaccgtggaggaaatatagatgaatgaagtaatagctcgcactctgattttatagtcaccaccaaaatgaagcaacatttagatctaccaagccaattttttgtaagttttattaatttaaaaagtttattaatttaaaaagtttaggaataaacttccaaagtaattcatatatattctttcgattgtcagaaaatcaacacatttcttttttatgtgaatctacctgcattctgtgttttttgcatacattagttttgtttttaaatttcacgattgattgagtttagggtgtttttacctgaatataaaaatatgtattatatttgggctaactttaaagagtaaaataatggtgattagaatttgaatttaactagcaaaccttctagagattaaatatttggggaaaaaaaagccacttgggttttaagtgacaccatgaaatacaagatgaacatctttaattaattctaaataagtttttccaaacctaaattatattatggacagtaaacatctaaattcaataaaataactatcatagccagcaggcaaggaaaaaacagaatatatataaatcataaaataaatttttggccgggcgcggtagctcacgcctgtaatcccagcactttgggaggccgaggtgggtggatcacgaggtcaggagatcgagaccatcctggctaacacggtgaaaccccgtctctactaaaaatacaaaaaattagccgggcatggtggcgggcacctgtagtcccagccacttgggaggctgaggcaggagaatggcgtgaacccaggaggccgagcatgcagtgagcaagatcatgccactgcactccatcctgggcaagagagcaagactctgcctctaaataaataaataaataaataaataaataaataaataatatatgtttatattgaagaaaagatagaatagccatgaaatatgaaaattttgccttagcagtcttcaccttgaagtattatagtaagcttagagtcactggtctatttgaaactctagaattgtttcttgaaagattttataataaaattgtatacacatacatatacatgtgtatatgtgtgtatgtgtgtgtgtgtgtgtgttttccaaggctgataatgccagtgcccaagtattggtatctattctgtagttgtgagagttattggttatttagtttttaacactgcataaatgtactagaacattaagatgccggtccaggtcaatggaagtgttctttcaatttcctttcaccttaaaatctaagcttctgaggatgttggaatgctcaggtcaaaggattagaaatcatcataataataatttgtcctgggaacttactttgatttgaaaaaatatattttggcaatcaaaaataaaaaagctcataaatgcatagacaggactggaatgacttttagtgatatgttaataacttattttgtttggccagcttatcggtattttaatttttttatttttggttacctgaattgcttagattttatgcaataattatatattactcttatcctgcttttttatccttgtagttctcaactctttggagctgcatttttttgtgagtttgattttgagttttttctttttttatttctggaatattctcagacattttttctaatatttcttatgcccattttctctttattccttttctgggattccaattacaatttgatttttctcataattttgttccgttctgactctgctcccctcccccgcccacatagacacacagttttttctttgtattttagtgtgaataatatttactgccctatttttgaattcactgattcatctgtgttagcctattgatgaactcactgaagaaattcttcatctttttatctttttagaaagatatttctagcatttctattagattatttcttatttccaccactctactgaatttctccatcgcttcaggcatgtttgtgctttctgctattttgcaatgtattaatcagagttgaatcagagttcctgtctgacagttccaatatctgggttatctctatctggctctgttacttcatttcttgaaaatggttgttttatattttgtaggctttttgtgtcctacttgattgaatgccagacatggtgtggaagaacagtaagaagtgaggtaaatagagtttatgcctgtaaatggacattacagacatttactctgttaagtaaagctattcaggaattatttggattttgctgttgcaattattacttccactgtgccaaaagcttcaaaaattcttttattggtggaatggtgtcaactcagtcttagaatagaggcctgcgtgctgtagggttttctcagtcttcttactcagtcctcagctctcagtgctctctatatgcttgtgccacagaagaggtttctgcccacactctgatctgtcccacagtgttagactgctcctccttgctgctgggttccactcttataaggaagaggtgggtcatggaataggggttcctctgttctccttgtacagcctgcatgtgtaagccttggtatgggctttctcaagattttttccccctctttcttatggcatcatggcagccatcctctgcttcacatttacagggggtcttgggtgcaagagaattttctgccccttctcaatccatagtagacctctactttgtattggtgcaagatcttacacctgagaggacttcctgctcctcccccaggggtaggggatttttgcttatacctcttttccagaagcagtagacctttgcctgagcaccagggatgggcacacttcctcctcctccctctaatacttacggcccttgtttcatctgagataaaggtctggggaattgcacaagggttgctgcctgtgcaccagccttgctgatttgttcctattcttacaccatgaaggaatattctcttgtgtcctgccttgtcccccaatctatcttacagaaatctacgcaaagaagttttcaaatgaggggagactccccttgtgtttgtgggtgtctataattctaaccttatttattacaattttagctgttttgttttgttttgttttttgtagagacatggtctcactttattgcccaggctgctgtcaaactcctgagctcaagtaatcatcccacctcagcctcccaatgtgttgagattacaggcataagccaccgtgcccagcctatggcagccacttttaaccttttctgccaaaggtgaaacaatgtatggtcacatctcaccatgaaattatcctaattgtcactcaatggaatttggttttttttgctcacattgtgacttcagctcaaggaaatttatgattttagtataacctggcacttttttgtcattttgttgttgctgttaatagccatattctcttgtggctttctgcattctacacaaaacagaacacactactttaaaatatagtttaattaaaatttaaaaataagcaaatacattttagcttgtttatctgtcttatatccagcctatttaaaaacagtatgtccaaatcgtaagagaaagatggagaaggcagaaaaagactttatacactgcctttaaaccacaatgtttaaaaacacacttagaccttaaacggtatctgattaacaggctctgataaagcctctttcaatgttctaagtaaaaaactatacatataaattcaaaatactgaaaatccaaatcaatggaatactaattattagaatctagttaaacagttatgaaactgtgaaaagaaaatagttgatgatctaaccatgatttgcttgattaagcagaaaaatcttatacagtgtaatgaatgtaggtagatatgttaaccactgcccactctgtacgcctaaattgtgtacctacaaaggaaatagacagttgtccctctactgtctagagtacaatctcctgctcaccctttacttatttctacattcatatgtacattgcagtatcaaaatcatcatcatcaaggtaatcagtcacgaaggtgagatgcagggtagattgttgattatgtatttattaattatatgctgaataacacaacattaggccccatatccatcaatggaggcagaaatacatgtttgcatgtgcttgagaaaataataagacatgacattggtttagcaacttatctcatttcaggataacatagcagtaatcaattcatgttggctacatcctgggaagggacctgtatacccttcccttagaattacaaaaggtttgcatatagtaactgagtacactgtagatgaaaatgacgagaaaaaaaaaaaaaacacatttctgtgttgatgctggatttgggcagatctatctcttttttaggataagtaagcagtggaaaaacgggatcagcaataaatactaaaaaacaaaataaatatggaaaatcaggagataataacctgatgacccagagggagaatatataactctggaaattttctcctacagaaaccattggaaaacagtttaacatttttagtagaaaacagaatggtatggattggtgaaatggtgtgtgtgttttacatggcttgagtccttctcctgtttctggtaaaagaattccactttctctcgtgagaattgtccctttcctacacggtggtagtctttaatctaaagtgccttcccctcagtccaactggagtatagcagtcaaccctcttctgtggttttgctttcttcagtttcagttaccaatggtacaatacaataagatattgacagagacagagagaaaccacatttgcataacttttattacactatagttctataattgttctattttgttattagttattgttgttaatatcttactgtgcctaatttataaattaaattttatctcctaaaatcaattgagcacctggattcaacctttcctgaaatgagaaggcatgtgaaaattaaattgacaacatgaagtgtatccattgaaaatttatgcaatattaagaaaaaggaaaaaacatataaataataaaagagatcaaaatatatttataggacgattaaaatacaacctgataatgacagttatttctgaggttaaaattgtagtatttataacagaagcaaaaaatcgaaaaaagaattcaagagtttattatattacaggcaaaaatcaatgaaaaggtagccatgtttctttgaatagtatctgaatatgtttaaaaatcactgaaacagaaataaaaatatcttactcataaaggaacaaaaattaggtaagccctgcatatctcatttgcatgataaaatgacaaaaggcaatggaagcaattttgctgttttgtaagggataatgttatgactcaagaatttttacccagacaagttgttttaaatacacaaagtaaagaaagatagtctagatcaggtgtgggttcaaaagtgatccatccttctagtaaaaaattgtttatgacatcacattgataagtgaaaataagtatctaagtaatagggctcttgcagtgtaaaaagactaacaaatcttactttagagagtttggatatgaaatccaggaatccaatagaattttgatctgtcaactgaactccacattgtaggggtatattcttcccttaaattaatgatcctcttctggatctgattcttccttgttctaataatatagttcctgtgaagcaattcttgatctatgcatcatttagaatctcttcctttatctaataaacaattcaaacaagaagtttcactattctatttctagtaatcataaaaatggctaaatttttattttcttttaacgtgtaacaatgagcttggaaaattgctataaaaagtacatttttaatctataaaagcgtatctgtttaaaaaaagcaaaaaagcattctaattgccacatgtgtgatatgaattagtttatgagttacatatgtgatggaattcatatgtgataccaggcacttctatttttaagcaatgaacagtgtgttaacgggatttaaaatcagcatggtcactctgaatattaaaattaaatgtctcaaaagggcataaaatagactgaaaaaagtacacaagcatggcattgattatattttgataatgaaatttagggccattttaattttttcttttgcatttttttgtgttttctgtatttttcaacataagcactttatatatgcagtatactcaagtatataaaatatttaatatcacccctccaaaaaaatattagacttaaatataccaagatgttagaagtgattatgactgtctgtagatcatgggactatgagtaattgtgtttttcttgaactatttttgttttccaatattctatagtaagacgtttgacctttatggtgttgttgtattaagaacacagttgctgcatcaatatgtagagcttataagggactgttcaaaagttcccaaggaattgtttaaaaaatcacctgctaattatgatattaaatacataacaaattttttcaatctcataagattaggaataattattccttgattctcttccaaaattcaagactcatagttggaattgcattatttagaggaaggaattacattgactaccacttcctgtcattcttacaacactgatatactactcgcatcatttatttagtctttttttcctaggcagaagggtcttttaaatgtcttcaccatttgaccataaaacattcttttggtttgaaacttgagaatgtttacttttaagatggtgttatggcaaacaaatacagagtttgagtctgaaatcttagtttggtgcctcagatttgtttttataactgtatagctttttggcctgcaataaatcagtattgtaatgtttgatctttacagggttatcctgaaggttacaggacccaaggagataaaatgcataaatataaactatggtatataatttaggatattatattttattccatctaaaatgttgttaaattattttgacacagtaatattaagcttaatgatactgataattagattttttaagtctataagcagatcaagagctgtgttttaaaatatttttgatatttctatacagatgtgtaattactcctcttctttattgcttatgctttttatatatgcttttcttattattcatgagacttctgactcagcttgtgtttcaattagagaaaatattgaaagatcttacaaaaagattttatttttaaaatgctctttctctgctagcatcattaattttactatttatctaacaataaagatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtaagtattcaaggatggtaaacctggatagttcctcagaagtcattgcagaaaaccatctctggtaacatggctttgcgttgtaaaatattgatggtgcaactactctgagattgctttatctgtctgtctatctcgtaccaaatgattttcttcaaaaggaaaacagtacaaactcccagtacatttttcactgatggcccaatattcctgtgattctaattcggtctctttcaatagaaatatcaccttagttcctgtggctttgtttatgctcttcttttgtttaagagccaacttgggagagaaggtaacaggtatcctggggtaaaagcaatggaatgtcatatgcggatacccactctgcccagctccaaaggaaggtcaataacttcgcgacattgtcatgataggtttttatccaaactgttaaatttgcctttgtgcaaatgatcacagtgttagcaaaagcattgtaaaatcatagcatgtaagatgtaattttctatgtggtttcttccttcctgggtgctttgccagagtttttagtgtactatttgacagcatgttctggctgtgcaggctcttaatttttctggttcctgcagtcaagtgcatccattgacaatatccatattttaaaattgtatttaacttatctagagtagtcaagtaattatcactaatttaaacatccatatttgaagtaggttagtaatatattctttgacactaggtctggggaagctttgtgatagagagccacacattttaagtatatttctatagacaatgacttgaaaaaattggggagctgattaagaagagaagtagccctgagtgtgccacaaaaagaaaataaatagcagacagtaataataaatcatgtaaattactttatgtaataaacaataagaaataatggtagaactgctattcatcatttaaactacctacagaggaaatactaaaatagttcttatgtattctttactttttttttttttttcctggagacggagtctggctctgtcgcccaggctggagtgcagtggtgtgatctcagctcactgcaacctctgcctccaaggttcaagctgttctcctgtgtcagcctcctgagtagctgggattacaggcatgcgccaccacacctggctaatttttgtatttttagtagagacggggtttcaccatgttggtcaggctggtctcaaactcctaacttcgtgatccgcccacctcagcctcccaaagtgctgggattacaggtgtgagccaccgcgcccagccaatagtccttatgtattcttaaactgtcatctttgttctcaaatacttaaaattttcttgtgaattgaataaggtaaggtaattccaacctgaaaatccaaatgtatgctctgaatgaactttgctatgaatggaaactaaaaagcaaatatgaaaaaaagtatcatgaattcgttacacagaagtaggaccttccaattctagctccgttttcaaagtgaggccaagagtataactagggcttgctgcatgactccattcctttaatatttttcaagcaggtcattacttttcaagtaattccaacctgaaactacagaaatattttctacctcaaaagcaatgtgaagttgcaaatacagcattaaggttgatatactggagcttaatgtgtccttaaccaatcaattgatatgctaaatctaaagctgatgaacaaaattgatactgaacaaattgttttaaattattaagccatcaacccattattaattataatgttaaatccattccgtattaccagttatctttttacacttaactattttccaaaggagctttattatatcctgctagcaagcaaatcagtgagaaaaattcttgtatttggcacagtatgcaatgatcaaaactgaagcgctctggatgttatacaaggtagtctgaaatacaacaaatacttgagatgtttaatatttaaataatttatagacgcattatttaattctcctttagtttgataatcagctcaataccatatgaatttagttactgctttttatagattaacataattaaacaaaatgagtttttctctgctcacatagcaaagtaaaattctaatatttaaagacctaacatttgtaccttgatatttgcttgcaaataaggtaagaatgaatagctatccttttatataatgatatgcctttgaacttttctatgaatggaaactaaaaagcaaatatgtaaaaactgtcataaatttattacccaagagtaggaccttccaattgtagcttcagcttcaaagtgaagccaagagtataatcagggcttgctacctctctccattcctgtaatattcttcaagcagggtaaaccaagaagccaattataaaggtcaggtcatctttaatattccatttttccactagagttgaaattctcacatttacattttaatccagttttcttattctatgtagttcatttctttatttttctgttatggatattttaatggcttgaatgactctaacggtaacgatactattttcaccttttgaattgatatccttagttttcttagtctgtcattaactctgtcattatgaatttaacgtataaattattcatgatttagaataaatcagatgttaaaatgttattaatgcaatagttctaatgtagctttctatttttcttactcttgctttcccaaacaggtttaaagtgtaagtataattaacattttacacatccttttcatgtaataggaaaagagaaacccgagattatatcaatcaagtcagcctgctcagaaccacatcttattcccttgttttgcgtttgtaatagtttatttcttggtttgatatatatagaattgagctgattttagacaattggacgtaacttgcacaaatgtgaaaaagatagtttgcctatagcttccatcctgtaacatcttggttttgaggaagaaattaatcagtgtccaggaaatccaaaaacagcagtgtagctgtaacatgagaatcacaggcattcctaggaattttttttttttttttttttttttttttttttttgagacggactttttgctcttgttggccaggatggagtgcaatggcgtgatctgggctcactgcaacctccgcctcccgggttcaagcgattctcctgcctcagcctccccagtagctgggatcacaggcatgagccaccgtgcccggcctaggcattcctaggaatcttaaaggatatacaagctaaccaaatttcccttgtacatgtgtgtacagcctctgtgaaataacgtcaaaaatgtttcaaatcatttcaaataactttaaaagacaaataataaagaaaaattatctatcttatctttaatatgcctcatcttatgaaagagattcattaaactaccaattaattatccatcccattttaattaaaattttgctttctctaagattatcatttaatttaatttgcaaatatgtctgctgaattctaccccttattcaagagatagctattttcaagaacaaagcagggattatatgcaaatgataccctgtggggatgcttttgtaattacatctgtttataaattgatgtttgtgtaaaataattttagtgggttcccctgataactggaccccattattaaaaggtggcttattgataagcattatgatttctaaaatgagttttacaagccatccttactttatccaagacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgtaagtagaccgttcaggaactctgagaagtagttgggttttactgaattctgtgtggtgagtatttaatttcaatctgatgtggaaatgcctacatggactatttattttattctattattttcaagagaaaatttgttaagacgaaaatctaagaaaggttaagttgaaaaataatagccaaaaccaaaccagaaattaaagaaagctaagagaaaagcagaattcaacttcaggagacaattgcacatttatagcttgagtataatatttaatatctcaatcctcagggtcatgcatttttacatatatataatgtatatgtatatatgtataaatatataaatagattctgaaaaatatatttttgcataggagacgagagaaataaagcacaatcataaaatagtaatcctgattaggtatccaaaccgatccctatttggtaatcaaaaccaaattctctggtttaaaatcgtagtattttctgagatactacttttaggacgttatatgatatagaaattaaaatctcaatgaaattacagaatttctatattaaattcccaactacttagaaaatgcttttttcactttattactctcagactgcggtgattaccgaatatttctcctgcacgatttgaaacttgtagtcactatttaaaaaatcatacatttttgaaagacactggtaactgttaaaagacctcacagttgcttgtataatgatgctaccctcataattggattccttatggtgatgttcagtttgtcagtattttaaaaattcaagaataactgcttttggacatgatatgtaaaacaaccaagaatattttacaattttgaatatgacaattaaatccagaaaaccttttattaactggaatttgatggagtagaaggactataacatgttattacatgtgacatccgtatcagttactagtagcaataagaaaagcctaaaaaatcatgaaattgacctggtaatggaaaagctggttttaaacaaatgtgttcaggttacttaccatattaataatgttatacaaggttttgtttaggatagtcgtattaatgttaaaattgatcttaatgctattattttaacacaaaatctgaatttataataggttaaagcatgacattctatttccaaaataaggacataatacagggttcatgctttagatatatgctttcaccttttttgtaagttgaaaaatgattgtttcttttgtaattaattattggtgaatgtaggaattgagccaatatgatttgattctatttgagtatgttaatgacctctctcaagcaaagatctttagaaactaaaaaaaaggattatgtgtaaagttgtgtgtttatatatgaaattaatgaattatgtattcattttaaattaataagaacaggtatactataacatcatctggaatcagcatagtttgatgacagtaattttcaaatagcaatacctaagattatttttacttgaacaattgtagtagactcagtagattttgcaattgtaatatatgtattcattgaaatagtttaagtaagttctacatatttaattatcttatctttagtaaatgtttaacctatctatctattcaagaactttttacaggaattctaagcattaagttactagaaaatgaattagttttaaatgattattatcaattatcttaaaaagaacaaagtcaaagatcattttggaaaaactacttcacaaagtaataacttcgtatgataacttcctatgaatgctataattactttgtaattaattgtcatcatagtagttgtatatttactttcttccaaacaaaatatatctactttaaaagtcagtgtgcattaaccagttttacagagttaagacatcatagaagcaatttttaaactctcatttaaaatttttattttaggattggcatcatccaggtttaatagaagtgaatttttatctatgtatagtaaacagactttattagatacaattttctgtgaaaagacattcaaataatgtcatttgatttcatctactattaaatgtcattcatatgaataataacaaaatataaaaacatgccttttttttgatatacgtactaagtgtttgtttaaagcaagttcctgctcatattttcagaattgttttaaattaactctagtaaaaacttctttttttctatcacatgttttctgtttctcacctgtggatacataggcataagtaagtaaataatatcactctaatagaagagcgttagaaaaatagatacaatagaacagattaaaatgctgttgtactgtaaatacagtgatcttcatcttttgccacagactcacttactgttaaaaggaaagttttgtcttccacacccaatttccttttgatggcatgagcttaaaacatgtgttcgctgtgatggtacctgtgcctactgaaaggaatttcaaaattctccttgtttttaatttttttaaattagtttttaaaaattcttaaattttaagaacttaaaatttacaaatctataaatagaaacctatttatagatttcttttagtcaaagtgatgtgatattgttatatccattgggtgctttaccaagagaaatcaaaccacgaacaaatgtttgtttacaaaaacaaccagtatataatatcaatcccagttgttcgtgccatatttgaaaaatacttttcaagattcgaagagtaaaagtgtttgtttgcactctgattagtccagattgtctgaattttctttgttgtccaagtaggcttgatgctccaggtctacctgtgtgaattgtttctttctctttcttatagttcgtatctttgccaaaagacacattaacaactgtggctttattattttgttgcctaaactatcaccctaatttttcaatatggctagttaatttctattcagaatatttcttttttatttcattcctgctaagtgggtaaatattaagcagtaactaaaataaatgttattctgttttggcttgagagtaaaagctaatgagaattcggaaccacctatcaatcagccaacaatcctgggagaagggtccaaatgctttccttagagccatttaatttgtgatctttgatgtatgcaactttatttatgactcacaactacctatgattcagtttccgtgcataagtaagcctttcagtgatatcaaaaagtgatttttttttttagcatcaatctttttgttaaggtgagttttaagtaaaatttgatccagatcagtctaagaaattactgacaacatcttttctgattggtactatttataaggttttaaaacaatttttcctgattggtattatgtataaggttttaaaactaattaagcacaaaatttaaacagaagaaaaactcctctgtcacaattctagcatacattcaatttctcaattgtgatttttgggctgtgagacaaactcccatctgtccttggtgattttaattctcttaatttggagaacaggatattccacatgatggctcagagaggagattacttttggctctaggacagaagtactgaatcagatacagctaagaatcttctatgcgtaacaggcagccctgagcatcctcaggcaaggatggtgttctgcaatgggaagaactgtgatttgtgcataagggaactgttacgtgtggacatggatgctttgctgtatcacactagctgaaaaaaaacaaaaacaaaaaatactctcttccaaaataatctagagatgagtactttttttttcatttacatttctcattcttctcacaactctaagatttttctgccctgcctttctaagagcagggaattaaaataatgtcttgctttagtaggttagtgttgtttggcctttgatgtttttaagtatttaatagtaatgagagccataaaaacatctttctcatgaaagctgtgtcacaacttgtttccttacatttcattatcttcttttctttcaagtcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatcttgagtcgttgacttttgtaaggcatttcattgttccaacagatgcttaaaaagtgctgtttaattttgtttgttcatattattaatcatctccctaatttaaattttttcataagattcctttttaaagaaagtatgatcttcagtttaataaatgaaatataaaaagcttaaatagaaaaaccaagagaagtgatatttgctgaactatcaatcactcttttacctaggtttctgctctttgttttaaacaaagaaaataaaactgtatactctgggaagagatttctgtagttgtagtaatagttcttagcgctccaattgttaaattcgaacagcatcacttaagctagatactatctatgtcccttccttcctaaggaaactatactttcaatattagtatataatgtataatatgtgaccatcaagtaattactttgtttttcccatgaaacacatggaataggttttatttactggaagttcacattttgaatgcacatgtaagtgtttaaaacaaatacttataaaacactctggagttttaagattttagaagatataagtttgcatggagaagggtacaattctaaaatacaggcaaaactcatacctgataattactattggaagtatatgaatataagttgagagcccccttcaatgcgttatttcagaggttttcttcatccctcatatttcttcaataatttgacctggcattcctagttaccaagatcagacagaaaacaatctgtaaatctgattatttttattagcccatctgcttcaaaatcttttcatcgaaatcaagagtaattactttcttggggttcttgaacgtgatttttttctttctttcactgaaaaacttcagttggagtttttgttggcagctggtcatatgcatgagaacttgtgctatttggcggactctgacaaggtattcacaattgtgtaagcctttaatgtgagtgtgtcttttctaagctaatatctacaccagctttttgcaaatgtaaaatttataatttcttgataaatctataaatagtaacaaaagaaataagagaagtccaaaaaacatatttgtgtaggtacctacagccctattaaattgttatattgcctttttctataacattttactatttacataatctgaaagttttgttattattctgtactttttaattgaaacatagatacctgtgttttatatttaagccagtctttttctgacacattgtatttggagattcctaatgtcattatgatacattataaaagtcagttaaaatatcttctatatgagaccttttagtattatttgagtacacaagcctaaatattcttcctcctctcaaaccctaactgcttacaacctgacaaccagagaggagaaaagtaacacttttttctcaatatttattatgatctcattaatgcataagaaattattagataccttttaaataaagacttaagaaagatgaccaaacatttgtccttattgttaaaagtaaacagtgatacatatacatgatataaaataaataatacaattgattatgaattgcataaagaggtgcatcgatattatatgaactggctttataagtatcaatagtcatgttttgaaagcacacaggtaaagtagtagttctgttatgtacctctttcaagtaactttctgcctttgagccaagacaagcaatacaaataaccaaataaaaggcaacaaaaatgtgaatggaaacattaacattgagttatagtttatctattgatattttatttttcacattgatggaaaacattgctaataaaaggagtcagaagaaatcgtctaaaaaataaagcctggctttggttggatattttataaggtatatgactcagttgtcattgtttaaacctaaatatgagctttccctacctgaattatttctgaaaaatataaatttggtaaaagttgaaaatgtctacaatttctaaaggctctggaagaattatcagtcttataaatattggcagaaccgtgtaagcactctacgaaattcactgcagaaccattttaaagaatcaattgagaagcttaagtaagcattgtatttacttttttttacaaacagtttcaatatacaatgcataaaccatacaagatgctttctgataagtagaattactttgtgaaggcctcaacattttttaaaaatttttctacagagattcttttgttggattttagaaagttatgcatgtgcctctttgtaatatgtgcctctttgtaataattcttcattacactgattgattaattctacataacatggttgacagcatcagtttaacactttaactgcttaaaaaataacacatagaacattttcattatttattagtaacattcaactttgaaaactctatattcttttctccccctcaagtatagtcaaacgtttcaccatcttgtgatgtgtgaactttataaatctttatgtaatattgaatatttggctattaaagctctaaaaacttcttcacttaatttctaatattataattgaccctgcaaggacagccaatagtttgtattatttttagaattaacataaagaaaatatcatacaatcatttggaagaatatattcaatcatagacataattttcatcctatgtttattacattcttcatgtataaagcatatctcttcccctaaggattagtatatatatcaagacttgtgtataacagagatcatgtataatattttttatccaaattgattgataataatagagtcaaagtttgtcattatacactattgaaataaaatagattttgcatgttttgttgctcatatggaacgaggctctgggttgatcattattttagtaattcaggtgtgaaaccatgatcttcctgttttgataattccacaaaatatacttcccactgagatagtgtttagtagaaattgtcttctcagttttactcagacattttttaaagcccttatctgtcagtcattttgtttaataacgaaaatctaagatgtttaatactgatttatttatttctgccttgcaggagaggttatggatcagaggtaagggctttatggtgttgatgtcgtaacaagcatactaggaaaatacttgtgtaataggcaagactaatgtacattcttttgaactagtttattttctttgatttcagcaaaaacatattagtatgttatgctatttattttcttttatatatgttgcttccctgttttaaggttttaaatctcttattcaatggtcaaagatcacttgcttacctttttaaggatacatgtattttgttctgcattactattactcagtattctgacatttccccaaaatttatttgtctaaggctatacatataatttagaaactaggattactgcctgtagtcccagctacttgggaggctgagacaggagaattgcttgaaccggcaaggcggagattgcagtgagccaagatcaggccactgcactccagcctgggcaaaagtgagactctgtctcaaaaaaaaaaaaaagaaaaaaaaaagaaaaagaaaaaaaaaacaaagaatatatatataggactacttaacttttgatctttttaccagttcaaggcgccatcctatcactaggttaaagcttgagatcctaaagattttaaaaataatcagaatgttagaaagctctgggttttctactgtgttcatttgattctgtctgcagagaacttactgggcattctggccagtagtatttggccagctgtactgcaggtgatgttaccaatgaagtcactgcgaacctagtttgatttagcatacagcttctcaatcaagagaagtatacgacctaattggattgtagtttagaattcattataagtaaaataactaactcaccaacaactgtattataaaaaggatatcccttcagtcaaatggttgttctactagccagtttaaacagtgggttcaatgatggaattacctcccagaacctcactacccacttttccaatacttagtttaatatgctgttttccctccaaagagttactaaccccaaaatttgaattgtgtatcttgtttttatctggttaaagtgtgtattattatgaaacagatcaatggtgactgtattagctttaaataaatacaagtgaaagaaggaagaggcaggaagcaattcctaccaaatctgataattaatgactttcctaatcattctgaaaacacacttaatgttttagtgcaagaaatccacactttggtaagaagaagaaatggagagcatgtcttcaatatgttgatagatacattacaactttatcgttttgtgtgttctgctcttcttcccaatgaatcttatcacatttaatgtgattgggaaggaaaaaaagaagggcaacttaaaacaaggttaaacttgataaaagtaattatatgacacacagtacttttagaaacataaataactctttgtactgtggagcttaacaaaacaaaaatctgtatagattcctgtttattaaggctattaaatttgtcattaactagaagaatgatgaaattaaaacataacaaatgaattcttattttatgttccaatataaagaattagttaaaatatttaatgcttttggtagctaacacatgaataatgaataatcccaaggaaacacgttttaaactgtcgcctttttttcctctcttctcaatcatgatctacctttcccatctgaattattttctaaatctttttctattttaatttcctttgacagcaacagcaactgctgaggccctctcttcttaaaccagaggtatcaattttcattttcttttcaacctcactgagccttcactgtgactttaagatctattgtattaattcttgtaggcagagtgggtgtctgccaatgtggcataattttaaaggaaaagaaaagagtctttcaaaataacttcaaaaaaaagaaaccaagaaatcacctcctgaagttgctggtagctcaacttccaaatttttagcctcattctctgggaatgagacaagcccattattcctaataaatacgggccattcattgaatgaagcaattaatgaacccgatcagcagttacttgtcttaatcaatctgaattcatctatccattcctgacatcagatttagattatgcaaagtttaaagacagaatgctgatatctgtacttaaatatcattttatgtgattcaaaatacttcttttggacacatatattaccaattgcctatggcattttcttctgcaatgtgaaaaagatattttttgtataataaatatatattattgtatttacttattatgtttatatatgtaattaaaaataaaaacacagacatcctacttttaattttacggcaaatttagtatttcataagctccacttacaaaaattttattccttttccttgagtacagaattctgtctttgctaaaaagaggcatttcttggttagaatctactctccaaaatctggaggttgtgtggcaggaatattaaacttttataaggttttagcaaaaatttccatggagagggctccataaaatttgaattggaaaactcagggttgaaatccaaacaccaatgactttatgcaagaccttagtcaagatacacatctgctgaacatcaatttcatcttctataaaatgttagcagtaatatctaataaatgtgtaagttcctagctcaacaactggaatgtaacaggaagaaattcagtaaattacaattattgttgttgtttttgttttgcatcagtataaatgtttataataattaaatattaagttaattctatgttttccctgtgtggacagcaaaaatgaatattaaaaattacattaagtgtttgatctacccaagaaaatcactagtgtgttactttgcatacttttctaaaatctagaattcatcaactaaggggttgttacagtctactgggactgtgtggaacaacaaaaagggccagcattcccttgttggttgaggttgactcatggatctgactggtcagcagttccttactcgatttttttttttttttttttgagacagattcttgttccatcgccaggctggagtgcagtggcataatcttggcttactgcaacctccacctcctgggttcaagcgattctcctgcctcagcctcccgagtagctgggattacaggcgtgtgccaccatgcccagctaatttttgtatttttagtagagacggggtttcaccatattggccaggatggtctctgtctctcgaccttgtgatccgcccacctcggcctcccaaagtgctgggagtacaggcgtgagccaccgcacccgggctctttcctcaaatttttttttaacgactgatggctctgctcttcattcatgggtggtggaagcatccaagagggaccttttagatcatttccttctgctagttcctatccctctttactcaactcagaaatacagagtgactgattgaatcaagggctatcttgctgagtttcctgggttcctatccgcatcccttctatacttcttattacatttttaatgcaattgatgccatatgcattgtagctagcaagagctgagcgttattttcccttaatgaagaaaaagtatttatgtaaagaaaattctttgatgctgacttctaaaatccaaaatccactcagttgcattatttctccataaatatttacttgaaatttttatttcgtgtttcttactattacctaatgttgttaaaagtctacttcaaaactgtttgaagttattttctcagtatctgtatgtatttaattaaacgtgcattggtcaagcagtttgaaaatattagttctgagacctatttgcttcatttaaaccagtgtcattacactgagttttacataccctaaaattcttagcttacctccaggaaacgtttttacaaagtacttagtttgaaataacttaaatctagactttttgtctcagtttcttccaggtctttcttaacctcattccttcccccacacttcaaccttcctataataaatatatttttgttgaaataaaacctacgcccataagaaaagtataaaccatactgtataactagatgaatttttacagagtgcacatgcccctcaagctcttctatgtcaacacctagatatcagttttccttctggcctgtaacatattctttagtcagttcttgaaatttatataaatagaatgatataatatatttcgttggtacctgacctatattgctcaacattctgtttgggagattcatttatgttgttgtgcgatgtggtagcgtgtttatctcatggacttttgcattgtttccaatttgggactgttacgaataatgtgttttctcacaagtgtacatgtttctgttgggtatttaactacaaatttaagttctgtgaaagaagaaatggttatatttaatttagtactattgccaaacatattctaaaaagttttaccaagtaataatctctccagacttagatgagagttttagctcttctgtgtccctgcaaatacatagtattgttcatcgtgggtttgtctaaatattagttattctggtgaataaactatactagttttaacatcaaaattggattcctttagagtaggttcacaaagtatttgtaaacggcaaaattataagatagaagaagtaatgcaagcgtcaatacctacaggatctagggtagtaatgtaagtgaatggagtttattagacacaaagcaatagcagatgacagatttcatagtgactagggtatgaatgtagaaaagtgtcgttggggatactgtcataaacaggagaggacatgcttgctgtaaaaattaatctagccaactagattattggaatgtaaaaatatgatcctagtgtttccatctttttatttttcaagagaaaccaacatccacagtgttggtgtcattttctgattagcactgttagtaatgaattcaattttttaaaatgatgttggccacaccaagcacaactgagggtctttatccatatcaatcatgcaggctgtaaatttccacacttcgcaaatgacatatttgtgccctcagaggagggctttttatttcctgactcattactattcctggatcaacaaaattaaatttttataaataatagatgatagaaatatgtaccaatctattttcatgtgagtacctatccttttcccccctctcttctcgtattccattgcgaaatgaatttggttaacctttgtcatttaacctgcttaacatgttaaagtagaatttaaaagggaaatgtagagaaattgcatttgatagttatcagaaaccgttttcacatgtatatctcaagaaaaacatctttctataagtagagtttgacagaaatcaatcagtatgtttagagtttagaactggaaatattaaaaggacctctattctaacaaattctttttttcctttaaaaaccttaaatttagaggccaggcacagtggctcacgcctgtaatcccagcactttgggaggccgattggggctgatcacgaggtcaggagatcaagaacatcctggctaacatggtgaaaccccgtctctaccaaaaaaaaaaatacaaaaatttagacgggcgtggtggcgggcgcctgtagccccagctactcgggaggctgaggcaggagaatggcatgaaccctggaggcagagcctgtagtgagccaagatcacgccactgcactccagcctgggcgactcagcgagactccgtctcaaaaaaacaaaacagacaaacaaaaaacccttaaatttagaatcagcagtatgttttaaagtataaacatccttgggaagcattacacattaacttaaattcttgttctcagatgactttatcagaacagtttcaatgaatagaagaatactgggtactagaaaactgttagtggggagatgaaaaaaaatgctgtagatagtgttataatttttcttaaggccaacatcacttaataatttaacttaaaattgagttaaatattaactattgattgataattttaaaagacatccaaaaacaagtgaaaatgctcatctgcaagttttaacaggtttgccattagaaaaaaattactttttcctcttcaggtcaaattatataaccttattttgtatcaaatggttacagccagaaaaaaatgaatagatttgactaacacttttaaatagagtaattttaattgctttaactgacacttgtatttaaagttattttggcaggaatgttttgagaatcatggaattctaggtgtagaaatctgactttgacctgaaacgtgataagaattcgttttcaaatgcaatttttctttttgaacaataggaattatccatggagtctggaattgatcctggccaggaatatggacaagattattacagttatgagcatgggtacatcttcagatttttaaaattcagattcttattttaatattttattaataggaaattattaaatgattattattactagaatttgtttttaatgtcatgtcgatctcactagtataatacttgaaaatgaatagtatatctagctttatttttaaccaagttttaaccatttttctatattgagttccatattgatattttacattgatatcgattgcaattctagaaatgcggtaaaattattcaaaattatttatatgggaaatagatgtgaaacatatttgctcaattcctaaattcaccatttctttcatataagatgttaatgttttatctaatcagtttaaagttttgcccaagagcagttaggaaacagaaaacacaccttagaatccactgataagtgtctcaaaagtcacttgtacacatataaattaaccactttcaaaaaaaatactgaagaaattgtgaaaaccattacagaccatgtttgaagcaacttcttgctaccaacatacagatttaatgtggtgaatgagccattacactgttccaaagtatctattttgtgttctggattcttcagctagttaagacacaatatggcttttttctcgttctagtttctccaaaaacgagtatctgaaataactcaactctctttattgttattccagggtaccattatggcaaaaatcactggtcatcaggtagcagttcttactctatagttttgtaactagtttacaaggagcctgataggtgctgtgtaaatatctgtcgattgaatggcggaagaaaaagaaggaaacagatcactcatggtagattctacagaaatcacatgacaaactgtttaaagatgtaagtttatattacaggtatgaaatgcctcaatatgggagtcgccgtcgattgttaccaccagctggacaggaggaatatggtgaggtggttggtgaagctgaggaagaatatgaggaggaagaggtaattactgtaattttattatgtaagataatattccaagaaaaatattgtttaaccctacgtgactagcggctgtagaacatttcagcttttagaaattcctttcacttagtacgtatttcccatagaaatttcacagtgctgaccgtttcattgccttgtctttggaggaaaattaattcttgatcatttaatttatttccttctaaaagtgttaaacatttggaaagggcacaatgaaaattatgttttctaaaattctaaatcttgctccataaagatattataagcaaatatattttaaagttctgcaatacaaaggttacttttgctcccacattatctagcaaaactaaaagtcatgaaaaaatatagtctccacctttcaattatcagagaaaagtaaattatttccacaaataattttcaaggaataatgtaatttatgtttaaattagcatgactcatttctataaaattcttatactttgtcttcactatttacttggcaaatttatacaaaaacaacactaacaagaaataaatgtcactgtggctttaacatgtgcaaaatttcataaaatagatttctcataaaatgagataaatcgtcatattttcgtgattattgaaaattcttgaaaatttagttcaagggaatacagaaagctattaacctaagtctagtgacagaagaaggaaggaaggaagagacaataattctttcttttttatttgatctaagaggaaaattaaacgttgagtaacaagaaggaaattaatatatttgggtattgtaaagtacaagctaaaataaaataatttactttctcttaatcaccttctgtctatatgcagtagaaatttttgtgattattttcttaagccagttatataacatgcatgaagctatcacccacagattcattcctgcgtagctttcgtgggacaaggtcataccatagctatctccaagctgacacttcaattgcattttcacaattttcaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaatcagctaatcaatatttaatatttactggtaggatttttgttaatgcaatgtggcattatgtattatcagtgacactctgtctattggaatggatggcatatatatatatatatatatatacacacacacactatatatgtttttatatcatctttcaaaataaatactaagacaagcttcaacaaattatatctttaacagtcgtctacttttgcatatatgtacgtttcaactggcaaaggtattataaaaactatcatgaacatgttcaaataagtaagtttgtatctgcaacttcaagtattaggaattcaatgaaataacatttttcaattaattaaaagttattacagcttattttctgttattattagctacagtggatttaaaaataaatgtaacaggcataaaattttttctaggtaaataaactataattttgaaatatagttctgaaaatgagaatgcatgcaatgtgttgatagttcacatattccaaaaatgcgatactattttgagaaaaacacagtattgcttaacccttgcttcttgctatttttaatgttgattggtaaaagtcaaatgaatttgtgaaaatgtccagttgcttacaaaaggaaagtttagtataataattagctttcagttttgtgtattactaggtaaatgatgcaggctgagaagatatttccttttaagttagtatatctaaatgggacaacccagaaaaccaggatatgtcaagtaaataaatgcattaaattatacatcaagtaaataagtaaagtcaagtaaataaatgcttaaattatacaaaatgcattaaattatacaaaagttttcgctaactagagaatacattaaaaattagaatgatgtggtttaaaaatattttttaaatattgggaatagaagcgttaatatgaacagaatatactaaagctgttcattcctttcaatttaactttcctgaatagtagagcagctgtcaaatagtggatcagctccttaaataaaagtaatacatttttttccatgtggatcagtaatttgatctaaaagaatacatgtgtttcctgaaatgtctgctttccaactcaacaatacatttttcaaacattaataagaaagatctaaagccaataaaggattgatgaaaggaaatgtatgttaataaagactggcttccttctatctctcttgagtgatttacctttgacagctttctaaatgtcattgttttggatttcacaggcaatgtaatcattgcctttttaatttatttgatagtgactcacatatttttgtttattttatcagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattactaaataatcatttatattttattgattaacatagattatgctttatttctagctccacaaaacatttttagtacatgtaattttattttccatagccaaaagggcaaaaaagaagtaagaggatatttacaggcaatgagtttatacagctgctgtctatactgccctaatttttaaaatgaaagctagaattgcaaagtaaagtaaatgagggaatcacctgtaaataattaattattttaaatcatgagcttgttttctttctttattgtcctgtataaaggttttcacattttaccataaatacatttatatcttgaccctttaggaaaccacttgaagtcgtatgtctttttatcaatattatttacaatattctcttgtcccttcatctcatatcaaatatggtagatactttagtttagtttaatcacttgaggttaaataattgtttggagcaacatggaaatctcacccttagcaaaagcttttagggaagtgagaaaggttcgagtaagcagtaatgcatctagaacgacaatttcataatggaagacatggtgaggttagggaagtctcacattaatgtcactagactttaatagtttgtaaacccagcatatcagagtaaaggaatttggcagggttgaaatgtatataatatataaagcttataaaggctatgaattcataacttcaaatgttgtgtttaacttcttccattttcaggttatttatagaatattttaatgcacatatttatgtgcctaaaatccagaaccaggaaatcattgcctgggcattttttaaaatcaaagaacatggtcttgattttttaccattgaacaaagcacagtgtttcatcataagtagaaatgaaaacagaatatcctttaaaaaacttgccttgtgtgttgcttattttccagatgatgtaaaaagaatgaaacaatatagattaagagaattcagaattctattgaatattacttagtatgatatagatgtagctcacttcaaattttgcacagtattgaccaagttcaggttttaatgaaatttcctcatgcatgcttaatatatggttgaaggactgaataatgcactattatttattcccctcttacatgtttcgcgtcttaaaaattgtttattattatgctatttcctcatttccaaagtgaatgaattgtactgacataaacttgccgacttgtaagagtagtatgtttttacttcagatttccaagaaaatatttgagatcaaatacagtaacatctcatctaccttattttattgagaattaatgcattccatacccttgccaaaaaaacaaaacaaaacaaacaaacaaaaaaaaacctagtggcattagctagattagaaacgtagaatcatgaccacacctcctggcctgccaaacaagcatccacattttcaaaagatcctaaggtggtttatatgcacattaaattttggaagcaatgaagtccggggcttattccttcaggcaccaaagcaatggtttttagtataggatactttgtataggaattagattaagcatatatttccctactaattcaatcagaggtcatcgaatataatttaatattatcttgatacccccagatcatctcagtcagcatcccttgatattctctctatatacagcttcatggctgcgtttttgtcctttgatttctggctgtgacatttaacttattctgttgttgtgcctttctcacatttttttctttcagtttatagcttctagtatcctgatgggaaagtttgtgttttttgtttgttttcttaatgttgaaaaatcatgaagcttaagatgggaattaggtacacggattcaaccaaatgttttgcgactcttagacgctttctttggttaccagtagatttggaaatatgatgttggcagaagtctagtggcctgacatatgagatgtcactgtattttaaactacattttttatgagaaaatatgcaaaattttacaagccacttagcagacacatttcagtaatttaaacttgatcatttcagtaaaaacaatcatgaggtcaatcatctgttacttaatggagatagtataaagagaagcagaatttacacagagcaaccaaaccaaatatttggtcagtatatttttgggtaacgtagagcagcaaaattattactaactaaataaatctggatcaattaaatagttactttcatagaactttcactagtctataaatccctgactcaggattaaaactgtggaacccagaggaaatacccaggtatgtttaatcttaagaatacttcatataaataacgtttcaatgtaaatatttataaagaaattggttgttatttttcctaggaaggtgtaggaaggttttcttgttgttctcaatcagcactagcttcaatcaggcagaagaaacagcaggtcttggctaatcgaggtgagaacagaatgatgtaatgactaatattgcaacccgttgattttagaaggtcttgtgggcattaagggaaagcagaggaagaatgagaaaatatggtcagagtgacataggacatttgtgacttaatgaccatcgaatcacaggtgttaatctccctctctcaatttgtctttctcattaattacagactctgagagttgtcatagaattgcaaccgtaggttggccaaaaccatctttttaaaatacagaagaaagtttgccttgaattttatatgtgatatgtcattcatgttattttaccacattgttcacagggatgttaaagactattatttacttaagtggttgttccaaaggtgattcagtagttaccattaaaatattatttaaaaacatttttatatcatagagccagaagtaattgaatattgactctcgagggaagacattttctgtcttttatttcatgagctttgatttttctctttctctgcttcaccttctgcactttataccttaagtgggatttatataccacttgaatttaattagcaaaataggcaaaaagtgctaataatctattctcagggcagatgcctattggtgcctgcaaattacacagcgataaggctgaaggataggttcaaaataatgttgaggacttacacattttatagatagtttctttctattcccaaatggtatgtgaaatttttgttctattttttttattggttttcaatagttaattttgatctttatcataagaagctttagttatagactggtatttttttcattgcaatctactttaaatttatggtcagttaagcacatgtatggaagattcgaacattgtctatagtttgaaaaatctatcaacaccttcactgctttcccaatttctttatccaaatacctgttcttccttaacaaatattatgttactgtataagaatctgaattagaagttttaagttaaaatgcattgttattcactacacaatgtttcaaaaataaattttcatttgaaaa

SEQ ID NO: 69 - DNA, 408986 bp, Homo sapiens
acagtagtgaatcgtagcatgttagagttagaaggttcagtgttgatggagttattgaagaaatgatggagtaagaggtgagtgatactgctaaatgcaagaagtctatgtctgtaggaaaattggtcaagtttgttattcataagtacgtattctatacaactcaagaaatacacacacacacacacatatatatagtgaagtctgaatataaattaggaactgagcacttcctctccgtgtgtgtgtgtgtatatatatagatatcctgggggattatttaaagagagtagtatttttacatcagctccctaggccaagtaaggtgacccaatggacttcacttttctaaaaagtccagttacacttatgtatcttctcttaatattcaccaaaatatcgacaatatttcgggctgagatgttgataacatctctaggaatccttacctactggtattcacacctgttcatactccccttccaaaatgaatcacagctgaccatgtgatcagtactgtacagcagaaaactacatcataaagacatacactatggcttctgccttgttcttttgtattctttgctttcttatgttgctcattttggggaaaccagatgccatgttttaaaaatactcaaggatcccttggattattttttgaagcagaggttcatacagatattattaacatttcagcccaaaatattgtcggtattttgatgaatagtaagagaagatacataagtataactgcactttttagaaaagtgaagtccattgggtcaccttacttggcctagggagctgatgtagaaatattgctctctctaaataattctccaggatatctatgtgtatataggtatatgtatgtatatgtatatacctatggagagagaagaagagctcagttcctaatttatattcagacttcactatgtgtgtgtgtgtgtgtgtgtgtgtgtgtgtgtgtgtgtatttcttgacttgcatagaagtcttgaatcttagctctgtgtgggaagaactgaggcctcctgctaatagcaacaacttgctagttatgtgagtgatctatcttgggaacagaccctgcaaccaagtcaagccttcagatgactgtagcttcagccaacatctgactgaatttcatgatagccccgacccagagctatccaatcaagctgcttctggattcctgaatcacagaaaccataagatataataaatgcttactcttgtcttaaaccactaaaatttgggggtaataggttacataacattagatcatgaatatacctgtggttcattatttttgcacctctatcatgaaatgtaatatttgttactagttccaacactgatcttgaatcttagccctctttcctatttagtgaattgggctgaaaccctgaagttctcttttcttgtttcccttgagtttcttgtagcagcttgctttctcctctgcttttttgagtactgattcctggctcctctagttcatttagtttagaagatactttccaaattgaagcactaccgaaccaaaaatcagagtgataaagagaatacaaaagccctaaaatctcccaacagcacaagatttcacagtcctccaaactaagaagatagaaagtttcttaaaatctacaatcttttattctcaccatcaaaaataagaatgtaaggtaatgaatatgttaaatagcttgatttagccattccacaatgtgtatatatatcaaaacatcaggtttcacaccataaatatataaatttttacttgccaattaaaaaagaaaaaacccaaagaaatgaaaccctaaaatattcaaataaaaacctttccagctgtatttatctattcctccttaccaaagaatcccttcctcctcccagcccagttagtcctttgaggtataaataggagactgagaaagaggatttaagaaaggaaggttgccgtctcttctacttgagagtaggatattaatctattttattcgttcatgtagttctctattcattcaataagtgttaatcaatcgcttactatgtactgggcactattctaagcatgcttgggataaatcagggaacaaaatgaattcttcatgaggtttacactatacatagggaagacaaacaatgaataataagcatgaatacattgttgatattaaaaattgaaaagtgccatgacagaaagaaaaaaaaatgagcatagtaagggggatttggattgctaatcatgggatgatggtgggccagctgcaagtattaatagggtggttagggtaggaccaattgacgaggtaatattgaaggacatgaagcagtggaaggggaggagacttccagaaggaaggaaaagccagagcaaagaccctacagtgaaaatatacctggtatgtttgactaacagaaagaagaccaagtggaattagtaagggggatagaaatagaaaatgaagtcagaaagatgagggaagactaaattatattaaactttttagaaagttttaagactttggtttttactctggggaaatgtggcaccagttcagattttgaacagaggaaaaatatgatctgacttacattttaaaataattgctacggcgactgtgttgagaatatcgagccaatatgtaggggtaatgagaaactagaagactagtaaggaatcttttgcaataactctttaaaaattttcttcttctggtggctgaataatactccattgtgtacacacacaacacacacacacacacacacatacccctcacattttgtttatccattcatctgtggatagacacgtaggttgattccatatctttttctctggaaaaatatattttcagttcctttgcctatttttaagttgggttatttgtttttttttgttttttgttttgttttgttttgtttttgctattgacttacaacaacatggataaacctggaggactttatactaagtgaaatcaaccaggcacaaaaagaaaaatactgtatgatctcacttatatgtggaatccaaaattattgaactcatagaagcagtgagtagaatggtggttgccaaaggctgggggagtgggagaagtgaggagatactagtcaaacagtacaaacttacagttataagacaagttctggggacataatatacagcatagatagtgatggatattgtattagtttgttttcatgctgctaatgaagacatacccaagattgggtaacttataaaggaaagaggtttaattgactcacagttccacatggctggtgaggcctcaccatcatggcagaaggtgaatgaggaacaaagtcacatcttacatggcagcatgcaagatagcatgtacaggggaactcccctttataaaaccatcagatctcatgagacttactatcatgaaaacagcatggcaaagacccacccccatgattcaattacctcccactgggtccctcccatgacatgtgggaattatgggagttacaattcaagatgagatttgggtggggacacagcccaaactatgtcagatgtgttattaaatttggttgtaataattatttattatacaacgtgtacatataccaaatcatcatgttgtacactttgaatacatacagtctttatttgtcaattaatattttaaaataaaaagttgcttataaaaaataattcagttgagagatgatagtggcatctatcagggtagaagcagtggtgaacatgagaaatggaaggatactgaatatatttttaaggtagaacttatataattttaaaaactaacaggatgtttcatgtgagagaaagaaaggagtgatggattaatgcacagtttttgacctaaacaactaagagaaggtggacttggcatcaactactatttgaagattgtagaaggggcaagtttatggggaaggatcagaagtttagttttggacacatttgggtttgaaatatttatttgatatacaagtgaagatgacaagtaggaagctggatatgtaagtctggagtcttggagagaggcttgggctgatcatatgaatttggaattcatcagaacattggtggtatttaagatcacagactggaagactcactgggaattgagtatagattgagagaaatgatctgagcccagggctgctccattattaagagataagtgagaaggggaggagtcagtaaaggagattgagaaagagcaactggtgactaagaagtgggtgtggggtcttggaaccaaggaagaaagtgtatcaaggaggaaaatgataatcaacagtgtcaaacgctgcccataggtcaggtaagatcagggttgagaaatggccattgtatttattaatatgaaagtcattgaagaccttaattaattaatatgaaagtcaaagacagcccaggtgaagtggtggcaatgatgctttgagtgaagtgggttaagagagaatgaagaggaggaaaattaaagacagcacagttaactgttttgaagggttttgctttaaagggagcaaagaaatgatatggctggggatgggagttgtggagttgaaaaaagatttgcttttttaagatggaagaataatagtgggttttattccttgttgtttgttactatctgtgtattgaggtgggttttaacctctcttttactattttaaattttgggtgctttttatgacagtttcctatggaggtaagatgaattaatgtagaatggtcttatgttgcctagttctaaggatgtttctcttttatcttcttttacgtctttaaatgtattatctttaagaaatattaaatggagtattaagagaggtatagaaatggattttctgacaaaataataaaatatgccatagtaggaaaaagtttccagaagacaagagtttgccagtcatcttgttgctgactgtggcagtccattccctcacttgaaaggatcttaaagaactaaagaaaaattaaaaaaaaaaattgtgcgggaactagcctaatgcttctcaaccaggggcaattttacagtgtctggagatattttgattgtcatgactggagtggcgctggtggcatccagtgggtagagaccagggatgctactaacattctataatgtacctcctcacaacaaaagattacctagtgcaaattgtcaatgttgccaaggctgagaagctatgggctagccctatcatctttcctttcttccagagagaagctaggaagctgcttctgaaaaagggatccggaagcaggagctttccctatcccattgttctgtgtttagatgagacacagcttttaaataaatgattagggttcaaaataaagacatttcttttttgcctttgctttctctttacccccttctgtggattcccatagtataatcgaattttataacttttggtagtttcccattagggcccatgacagaggaacattaaagtcatggtgaaaaattcctcattcagttgagaaaccacaatttcacattgctgatttctattctgcatctgtctgacaacttagtgaaggaaaggatgaagaatagggtgatttgttaagctctgactctacaaatcactatagctttttaatatgaaaggaggggtggcctctcaggcatctttttttgtagcttttttgggccattaggattttggatgagagctgcattgtttatttatttatttttattttttctccaccttctcattcttaataactctaccttcaatatgtgccttatcttttaagaaaggctctgaagaaactcagaacaggtcctaagtgcttgttgaatgaaaattttcttgtagaatcaaaaatttaaaacccaattttaaaagaagcaattttaaattcatagtttttaaaaacttaaaaggcaggtttttaaatgtaaatttgctagttctctggattgtctttcagtgttcaaagtcaaagacaaaaatcaggctttcaaattgacattttaggaagcatcccccttgagaactggaacaagacaaggatgcccactcttcccactcctgttgaacacagtaccggaagtgcaagccagagcaatcaggcaagagaaagaaagaaaaggcatccaaataggaaaagaagaagtcaaactatctctcctaggaatccctaaagactgccaaagacttttggaactgaaaaatgacttcagtaaagtgtcaggatacaaaatcaatgtacaaaaatcagtaccatatctttacaccaataatgttcaagctgagagccaaatgaagaacatagcctaatttacagtacacacacacatacacacacaccccttggtttcacctctaaccaaggaagtaaaaggtctctacaaagaaaactacaaaacgctgctgaaataaatcatagatgacagaaacaaatggaaaaacattccatgatcatggattggaagaataataaaatggtcaaactccccaaagcaatctacagattcaatgctatttctatgaagctaccaatggcatttttcacagaatcagaaaaaactattctaaaattcatatggaagtaataaagtaataaagagcccaaataggcaaagtaatcccaagaaaaaagaacaaagccagaagcatcacattacctggcttcaaactatattgtaaggctacagtaagcaaaacagcatggtactggtacaaaaacagacacatagaccaatggaacagaagaaagaacccagaaataaagctgcattcctatagccagctgaccttcaacaaagtaaaccaaaatcagcaatggggaaaggactctctactcaataaatggtgctgggataactggctatccatatgcagaagaatgaaactggacccctaccttgtttgatatggaaaaattaactcaagatggatcagagaattaaatgtaagacttcaaactataagaatcttagaagaaaacataggaaacaccattctggacattgactttgggaaaaatttatgactaagtcctcaaaagcaatgacaacaaaagcaaaaattgcaagtgagacctaattaaactgagtagcttttgcacaacaaaagaaactatcaacagagtaaacagacaacctacagagtgggagaaaatattcacaaactgtgcatctgacagaggtctaatatctagaatctataaggaacttaaacaattgaacaagtaaaacaccaataaccccattaaaaataggcaaaagaaagacatgaatggacagttctcaaaagaagacatacaattaaaaaaaagaagacatacaagcagcaaaaaaaaaaaaaaaaacatgaaaaaatgctccacatcactaattaccagagaaaggcaaatcaaaaatcacgagataccatctcatataagtcagaataactattattaaaatttaaaaatatttgggtgaggctgcagagaaatgggaatgcttataagcatatatacactgttgggaatgtaaattagttcagtcactgtggaaagcagtttggaggtctctcagagagcttaaaacagaactaccacttgacccagcaatcccactactgggcatatatcctcaaaaaacaaattattctaccagaaagacacatgcacccgcatgttaattgcagcactattcacaatagcaaagacatggaatcaacctaggtgcccatcaacagtgaattggatgaaaaaaaaaaaggtacaaatacactatggaatactatatagccaaaaaaagaacaaaatcatttcctttgcagcaacatggatgcagttagaagccattatcctaaatggattaatgcagtatcagaaaatcagataccacatgttctcgcttataagtgggagctaaacaacaggtactaatagacataaagatggcaacaattgatactgggactgctagagtggagagggaggttgggggaaagggttgacaaatgaactgtggggtactatgctcagtacctaggtgacaggatcaactgtactccaaaccttatcattacacaatataaccaggtaacaatgtgtatatgtaccccctgaatctaaaataaatgttgaaaaactctcaaacccaaattaaatatacataaataaatttacattttattaaaaatgtattactactctagatttgccttacaggaaagtcaaaacttattttaagcttagcctatgattatatacatttgtacgtacaagtttaaaaatatccaaagtcataaaatttaacaaaaaaggtaaaagctacttactgggcatttatgcttcacaaactagtattaacagcacctttcactttgaaatactttttttcgaagtgaaaaacacatttttcttatttatctcagcctcttatcacacttttgtttggttgcacaagaatgtcatcacattctttactcatggcaatgacattgattctgctgatttaacacctttgctttactgaaagagtattggtgactaaaggaggaccattattgctctttaaaaaatgtttaatcataaatagatgtgtccagggatatcttaactgtatgaggtatgataggcttgaaattataaagcacagctttggaatacacccctccacaatccttaaccactcagaaagtcttacgttaatacatattattttttgaactttatgaaaactgcattgaataattatcacacttcctacacaccaacttgtatttaatgatttatggaaacattactaagacaaaagaaggacatagccttcacttgactaattctaagaccaaggctccctatgttttaacttctgtaaactctcactgcctgaataaataccttaggtataatgaagcgtaggcaaataatagattataaataagttgaccgaggtcaagagaggcatttaacctatttaacctatttgggaaaacaacccattttcaaatttttaacagcagtaaatggtagaaaagtatactaattagaaataatcatttactaaagcaaatctttgaggaagtctaatgagtagtttctttagccaattgcttgtattaaaggactggaataacttttgaatattcagaattttcacaagttcagacttccttcagttggccctatttaatgagtttttatgctgcatcttgtatttctgaaaattgagtttttgtttgttttgaggctgagaattttgagaactgtcattgtcagaccaatgtctcaggaatcattaggaaaacaactcggggtgggaaggtggttagatgatgtcgttgagtgatctttatggaagggaaatttgtgagagattttctaaataaagatgcaagattttcattgctttagatatgctaaatttttttcctggaatcagtcagaccttgagatagctctttacccagcttgtgttattttggtccctgcagaagtgcttttgctgatttgtgcttacctgttataatattggctggcattgagaaacttgacattgtattaagttcaaggatgttatttctctctcttttttattatactttaagttgtggggtacatgtgcagaatgtgcaggtttgttgcataggtgtacacatgccatagtggtttactgcacccatcaacccgtcatttacattaggtatttctcctaatgctgtccctcctctagccccccagccccccagcccccgacaagccccagtgtttgatgttcccctccctgtgtccatgtgttctcattgatcaactcccacttatgagtgagaacatgcggtgtttgtttttttgttcttgtgttagtttgctgagaatgatggtttccagtgtcatccatgtccctgcaaatgacatgaactcaagggatgttatttcttgtgctgatcactgtttttagaatctgtattatgaggatctcatggataaatttctctgaaatgtcgctagccaaaatgaacaatgtcactcatggaactcattgtgttttccactatgggtagacaggaagtctcagaactaatgttgagctcacttcttgctcaaggttatgtcatcataagtcatgcacttgattcattttgtttctcatattcttactctttcttctcactgtctctctttatacacagtcatgcattgcttaagtatggggctacattctaataaatgtgtcattaggtaattttgtcatgcaaacattgtagaatgtacttatagaaacctagatggtgtagccatatctagttatacacatagataggctatatggtatagcctattgctccactcctaggctatatatctgcacagaacaccactgtattaaatactctagacaatcataacacaatggtaaatatttgtatatcttaacataaaaatggtacagtaaaaatacaatatcataatcttatgggaccactattctgtatgtggtctgtcattgactaaaatgtcattatgtggcacatgactgtactttgttttgctgaattgtatttatttttataaactacttaaaatattttttgaaacaagattaataaataaataaataaatatttggatgagacaattcacagaggttaaacaacctgctcaaaattataaaactaatgatttacagagttaatatttaaaactagatgtaaccccaaacaatttcagacatagagtatgacattgaaaaagttttggaaaacaagtggtcctactgttctaactcaactttttttcctttatttttgtagtttaccatctagtcttggttcatatataattttcatggttgtacttttatataatgacatctttatctgtctgcttgcacaagctaagagtccttgactccatattccctctcacatcctctttccaggctctgctcaaactgataaagtcagtcactactcttgatcctaagtatctacttttctctatctctgctgccacagatctgagtcagtgttatcatttctaatatggattagaccacctctgcactaaggggtctccttgctttcgacctagctttcctccaatttattttttactctactgcaattaagaaactcctgcacttatgacactcctgaaagacaaatctggtcatttcacatccctaaaatccaataatggcttttcattggctacacaagacaaaatcaaaattctgtagcaaaccatccaagtctagaatctgacctatgattacccttccaggttcatttcccaccacttcccacattcaccctaattcttaatgatccgaccacactaaatactgggggccatacacattcttttatgcttctctgccttcatgatgttattgttttggatggtttgtatgtgtgtgtgtgcacatgtataattctgaaaatttctatttttttccaagattaagcacaaatgtcaacttctctgtaaaatttcccatcttctctgactaccaccttcaaattaagcacttctttctcattgctcccataacatctttcatatacctctgttagtgctcttatatcaatttaaatgtagactctacacatccatctcctttctcaatcttcatgtgggtcttcagccctacttctgcactgaagcaaaaggaaccaaaaacctgaccgcaaatcagtcagtggcttaacatcccaggttagagtgtcgctctggtccacttctgtctccaattgttctgttgatgcgctatcagttagttttaggccagccagcctgtacattgatgcttgaaaaaacagtgctctatttccaagctagttgtctagaaactgtcatctctttcttagcgttgctcccaatctttttgtcccttcctagatacccattactaggctgtgagcaatgcgagcattttgattgtgcgcaatttatcctttaatccaaaatgtcaagtgtaattttggacatatcacagatactaaatgaacatttattgaatgaatcaaacatttctctatatttttatatattttcataattttattttaaatggtttggtaatattcaattgcattaatttagcataactggcataattaactgagttttctgtggaaatgtaatagtctaaacaacattatatatatatttgtttatgaatagtcttttttaatttttattttaagcttggggtacatgtgcaggtttgttacataggtgaacttgtgtcatgggggtttgttgtacaggttatttcatcacccaggtgttaagcctagtacccactagttacttttcctgatcctctccctcctcccaccttccactcttcaataggccccagtatgtgttgtttccctctatgtgtccatgtgctctcatcatttagctcccacttgtaagtgagaacactcagtatttggttttctgtccctgtgttagtttgctaaggatgatggcctccagctccattcatgtccctgcaaaggacatgatctttttcattttcatagctgcatagtattccatggtgtatatgtaccacattttctttattcagtttatcattgatgggaatttaggttgattccatgtctttgctattgtgaatagtgctgcagtgaacatacgtgtacatgtgtctttataatagaacaatttatattcctttgggtttatacccagtaatgggattgctgggtcaaatgttatttctctttttagctctttgaggcattgccacaatgtcttccacaatggttgaactaatttacactcctaccaatggtgtgtaaatgttcctttttctccacaacttgccagcatctgtttttttttggcttcttaataatagccattctgactggtgtgagattgtagtttttatttgcatttctctaatgatcagtgatactgagctttttctcatatgattgttgggtgcatgtatgtcttcttttgaaaagtgtctgttcataccatttgcctacttttttatgggtttttttttcttgtacatttgtttaagttccttatagatgctggatattagacctttgttggatgcatagttgcaaaaattttctcccattctctaggttttctttttactctgttggtagtttcttttgctgtgcagaagctctttagtttaatcagatcccatttgtcaatttttttcttttgttgcaattgcttttaacaacttcatcatgaaatctttgcccgtgtctatattctgaatggtaatgccctcattgtctttctggactttatacttttaggttttatatttaagtctttaatccatcttgagttaatttttgtatgtggtgtaagaaagaggtccagtttcaatcttctgcatatggctagccagttatcccagcaccatttagggaatactttctccattgcttgtttttgtcaggtttgctgaagatcagacagttgtaggtgtggagtcttatttctaggttctctattctgttccattggtctatgtgtctgtttttgtaacagtaccatggtgttttagttactgcagccctatagtatagtttgaagttgggtagcatgatgcctccagctttactctttttgtgtatgattgccttggctattcaggctcttttttggttctatatgaattttgaaatttttttctatttcagtgaagaatatcaatgttagtttaataggattagcattgaatttataagttgctttgggcagcatggccattttaacaatattgattctttctgtccatgggcatgggatatttttccatttttttgcattatctgtgatttctttgagcagtgttttgtagttctacttgtagagctctttcaccccccgttaggtttattccttggtattttgttctttttgtggcttttttttttttttttgagacaaagtctggctctattgcccaggctggagtgcagtggcatgatcttggctcagtgcaacctccacctcccaggctcaagccatcctcccacttcagcctcccaagtagctgggactacaggcaagcgccaccatgtccagctaatttttgtatgtttttcatagagataggggtttgccatgttgcccaggctggtcttgaatgcctttgtttctttctcttgcctgatttccctggccaggacttctaatactatgttaaataggagtggtgagagagggcatccttgtcctgtgctggttttcaaagagaatgcttccagcttttgtccattcagtataatgctgactgtgggtttgttgtatatggctcttattgttttgaggtagggtccttcactacctagtttattgagagtttttaacatgagtggatgttgaattttatcaaaagccctttctgcatctattgagataatcatgtggtttttgtttttagttctgtttatgtgatgaatcactattgatttgcatatgttgaagcaatcttgcatcccagggataaaacctacttgatcatggtggataagctttttgatgtgcgttggatctggtttgaccgtattttgctgaggatttttgcatggatgttcatgaaggatattggcctgaagttttctttttctggtttatttctgcagggttttggtatcaggatgatgttggcctcataaaatgagttagagaggagtcactctccctccctcaattttgtggaatagtttcagtgggaatggtaccagctcttctttgtacatctggtagaattcagctgtgaatctgtctggtgcaacttcaacttttttttggttggtaggctatttattactgcctcaatttcagagctcattattggtctgttcagggattcaattttctctcgtgaacattacattgtgtgtgtgtgtgtgtgtgtgtgtgcatgtgtctactatgttgaactatcactttagtttgaagaaactcagtatcatctgagcctaaaggttaagtgtgggcccatgaaagaaaaagaaaaagtgaatttgctattaatatattcagggacttgtaccaattggttattagaagatttgatattagctgtaaatcttaatagtgttctttttgaatgatgttagaaattctcagaaagctagtcaataggtcagatatgtaatattagcttgagttctaagggaaaaggtacaaatgaatgtgatgctaaattatctctttttaacaggaacttttaaggcttatatttcaaatatcattcatttttctttctgtcctattcttcctttaatgctggtaagtttatacatgaatataaaattaagccataaacttcttgaaaatagagactagtaaatctttctattggtgcctagcacttagaaagtgtttaataattatttgttaaatgaacatatgaatgagttttaagatgcagtttttttaaaaattatgcaagtgaatggaagagtcctggtgccagccagtgagctgaaatttacagacatagttcagagtggatattgcttctttctgtagtagtaagaattttcagatcatgcctgaataatcaatatcatgaatctatttctggataatcaattaactattatggttttcatttctttcaggtttcaaatagggaactatctaactcatcaaaagtttttttttaattgtagtgaaaaagttggttccatgatccacagggaataaataatttatgggtcagggcctttgagatgtttttgaaatattgaaatctggtatgctttgggcaggaaaatttctgatttaaaaatatagacaatggaatgggttgtgtgtgtgaataaagtgtgaaaagctgcccttaggcaaagtcttttccagagaatacatcactgtcaacctggagttagtctttagttaatacttaataggtgacttttccacatttggaatctttaaaacttgttactctagaattatttctgaagcactagaagaggtatattttcttccctttctacctccctacctccctttctttcttcttttgatataattattttcttattttgggttagtcttggttaacaaaaagtaatttattgaaaatggtcacactaaaaacttcagagttgtaataccaaatataattttaagggttttaaaatgaatttataatttgttttcagccttatatgttttactgaaatcaggggcaaaatatacactgaaatattgactttatctaccctcactaattgtttatgaaaaaataaatattgactttattttcaggttgttactggttaacattgttagtttaataatctttcttttttactaaaatgataaaaaaaaaaggtaccatcttccctctgcctttttctgttacatcattagttttcttccaaggtataaaaacttcataaatgttagctaattaattttcaaaaggcagagaaaatttgaaaatattaattttcttatttataaagataagaaagcatagcatttctgttgcttattatcaatttacatatcacttgacgatttcattataattttgaatgccattttacagttgacatactgatagtttaaaaaatgctgacctatgaataaaataatattaagaccaaaattcagcttttctaatttttttagtcttactatttttctactgtataagcagtcagataatataatacaaaatggggtaattcaatcttttaacatttcatttggagacactaatgacatttggatccggcttagaatactgtcgtgctatatttaaacatgttcttttttttcccttcagaacttcattttgggatttttcaaaagctgatatatctccatttatgatgtcagtttttcttaccttgtttaatattggttgtaaaattcatgtgacttgggctcagtataatttttaaatgacgcaactggagatagtctcaatgtaaagatcttaagtgttttatttatttttaattcctgtgggtacacagtaggtgtatatatttatggggtatgtgagatgtcttattataggcatgcaatgtgaaataagcacatcatgaagaatagggtattcatcttctcaagcatttatccactgagttgcaaacaatcctattacattttgtcttattttaaaatgtatagtcaccctgttgtgctatcaaatagtatgtcttattaattctattttttgtacctattaactatccccacttccctctattttttgtacccattaactatcccctcttccctccatcccctgactacccttctcagcctttggtaactcctactctctatctccatgagttcaattgttttgatttttagatcccatgaataagtgagaacatgtgacactcgtctttctgtgcctgcttatttcgcttaacataataatcccgagttccatctgcattgttgcaaatgacaggatctcatccttttttatggctgaatagtactccattgtgtatatgtcccacattttctttatctattcatgtgttgatggatacttaggttgcttccaaatcttagctattgtaaacaatgctgcaacaaacataagagtgcatatatctctttgatatactgatttcctttcttttgggtatatatctagcagtgggattgctggatcatatagtagctcaacttttagttttttgaggaacctccaaactgttcttctttgtggttgtactaatttacattcccaccaaaagtgtacaagggttcccttttctccacatccatgccaacatttgttattgcctgtcttttggatgtaagtcattttaactggggtgagatgatatctcattttagttttgatttgtatttctctgataagcaatggttttgagtaacttttcatatgcctgtttgccatttttgtgtcttttgagaaatgtcaattcaaatcttttgaccatgttttgattggattaatagacattttcctttagtgttgagttccttgtgtattctggttattaatcccttgtcagaggggtagcttgcaaatattttctcccattctgtgggatgtctctttactttgttgattgtatcctttgctgtgcagaaacttttaaacttaatatgatcccatttgttcatgtttactttggttgcttgtgcttgtgggatattgctcaagaaatttttgcctagaccaatgtcctggagagttttcctaatgttttcttatagtagtttcatagtttgaggtcttagatttctttaatccattttgatttgatttgtgtgtatggtgagagacaggggtctaatttcattcttctgtatatagatatccatttttcccagcaccatttgttgaggagaatctctttcccccagtatatattctttgcacctttgttgaaaatgagttcactgtgggtgtgtagatttctttctgggttctctattctgttccgttactctatgtgtctgcttttatgccagtatcatgctgttttacttactgtagctctgtaatataatttgaaatcaggtaatgtgattcctctagttttgttatttttgcttgggatagctttggctattctgggccttctgtggtttcatataaattttaggattgttttttctatttatgtgaagaatgtcattgttactttgatagggattgcattgaatctgtagattgctttgcatagtatggacattttaacaatattcatatttttcaattttttggtgtcctctttaatttccttcatcagtattttatagttttaattttagagatcttacatttctttggttaaatcctaagtatttaattttatgtgtggctattataatgggattactttttaaatttttttttgcattgttcactgttagcatatagaaatgttactgattttttatgttaattttgtatcctgcaactttactgaatttatcagctctaatagttttctaatagagtctttaggtttatccaaatataagatcatatcatctgcaaacaaggataatttgacttcttcctttccaatttggatgccctttatatttttctcttgtctgattgttctagctaggacttccagtactatgttgaataacagtgttgacagtgggcatccttgtcatgtcccatatcttagaggaaaggcttttggtttttccctattcagtagacactagctgtggatctgtcatatgtggcttttattctgttgagttgtgttccttctatcaccagtttttggaggttttttttttatcatgaaaggatgttgactgttataaaatgctttttcagcatcaattgaaattatcatatgatttttatccttcattctgttgatatgatgtatcatgttgcttgatttgcatatgttgaaccattcttgcatcccaggggtaaatcccacttggtcattataaacgatctttctagtgtattgttgagtttggtttgctagtattttgctgagtattttgcatcaatattcaccagagatattggcctgtagttttctatttttgacttttctttgttatcaccataataccaaaaccaaaaaaagacataacaaaaaagaaaactacagaacaatatccctgatgaacatagatgcaaaaattattaacaaaatactaggtaatcaaatccaacagcatatcaaaaagatactccaccgtgatcaagtgggtttaaccactctatgttttttgattggagagtttagtctatttacatttaatgttattgttaagtaagaacttacgcgtgccatttgttatttgttttcctattgttttatggtgttttcttccttcttgtcttccttttagtgaaggtgatttctctcactttctcccaccttagggggcacccgaaggccagtaatgctgtggttcttgcagactcatagaggtacaacattgttagtcttggataagattcaggagaattctctggattaccaggcagagactcttgtttatttcccctactttctcccaaacatacagtctctctctgttctgagccacctaaagctcctgtggccaccaccagtatgactgctctgagtgagtcctgatgccagcccagtgcagggtctcgccaaagtcctgctgtaactactccctggctactgcctatcttcactcaaggccctggggctctaaaaccagcaggtggcaaagcctgtctccttcccttcagggtagcggggtcccctaagctccaggtgggttcagaagtgctatctgggagtcaggcactagaatcaaaaaccttaggaatctatctgattttctatttattgttgttgacctggcactcaaactgcaagatgtagtccttcccactctttctttcccttttccaaaggcagaggaacctcaccccatagccaccaccacccctggccatgaggactactgccagactatcagccatgttcccttaaggcccacggactcttaagtcagcttgtgtgaatgctgtttagcctgagactagactcccctcagggcactgggctcctctctgccccagggcaggttcagaaatgctgtccaagagtcaagtcctggaattggggaccccaagagctcactggtgctgtatgcctctgtggcagtgttggtacttgaagccagcaagtctcagaggcttaccaaggcccttgatgtagtacctgggtattgctactggttatttaggtagctagcaggtgatgaatgctggcaagactggattttttccattaaggcagcagattaccttctggcccagggtatgtctagaattgtcatctgtcagctagggcctagaacagagcttcatgatgctgacctatcctgctgtggctaagctggtatccaagatgcaagacaaaatcctcctgagtcttctctcttctgtcctcaagcagaaggaaggggtctctttttgagcccagagctgagcagtcaggggttaggggaagggtgatgccagcactcccttggttaccccagctggtgtctcagtacgtcgtgtgcccccctaatccactgtctctgggcctatttcatccctaggacttgcctacaggttgtggagttgcactccttatggcctagactgcctttcacatttacttagagacgaagaccactttggcgctaggtggtgaggtttccaggcactcaagttcagactgctgagatggacaattcccctctggctagggctagtttaaatgctctctctgcagggggcatcagctgagtttgatctgggttttcctttctgctctcacagaacatcactgagttcaatgcctcccaattgctgtgttctctctccccgagcacacagagatgctctcactaccacacagctgctgccagaggtgggggcagggtggcattggtgattcaggaccgttttttctatctctttagtgccactttctgtgatatgaaggtaaaaccagatactatgtatgctcgcctgactttggttcttggttcttataagggtattttccctgtgtagatagttgttaattggatattcttgctggcaggacgatgggtagagctttccattataccatcttgctctctctctccataaatattcaaaagtctaaagttctaagacagtttatcaaacaaatttctgattgcaagctacactatgtcgttgagtagtcattagagttagaactacagagagtattaaaaatgggagagacttaaaaatggtttagcttaactcccttagcagataaggaaacttaggatcagggaagttaaacttactttcccacagtcacatagccagcactctggcaagcctagatgaaaattcagatctggcttttagtccaatgctgctttttaccacatgttatggaattagctctgttttaatgaatgacatggcagattaggtggcagaggtctttcttttattgtctagaattagagtattgtttgagagagagagagagagaaagagagagggtgcgcgtgaatgcagttcctccaaacttaacgttgacttctaacttcttttgtggaagaaaggggttttcactttgcttactcatgccttaagcctcaacctgaaactctggcatttctctttgtcaatattaacttgttcccataactccctgaggtttcacttgttataatatttatcaaactctatcataattgcatgtttacttttcttctctactagactgtaaatttcatgccttgttcacagttataccttcaatggtgactagcacagtgcctttcacttagtgtttccaattatttgtggaagaaataaatgtaaaaaatattatctgctttttaaaaaaaccagtatgaagtaagtataggaaccagatatctttatttcaggaagaacaatcccatatctcaattcagttttctatcatgccgggtacaatgttccccaaatgatttttcttaatatgttttaaaaaattttaaaaaacatctatctctggggatggggagaaaaaaccccacattttcccagaacctaaccattttctttttttttccgaactttcggatcgggcagatatgtgttccaatctcagctctgtgattttgggcacatgacttaacctttcaacttcactctccttatctgaaaaaaatggagactatattacctaccttacagactatggtgaggattaaatgacataacaaatagcaaagttatatatagtgggtattcaataaatgctcattccatttccccttctttactccatccctttctttctccctgtcaccttcctccccacctcccttcctcccccctccttccctccttcactccttccttccctccctccctccttccttccttcatcccttctttctttccttctcctaactccacttttttggatacgagagtgctgcaacatagtcaaagttttctttgtcttacagcaacagggctttatcgagtaaactactttcagcctcagcttacctccaggacagcctctgtttctctacactcctttttctttgtcctgtgtatacccacaaatgaccagatttgccttctggtttctcacattggcttgcctgaaatccaattattctgccatatgcctgatggtcaacacgtttttcacagcaaggaaacagagagagagagagtgagagcaggggaacctgcgagtgccagacgcagtaaaacctccaagaggttgtgttgattgcagaaggctgttccaggagcagggtctttggaatgcaatttagggcccaactgaaaaggaaaaagggaaggtcacaactggttgtttgtcctgctcttgactgtgaaagttgccatttcattatctttcaatcaggctttattgcaaaatgttttaaaccaatattagacttaatatatactttgaaagaggcctaatgtgaaaaagagctaagccacataactgaattaaagaaaatcaaaaaaatttattaccaaaacaacaactggaggaaaggtatctcttgacacaggtgatcttgtctaggctcagaaatggaggtaacatgagaaagcagtgattaagtagctactgacgaggttcacattaaatgatgaatgaactggccaggagttaagaagaaagtgtttaagagtgtttggctcagggtaagaatacattttactgctaatcaaccactaacttgagcccttgtgaccttgagcctcaggttgcaaaatgttatctgtaaaacaaattgttatacatgtgtaagttgctgctattgatatgcttttatttaaggccaaattttgtttaggagggtgatgggagaagggttaggacccttgcttaattagctcagctgcattcctctaatgctgaatttcccaacctagacacctttgacattttaggccgaacattttgttgtcggtggctgtcctgggcattgtaggatgtttagcagcatccttgactttcattcactagatgtttttaggaccctcttcagttgtgacatacaaaaatgtctctgacatagccaaatgtcttctagggggcaccagcctgccccagctctgcattttgagaaccactgctttgataaaagagctgagagataactctatctacgtctagagtttcccatggagttatcataagacttaaaaaaaaaatcacaaaacttactctattccaaattgagtggagtaatttactctatttcatgcattcactaagcattttattgactgtctgcaggcaccgtgctaggcccttggggtacatagataataactatgatctgatttctgccttcaaggactttgctttctattaaagatagcaagtaatgccctattagtccatttcaattcaaggctgttaagtgcaatcatatatcttaagtcaatatatggtatagtggacctgcaaaggtgtagtcttcccattcatcctagaagacaggtgtcagttaaggccttgttgagaaaggagtaatcatatgagactacatttcaagtcaccaaacaaaaaaaaaaatcaaactccagacatctaaaatatagcattttgaaattgtattttctgcctgtcattttaaattttatatatatatatataatttcttaaatattgtattagggttcgccagagaaacagaatcagtaggacacacacaggcagatacacacaaacacacacacacacacatatatacatacagaaagagatttataaggcattggctcttctgttttggagactgagaaatcccctatctactgtctgcaaattggagacccagaagagaggctggtggtatagttacagtctaaatgcagaagactgacatcccagctcaaaaacaagcagagaaagcagattctcccttacttctcctttttgttctattcaggcctctaaaggattggatgatgcccacccatattaggcaggacaatctgcttaactttggctacagatttgaatgttaatctcatccagaaacaccctcatagatacatccagaataatgtttaaccaagtgtctgggcactctgtggaccagtcaagttgacctgtaaaatgagccatcacaaatatgattaaagtttttgttaggtagtggttctcaaagtgtcatccctggagcagcatcacttgggaacttgttggaaaggcaattcttgaacttcctctcagagctactgagtcagaagaagctctgagggtggggtctgtcaatttgtattttatgagtcccccattagaatcatgctgaagtttgagaaccaatgctttaataattcacttattaattcttaaatgtattatataatttactgaataaatatgtataaaatggtgttaaaaaagaagggtataatctatatatttatatgtattaaacatgtgctaatacatgaaatgccttcagacattgtctcatttaatcctcacaacagccctcagagggagcatagtggttctcagctgtgggccagtttccaaatactcatgaagtttaaatgcaattgtccaggtcttgcctcagacctactgaatcagaaactgtttggtttttaatatgtactgtgattgagaatcactgaagtgggtattctttttgtatattttacatacatgaatattgaggcttcgagaggatgcataatttgactatggtttttgatatagtataaaactgaaaaagtattccatttatttattcagcaaatacttactggcattggatgattaatgagtctgtctgactttaaagactatgctcctaattattcagataaattcagtttatgtgatctaccagaaaaaagtgtgtttttaaagagagagaaaactaatatttacaaagtgatttgcagtccctttacaaaacataacaacctttcaaattttcttaaatcattgctgttttacaaattagaaaaccaaggctgagtgagatgaagtgatttgtccaaaattatacaaccaggaagtcccagggttgagtgtggaaccaggctttctgactttctggctatggagtttagcttttttgaaccactacttaatcacatatttatgtataaaattagaataagaaagataagttatgtgttatttgcaggattaattatcttcctgatcattaaatttacttagaaattgtaaaaaccccactgggcatggtggctcacacctgtaatcccagcactttgggaggctgaggtaggtggattgcttgagcccaggaatccaagaccagcctggacaacgtggtgaaaccccttctctactgaaaacacaaaaattagccaggcattgtggcacatgctacttgggaggctgaggcatgagaatcgcttgaactggaatgctgaggcatgagaatcgcttgaacttgcagtgaactgagatctcaccactgcactccagcctgggtgacagagcgaaactcagtctcaaaaatactaaacaaacaaaaatcccaaaaaaacccccacaaaacccccaaaagcaaacacagtatttatggcttgattttatgttcctaaatcctaaagaaagtgtcagtgaatccgtcttccaaatatgaggactctagcttttctaattagctagtagaaatactgacagtgtcctaattcattgttaattcagaatacatttaccacttttactgtgtaagggtttttatattctaatgtgatacggtacctagactagtttgccagtgcagtgactgaaacagattaatttattcacaccaggaagaatgcagttaggatagtgctgcactgctcttactttcatgaaccttttaattacctttgccttacaccatttccacatagactagactacagaagctcaaaaggacagtttcactgtaaagggacagagccatttggagtgaggcccttaagccctttactttggatctctcctccccagttagttgggtggcaattcagaaagataaattttcatttaagacactttattaaaaagccactttgaatctataagaacatgtggaatgggagatgtcctcttgtcttagaatttgagacctcaaagcttgggacattgagtgacaatctcctccatacttcagagattggtgctgacccagccccataggaattactgaaaattggccggaccaccaactggtctgtgatctgcctttggcctattcagactttttttagagggaagggaggcagatgcttccctcaccaccaaatcacatgttgggaagccccaagagtactgcatatagaggttatggtcatctacaaaatggtagagtgtcatctctgtccctggctggatgtttgccaaattgcaaaaattagtggggtttccctttgcatctagctgagcagaaagtgagttttttcttgagagaaactgacatgtgactctccataatttgaagcaaagtgtgataataataggtctctgcttcttttctggaaaagacaaaggatagaaaacaaagtagagctgcccttgactgtggggcaacaaggaaggagtcagcagtttgtcaagctgcacgttcattgtacttcctgtgagtcaagaggaccctaagagggctgtctactggggcaaagctgagggatgcaggtgattctgagcggtcagataaagagctcattgtctattgtaggaaacatgtagggcataggaacttgttgagagtctcccaagaatctgcaaatgtacttaatgagatccaatatttggaaggctgctatgacagagggcatctgatagtcaaatgagagttataaattagctccttttttgatccctgccatctcccaggattcagaaatggaaagggcaaggttgagggtgggatagggagagaagaaaggagtataaaaaaccagaacagagtcctcccctatgtcttctcacagcttctcttcccctcacactgagtcattcctgagctgacaggaggggacgttccaaatcaagtattagattaatgctttgagttagacaagactgaactttttaatactggatgacaaaattgttatcatgaaaagaaatctgaaagagacactgtcaaggctagaggaggggagacctgacagaatgtctgaatgcagtgatgggagaaaaatgaagctgtttcctgattgctactgagtccagctcatgcaataattaataatgaagggcccagattccttagcagataaattgtagagaaaaggaaatgatgggagaggattctgttttctgaattataaacttagaaaatcactgtagtgaaaggcttcatttaaataagaggctaaattagaaagtttccttgataccttcagactttaaaaatctatacttttttgtgggggtaggggaggagtgttaccctcagatttatttgtgcaaatagcacaggaggacaccagccctatgcagacggcagtgcagggcgggtcacaccagtccttctgtcctcatattggcagatggagatctctactttgaaccctttgtagtggcctgggcgcctttgggagcctgagctggaattgaagctggagctgcaggctgggccttggtttgatccttggtcttggcctttggcccacacagcctgagccctttggcaatgtgggcatgatcatgcttcccaagcttggagtgggcaatgtgggcaagtcgatggagcttgtggctgacaccctttgggatcttgggcttaacttccttgggctttaccagggccttgatagcctttgcacgtgcactcatggccttggcattgttggcctgcatcttctttaggcccttcttgttgtgcttcttggcaaagcgcatgttcctcaggaacttggggtccaccccttaagagattcgtatctttgtgattggggtttcttgaggcaatttctgtgccatattcgggaccagttgtgtgtggtgtggttcttggacttggccatgtctgcactgtaacccgtggctcctgaagcgcctggaagtgaaagctcagtatccttttgtatataactggatatcttggtctgtttgcattactgtaaaagaacacccgaggctgggtaatttttaaagaaagaggtttacctggctcacagcaggctgtacaagaagcatggcatcagcctctgtttttggcgaggactcagactgcctccagtcacagtggaaagcaaagaggagctgctgtgttcagaaatcacatggtgaaataggaagcaagagagaggggagaggcaggtgctaggctcttttaaaaacagttctcaagggaattaagagtgaggattcactgatttctgtgatgacagcaccaagtcattcatgaaggatctacagccatgacccagacacttcccattaggccccacctccaacactgaggatttgtgggaagaaatatcaaacagtactacctgggatcaagtgttattttggaatactgtacccctttcccacatcatcttattccatatacattatttttatgaattatcatagaagagttttcattatatttctaaaattacattcttcattgctgacaatgcagctttaaccaacaattgttggtcctaatagtgacattaactatttggcatttttatatattttacctagtggaccataatggcttaagccttttgagtataagccagttcatttagttacctccaccatttctttcaaccaagactcacaaggaacaattttaacaggctccatgttcaatttttagacaatgagctttggtttttggaaacagcttgatcatatagtataatataaattctaggtccacctccagttttttaagattttgtctactaatgtgaatggtctttgatactcttggtaatgaaaggattaaatcattgatgtcattatatgttgaatttggctattttcatcagccttcagggtctggcttgtctgccttttaaatggacaaaatggagtaacataatttgtttttaaaaattttattgccttaagatatttctgactttctgacttgtgtttatagctaggctttatggatagtaggtatctgagaaagaaagtatctttcttctccacaggcactaattccatcttgtaggttttgattttttaaaaaaatattccctgtgcattatgctaaacatatgggccctctttcctttcctttctttgtttttctttttctttgtttttttttttgagacagagtcttgctctgttgctcaggctggagtgcagtggcttgatctcagctcactgcgacctctgcctcccaggttctactgattctcctgcctcagccttctgagtagctgggactacaggtgtggccaccatgtccagctaatttttgtatttttagcagagacagggttgtgccatgttggccaggctggtctcgaactcctggtctcaagtgatccaccctcctcagcccctaaagtgctgggattacaggtgtgagccactgcgctgggccctaactcattattctgttttgttcctatgaattcttcagaagaaccaactttggagtgttatggccctttctgctaacaaacttgtttgtatgtggtacttagtttatcttcctaccatgaacaagcagctatggaccttgtggttgagacaacataagacagcacaaatatttgcacctgactctcaaaccacacattttagagctagtcatatgggacacccaccccgtggtaattcatttttcagaatgctgcatgttttactgcttggctaagttcgtaaatcctacaacttaaagttttgcttttttatttttattttttgtttatttgtaactaatattatatctgggaattagatttctatcttttgatgctaaaaatataatatttttattctatgctgtaggtagtctttttttattttttattttgagaagtgcttaaatgaaagactctctgctgttaatattttatcaatagattttatgcagtgtgagtccttccacagagacatgctcactggatagttaacaatttccaactagtaaaaatatgcatggaaaatactatgcttgctccttacatgctgaattattaaaaacatccaaaaatttgatctgagatcttaaatgctgaccatttgtgttatcttcctgaattacttttttaaaaaatctcctggttggcaggttcagataggctgactagtttgtgtgtgtgtgtgtgtagatagttgaattttgtcttctccaaatcctctctctttgttaaaggaaaatctatagaatcatttcagatttgttcttctatatattctgtcttctctaaaccttatctattgagaaaccttttttcattatcaattcaaaaacattcctagatcttaatatatttcatatgactcctgcaagaggtgtaattagtaggaaaggggtcttttaaatgcattgggttcaagcaaaaaggctatccatttagaattcatactgaaaaggaatatattagtgtagggaagtgaatgagagtcctcttgaaatattttgcttagggacctataacttattctaagctcctgacttacattttgtttatttatttacttatttatttatggagacagtcttgctctgtcacacaggttggagtgcagtcgtgtgatcacagctcactgcagccttgaattcctcagttcaagcgatcctcctgcatcagtctcccaagtagctgggactatagatgtttgcctccatgcccagataactgacttaaatttatgtgttctggtcaagttcagctgattagtcaaaggcatttcctttaattctgcaatgccttcagtagtcatccaaatggcacattttcccagattataactaactccttttcctgtttaattaatggtcatagttcagagttcatttcctgactgaaacctctactttcagcaatttaaactgtggattttaattattaggttaataatgagcatttagaactcaaagataccagcttttaatccatattactattattgatttgaatatttataatatatgttccattttagtacatatggtagattatgtatgctaatattttcatattttaaatgctgaatttagcaatacagatgattttgtaagtgacaaataaaaattgtatgtattttcagtgtacagcatattttatatatatatccattgaaaaatgattaaatcaagcctgataacatatctgtcacctcacatattgtttgtggtgaaagtatttaagatctactatatcagcaattttctagtatcaatacattattattaactatgttttactatgttgtacaataaagctctggaacttgtttatcctgtctaactgaaactttgcaccctttgaccaacatctccccatccctgcacctgcccccacagcccctgtcaaccaccattctatgctctgtttctgcaaatttgactgttttagattccacatataaatgaggtcacaatatttgtttttctatgctgggcttacttcacttagcacactgcacttcagttttattaggatttccttctttttataagactgaatagtattctattttatgtctatctatctatctatcaatcatctgtctatctctatcaatcatctatttgtctatctttggaatttaagaaggtaaagagaatgacaagagaaaaatattggtgtgttagatgtttttttgtgctatttcagttattaatcacagagcttgagtgaaattattttaactatttatttaaactcaattagcttgaaacttttaaggaatcataaaaaatgaatacagaaccatatataaattatatatcactaatttttataattcttcttactcaaaatttacttgggaaaaatatagaaactgtatttatggattgtttaaggagtataaaatatttatttaaaagctattaaaaactagtttttagcagatcatctttagagaatgtctttggagcttgatagtcatgagtttttaatgttagattaatttcatattaaagacaaaagtgaaacattaagaaacaaactgttttgaagctaatgtaatttataatcacagtatatattgggaagacttaaaaactaggagaaattacataaatgaatatcctgagtaaacaacaactaacatttattgtacacttagtatgtgtcacacatttttaggtgttttgtacttattaacttattgaactcagtaatgtcccagaataggtacacaataggatatggggatatacaatgaggaatcaaacagagaagtagctctgctctcagagaatttatattttagggggagaagacacaaaataattaaaattaataaataaaacatatagtgtgttatatggtggtgagttttatgaggggaaataaaggcataaacggaagaaggggagtatgatgtatgaatgtggtggtctttcattttaagaaggtatttagggaagggctcaccgagactgtgacatttgagcaaagatctgaaatcgctggtaaagacatctggatgtctggaagaagaaaggcccagaaagagggaataagtgcgaaggctctgaggcgggagcatgcttcgcatgtttgtttcagaagcagagatgctcatggccaggaggagagcaaccagagatgaggtcagaaagttaataaagggcctgattttgtagacttgggcttttattctgagaaatatgcaaagttaatgaatggtttgagaaaagacattttaacaggattcctctaactactatgttgagaatagactgtgggggcaagagttagaagaggaggtcaagtaggatgctgttgaaatagcccaagcaaggattatggtacttggatcagggtaggggtggagtgtggagagaagttttgaattctggatatattttgaagatagagccaacaggatatggtgtctgaaagagaagagtcaatgagatgcagggctttgctctgaatcatgggaaaagcattgggaagacagtggaagaaacaggttcaggaaaggaagatcaagaattcagttttggacattttggatttgagatgcccattagacatccaagaagaggtaaatcttcactacacctctgtgaggtaattcccagtattgtcctgattgtgcaaacaaagtaacagtttagaaaggttaacttctctttattcatcagcaagtaacagaggcagcattcaagcctgggcagtctgacatcacagcccctgcttctaagcaccatgagatctgcgtctaaggatttcagaaatgagtatagttgtgttgaatcatatagacttataatatggaaaactctaccacccatcagatctaggacttgcgatagcttagattaaaatggctctttttaaaggaacatttaggccaggtgcggtggctcaacgcctgtaatcccagcagtttgggaggccacagtggacggatcacgaggtcaggagatcgagaccatcctggctaacacggtgaaaccccgtctctactaaaaaaaaatacaaaaaaattagccgggcgtggtggcgggcgcctgtagtcccagctactcggaggctgaggcaggagaatggtgcgaacccgggaggtggagcttgcagtgagtggagatcgcgccattgcactccagcctgggcaaaagagcaagacttcctctcaaaaagcaaagaaaaaaaaaaaggaacatttataaaaccttaagtattttggtttctctctgtctctatctctatctccatctccaacttcatctccatcttcatttctccatctatctctatctatctctcatctctatttcttttataaaaatatttttattttactgtaatagacatcccattcatctctatttctctctctctctcccactccccgcccccacctttactctagagagctgtttttcacatctgtctagctagggtggcagttttctgtactacatagctcttaatagcttgtgacaaccgttctcattttggctactacatttctggtgctgtttgtatttatgcctcttagtcacaagctctccaacattttagctttcaaaaagttcttgccattcctggttactttctgaatgttggttgacccaacattctactttcctaggagtccatagttaatgacattgttcaggcttcgtgtatcctacatttccattttgtccaatgtgcttatggttaactcaccacacagcagctgtttaggtattcttttgtcaattaatctagccacacaaggtcagctcagattttttgggttgcattgtgcactatataactcagcaaaacaagttattacaatagaaatatataccctctgtattaagtaggatagtgtaagtgtggactactctaaataacttgtccaaacaattgtggagttaaaaaaacacagtttttaaagaattatgcatgatctgcgctaaatttcctaccagctcctaggaaatattttatatcttggtatgacagccttagaaatatgtatttgtaagtgaatggctgacataccattaactattcagcaatacattcaccaaatcaatacaaatgtagtgcatagtcaataatatgattcatttgtcacttggtggttggtcccatcagaataagtacattataaaatgctaaattttttcctttctacattgtaccctgtattaccccatgattaaactaaagtgttaaagtctgaaatcattttagttcatacttacaaataatgacacatgtgggggaagcatctggtgaaacaatataatcagttgagggaatttaatattaggctgcatcgaaagtatgtgtgacagagttaagaaacttgattatctattaaaaatgtggagcatctagaaattaagtcattttagggaaagaaaatgatttttgggttttctgcttgactcaactttagtaagcattttgatatcctatatgtttcctctagaaaataggagtgatagtacccctcttcactggaccttgatttccagagtcatcctaaggcttctctcattcttcattgtccttgtttattttcccagtagaatgtgtactgctgttattcccttacagaccaagctgacctggccagcccttttgtgttttactcctgttagttcttaagcatgttgcatacaaaagtccataaatggatactcagtcttctcccttatgtaccttttattgttgaaataattttctcatattacttagattcccacaatatggtcttaatacttctaatgactggaccaaagagaggacagaatcacatataggagagatgtatatggtaaagtagaaataatacctgggtgatactgtagagggcagggcttggtctatagggtgctggtaggagtggagctccaaatgaggtgggtcgctgagagctgcttgctccacagttttgcctaagagccagacctgcttctgcttttatatcattaggcagtttgctttatcagcactgctggcttatagttaagtatcagagatatttattattgtcaatattttatcaagatgtatctgtttaaaactgcatgaattttaggtgtcacagaagataacatcccaaatttagtgacagttaatgatttgctattaggtcattcttgcttaagtcaggtgcaccaaagccaaatagcatggtttagatcatttactaaataatatcaatgtggactctctgtccacattgctttcttaaaactatattactgcaatgcagtctacttgtagcagcttttgaaaatgcaactcagaaaatgagtgaaggcttatttcttaataggataagccacagggggaacattatatttttgtcctctagttccacaatttgcttccaggtgcaattcaaggtgttgactttgatgcattttgctttcttcactttttaaaaaaatatttttccaaatgctacctcatgaaggttattcagctgagactacaagaagttgagactttcgctgacagtcttcagatttgccatatttgctgatgcattgagtgcatcagtgcatggggtgcataattatctttgccataaatatattcgggtagaagatgcaagtgctatttctgaacctcagtgtggccaaaacattgtacatgtttcttaaaacaacaaaaactcccataggaggaggaaaaatatcttttttttttctggctttcttatttgagttgtataccatattaaataaattattattgtgacaatttacctgatacttactggagtagcttctacttgtttcatacaataaatcggcatagtttgtggcaatagagcttatatggggttgggttacgctccctgtgtataatcattgtcacttttagtagtcaggacgatacccagcaacggttaaacatattcattttgtattacttgtgagggagacactctaaggaatattttcatttatctgtgcattgataaacatgcaattttatttaaataacaaatttatgtggttaaaaatatcaaacaatacagaagaatttagaataaaaaactgcaatccttagccacacccttccctacccccagaggtggccaacgtttaactgtttttgttttgattcttctggcagttatatctatacttctttctttttttttgagatggagtctccctctgtcacacagtctggagttcagtggtgcaatgtctgctcactgcaacctctgcctcccgggttcaagcgattctcctgccccagcctcctgagtagctgggattgttatatctatatttctaattaatatgtatcattatttcttgctttagtacctttatatactatttcctttttttttttttttttttttttttttgagatggagccttgctctgtcgctcagctcaggctggagcgcggtggtgcaatctaagctcactgcaacctccgcctcccgggtttaagcaattcccctgcctcagcctccctagtagttggaactacaggtgcatgccactatgcccagctaatttttgtattattagtagagacggggttttgccaagttagccaggctggtctcaaactcctgatctcaggcgatctgcctgccttagcctcccaaagtgctggtattacatgggtgagccactgcgcctggccatattttcttcttgatatgcttaagcctgaatttatttatattactctttacttccccattcctctttttccacatatgatcatatcaatagtctgttttcctacagattaactttggtacttcaaaaatataatcaaatctgtatttcttatttcattgacaatggacagtacctctgaactctccactttgtaagacaaacacattataactcccagtctttcttccacttctttttaccttggtacttctcagtgttctaagccaataaacaatattccctctaaaatgacaagataaatataatatgtctgcagagctaggcacagtgcgttagtaatatatttccttctctattggtctatggaagttatacttctttctcaataggttttatataggacttctctgccactcaggggagaatattctagcttcaaatcccaatgaattatctgcttgaacacttcactaatagagtttatcatatccttacccttttcatagttctgaatccattcagttccttttttcctctgaagacctgcctcctggaatgctatatccactgggtctagtctgccctggttactctctagggtcattccaaagctgtcattgtgagacttactttcactgttccatggacatcaccctgttacttggatcttatgttttctttatggcttacatccttaagttaacttcctaaggaagggtacacaggagataaaatgaatgagatcttgcaaaccacaaagatctttattctactttcacacttaattgatcaagtcatttggctggacatatatttcttggttgaagatcatttttttcagaactttgaaagcataaattcactgtcttctagcacttagttttgctgataagaaatctgatatcagactaattctaattcatttgttgattactttgctttttttaatctctggaagtttttaagatcttttctttatctttgttttcaactgaacaactttatttacttatttactattttctcttatacagatgctccttaacttagtggagttatgtcctaataaacccactttaagttgaaaatgtcgtaagtcaaaaaggcatttaatacacctaagtcaaaaaggcatttaatacacctaacctaccaaacatcatagtttggcttagcctatcttaaaggtgctcagaacacttacattagcctacagttgggcaacaccatataatacaaagcttattttataaaaaagtattgaatatctcatgtttttttttgaatactgtgctaaaagtgaaaaccagaatggttatatgggtacttgagggatgatttctactgaatgtatatcactttcacagcatggcaaagtaaaaaaattaagttgacctattgaaagtcaggggatgtctgtatttattttttgctaatcatctcccctctatgtactttctcaatatttattagtcaatattgatcattctggatatatcctctgtgtttctttagtctatattttctgtttctttgtccttactgttctatgtcttgggagacttccctggttttgtcttgtaagacttctcttaaattatatgttttaatctaagatcattttcttattcacctatgttttttcataatatatttttcctgtttgcagagtcaacatttttgggaatgtctctgagaatattattttgagggtttcaaaagcactcttaaatcctctggattattagcgcttgtggtggagccatttttctactagtttatatctttctctttcatattgctggctttagtcaaacatttagtgatttgggtgggctgtccatctggaagaatgaaactgactgggggctctgggtacgggagatgtttcttgaccggcatcctctgccttttgcttcatgactagggcactgatcattaagcctgagaatccctaattactaggatgaggagggctttaattagcacattaacgtactgtcttatttttttctagtatgatcagagaagatagcccacatttttttcgttcagtgttaagtgcctggttttaggcagtcttacttccaggggtgggaaagggctagtatgtgtgctttctattccataaaccaggggtcagcaaatttttttctgtgaaagccagatagtaaaaatttaggcattgcaaactacatatagtttctggcacaaattctcattttataaacaatgctttaaaaccacaaaaactgcaaaaataggtgttgggatatagtataccagtctctgcaaaacagacttgcatcagtccctccctcttcagcctcatgtttcactgtcaacttctgagtctcaatcctatctagatggggattccataaaatagattgaaccctcctctttcacctaccaccattcctgaggtttagcctttctctttgtgtattttgatttcttctgtgtatttctgtgtttcgttcacttctcagtcataaatcttccatcagtattttgtctttcaaattcacatccacttgtgggccccttccttctttctgttattgtttgtagtagattctgttagttacttacatcctgtcattgctccccgtttttcagcacccatcccatttttcaatgccagcacctgtagctcttagcctgaaggtcctgtctggatgtagagcttgctctacctgtccatgagcagtctggtggagccagagaatgtcccctcccatcagccttcaacaaatgactagtaggaattggtgaacaaacacctcagcttctttttccttctgttgggataactttgagttgcatgttctactctggcttccgagttgcttagctgaattaagcaccaggtgccaaatgatctgttgatagtgagccctttattgaatctcctgcatttcatatctcacttttcctctcctgtattagtgtttcctggcattacctctcatataaattgcttgtggtatagaatccttatctcaaggtctgcttctgagcaactcaaatggagataccatgggttaaatttgttctttattacaatttcaatgaaatattagatggaagagcagacaactaagtacttctttcattatattgaatctgaatcctattaactgatattattttgagcatttaccgttagccaggtattattcatggagagtagaataatgagttatacgtgaattctacctgcaaggaacttgtgttctactgaacagataattcattcaatagaatgttttaagtgttgttaagaaaagttgagggcagccttcgtggctcacacctataatcccagcactttgtgaggcctatgagggcagataacttgagcccatgagttcgagaccagcctgggcaacgaggtgaaatcttgtctctacaaaaaatacaaaaattagctggacatgttggcatgcacctgtagtcccaagctacttgggaagctgaggtgggaggatcacctgagcctgggaggtagaagctgcagtgagccatgattatgctgctgcactccagcctgggcaacaaacagagaccctgtctcaaaaaaaaaaaaaaaaaaaaggtagagatgaatgtgtcattgggcttaaagtcatgaaaggttatttgaagatgggtggttagggatgaattcaggaggaggtgacatttgagttgggtaaaagggaagtcaatttgaagataaagtgatggggctggacgttcctagggaagaaacagaataagcacagtcccttttcaggtggcatgtgaagaggaatggttcactcaggagaagccttacctgcctaagtgagggaaggcaacattatgtgaagcaagtgtaagtacatacaaaaacccagacatgtacacaggattaattaaaattgtaaggagatgctcatataaatattgatggagattggtgataaatgattcatataatcaggaatttggatttgatgtggaagcaaatgggagccattagattcctctgtgaagggaaattgaaagcatctttatgagaaaacgttgtgctttaggatgttctattcttgtgaggaatagaatgatgtaggtaaggaagacgctattgcagggatgtggtaatttttcagtctgcatcattgtggtggatcgtaggattaagaatcagagggccactttgagaaatatggaagaagaatctgaattgccaaaggcagaaaaaacagatagaggtatggaaaatagaaaagcaaggaaaaattcaaaggacaagttcattctctgagaaatctctcaaagtggggaggataatagagggaataagaaagaaaaaaaggcctgtttcctgtatctgggccagtcagaattgaggttagctaggtagcttattggccggagctctgcttcatcttctatttatcctctcactatttctaaccatctatgtccttccaaagagttggtgaagaattgtataaatctgttggaggttatgtgttgggtttatcctgatttttttttggtaccagtttcctaatggatttttaatgggaaacatttaaaaaatagaaagtaatcattctttattgataataaatccttgagtgtaactgaaagacttttagtgcccacaaattatacgttacagtttctatttaaactaatttactgctatagtcacaacagttgttttgctgatttccatgtgaagacttcttgcatggaaaaaaagtacaaaacaaaatctactgctttcctacattgccaatttcttaggcaccaatacataagttagcattattagtggggaaagtcactaataatgtatttaactatatgccgagaagtctgtgctcattattgcagccatggggtagcaatagctacacattaagaagttacgagctactatttcagagaaattgctcttccaataataagtagtctgtgttctatttttctccttccttgaatatcagtgtggaaaaaagttaattcagaaaacaacaatctcaggaattgaaaagcttaaataatctcgtaactggcctttgttccccttcctagccttattaaatcgtatttagaatgattctagcatattacttgctttttcagaccctaaatcttaagcatttgctttatttcatacatccgtgaaaggccaactctcactgtctcctctgttagtgactggtagaagtggtatcacacacttctagttatctacatttttgcctattagtaatttaccctgaggtccatttcctttcttttgttatccaacaatattgaaccaggccatcctatatgaattttgctttttatggctttggaattagcaattactctgaagctttcatatactctaatctcatctttcttctttctcactgttcttttaacaatgatgtcattgctcataatctatagtaatataatttgcatattactgtttggctactgtcagacagttctgcttagcaaattatgcaaaaggttctaatgccaggacaggacgtctatcttctgggtgaattctgaggttgtcatctatgtgggggagctgtacataggaaagtagctctcttttctgtttcagatttagttttggaaaaagtgcaaaaagttatccctgaggaaaccagggatacccaaacacctgcagaagcagtatggctctgtctgaaataatccacttctaagatcacatgatcattaggctatggaggctgaaagagatcatataggttgagcacccacccttgcctctagtcaacgttgctatccactactggattaggaaaatacgaagcagagatggagtaacataatgtaacagataaaagtgggggatccatagtcagacaatgaaatccagattttccacttacagttctgatcttggacaggttgattaacctctttttgccttagttgtcttaacagtaaaacagatactgataatacgtatgctacagaattgttaagattaagtgaggggcttcaaatgttttcaatattaaataaacataaggtgttatttttattacttttagagcatgtaaagaccatttatttacgtttgtgctgaaatctttcattggctgtagccagataaatgcattgtcagttcaactttttgagtgaaatctttttcttttctgctgtgctctgcattgtataaaaccaacttagtaacataatttacacatcattcaaatgcatatacatgtttgagagtgatttttaaagaatctagctgcattttcacaatggttttaacacaaagttgttagagataataaaaatatttaccttttagcagcatgatttatttcatactggtactgaagctttgggcctgtgtggtatttttgaaggaatgcttaaaattgctgtaacaaaaataacacatattctgctttaactgcagctggaactggccttttatttcacagactcattcttattcttttgaaagatagatatttttattagtattgataatttcattctatcaaaatgatttctaaatctcatagaattttagttgttataaactggcttgaggtggtgccacacgtgtatttttatcataaatagctagtactagaataatttgtcttctttttaattttatatgagttgtgctttaatcattgggcactgagtctcaataacctctggtgctgtggcattccatttcctcctggttctcacagcctccaacattgatttcagaactgccttattactgcataatgttcctggttcattgttataaacagatagcctgaagtgaaatgtatgctatttaaagacagcagtgttttcctttttcttttttaacatttgaataatacatcagtgtgaaaaataacaccttcaatattaataagttttggatgccaactaggattttaaaaatttgtatttcagatgctacttcattacctataaaggtctatccataccaggtaaaaaagcattttgtatttatttggtagcttttcagtgtcagacactttgcataaattgtactatttaattctcataatggctcctggaggcaggaattattaccctcattttagagagaagggaattgaggatcagaggtaaaatgatttgcaaaatgagtaagtgaaaaactaggacttgaacctggctctgataccaaagactgctcacctgttctacattactgcctggagtgaaggagaaagaaatatgtgtggcaaaaatggaaatggctatggccatttagaagaatagttctgccaaggacccctttacagaattatcccacttctacaaaagactctgatatagatacattttagttataaattttgttaccatacgtgaggatacagcattggccataattaactgctgctgttataactttgtgcattagtggcagttttgtgaggctagctgaatttttcgttttaccaagagcttgattgttctctctagacttctctttgtctcctgctgagatcttgttaaacattttgaggatgaactaatcagtgttttgcatccttccaataaggcgaatgcttttgttttcagcataatttaatgtgagaatattccgatgaaaatagattgaagactccttcaccagttatggtcgggaaaagtaggctggcatagtgatggttttggggcaggcaacctcattaatgtttaacctggggaagagacttcagataaatgtttgtaatggtcaacaacttatagattatttctaatcatttattttctgattctcaacattaatggttctaggtcatttgcagatattaaaattctaccatggcacatgtttatctgtgtaacaaacctgcacatcctgcacatgtaccccaggacttaaaaataaaaataaaaataggccgggcgcagtggctcacgcctgtaatcccagcattttgggaggccgaggtgggtggatcatgaggtcaggagatcgagaccatcctggctaacacggggaaaccccatctctgctaaaaatacaaaaaattagctgggcctggtggtggcggtcacctgtagtcccagctacttgggaggcttagacaggagaatggcgtgagcccaggaggctgagcttgcagtgagccgatatggtgccactgcactccagcctgggcgacagagtgagactccatctcgaaaaataaataaataaataaataaataaataaaaattaaaaaaaaagtaaataaataaatcagggttgcagaagccatggagttaaagatcatgggtcctaacttctcaggtaaagagccagattattcattctatttggtgattatgtaaaattaattacaaagcttttctctgagtagaaaaataaaaacgattgcaaaaaaaatccttttgggggacttatgagaggaaggtgattcattctcaaaatcatgatacccaaattgataagcttttgatagtgatgttaatgcttgaaaatcaaatttgctctttctttaccccagtggatcacttcgacataaattaagaatgcttaatttgaaattaattctcccaatgaagaaacaattctaattttcctgtaaactgcttctttgggtttagcacagtagattacagtagtttttgttttcacaggtcagtctagcccatttgatattgatcagcatattgcaacttgtgacaaggagccagtgtgtatttgtacagtgttctgatgtatttggtgaaaatgtgttttgatgtcattgatggcaagaattgtcaccatctaaatatgtagagaggggtaatacaccagttttcttttttcttttttcctacatgctagaggctacagattttaaatttcaacagtataattcagtttttaccctatattctctattgctaatatgaatcttttccaatataactttttgaagacagttcttacgatttgctttaagacagagctggaaatcataagctttttgtgtgattttcagacacctgtttgaaaactgatggagtcaaatgcctcaatatataatgcaatagaacaactatgttatttgcacttattatgtggtttaggataatgcggtcttataaatataacaatttcatttacatttgataccaagaccacggtcttggcttgtcttttataggagacttgtaagttcctctagaacagtatagaaaaccatgttctaaattatttgtttagctatctgtataatttattttaaggtattcatttagtcattctgaatttttttactattatttaaaaataatatgtaaaaataatttttctaaatggcattaaatataatatctcaactgggatgatacagtagaaaatttcagccaagattttggcatgcagagtatgtagagcagacaaagtacatgttttacagaatggtttctgaataagaccctttcttgtttaggtgtgacacatttactcatttgaaaaaaaaatatctacccttatcttttcatcatcttctgatacttttcttcagtgttaatatgctagtaaggaaatgggtcctgagctgttaatctctgtaactgcttaatttagttttacatttcccactaaaacaaaactattcttgagattttctgtgaaactcaatttacatcccaaattcttttattttcctaccaaaggagggattcttttatatccatacttttataaagagttcttgtataaaactacattatgatgatattaagatatatgtaatctatatttaaaatccacagaatgtaatgattgcgtatcaaagagaaaaggtaagaaacatttcagtagctgaaagaaacacaaactaacctcaagcagaccaaaacttttgaagtgtaatatacaagtgtttttgtaaaaatgtcagtgtttttccttgaactgtttcttgagttgtttcacatattgaggattactatggtatcatgacagctagaacagagtataggagcaaaaaataatagaccactaagaaagataagtgatcacccatttgaaagagagactgtgagaggatacagatcctgaattggcataaggtaaggattaaggaaaaattactcaagacttaagagacgaaaattatatatatttttttgtgacagagtcgtctcactctgttacctgggctgaagtgcggtggagccatcatgtctcactgcagactccatctccgggcttaagcaatcctccccccgagtagctaggagtacaggtgcaggtcaccatactcggctaatttttgtaactcttatagagataggggttctccatgttgcccaggctggccttgaactcctgggctcaaacgatctgcctacctcagcctcccaaagtggtatgattacaggtgtaaaccactgcacctggcctaaaaattatattatcttagcaatttctttaaaattctcacttacaaaaataataagaaaattgtagaaaacctggtgatatagtttttgggtttatttctaaaaacaaaatgaaagaagtctaagaattaaaaacattttccatagaggagtgctgatggatctggggtagaaaaaaattcaaataataaaaaatctgggaaatactagtatttcttatatgactacctccaagaaggagttcatcaaaattttatcaaaatatcctaaaattgtgtttcttttaattttttaaatttattttttaacttttatttcaggtttggagatacatgtgaaagtttgttacataagtatacatgtgtcacaggattttttttgtacatattattttatcaccaaagtattaagcccagaacccaatagttatcttttcttctcctttacctcctccctccctcccaaaattgtgttcttataacaaaaaatattacattaatgatggcttgataaaaagtacaactgcatcttcaaataaaattttctcattttgcttattccaatgcaaatcagattataactgtcactctatggtaaattacaataataatacacaatgaatttaaaataaccatagtttaacagtgaatgataacctcaaacatgtttgctgaccaagttgaaaatgccaactcttattctgcaaacagtagagatagggttatcaggatgttggagagattttgtgagataaaatagttaaaatgtaaaagcattttattttccttttaattttattcagccagcaattgtaggactcttccaatgcttcctaaatgttaaatgcattcagtgtttattgaatacctatgatattgaaatattgaggacctacagtattgaatgttataggtgttagtgacataggagtgaaaaataccaaagttcctttcctcatagtacttgtactcctctgggaagagacagacaataataaaagtaaaatgacaaatgcatgtaaagtatgccagtgggtattaaatactatgaaaaaaagtcagggtaagagtaatttgaaaaaacaactaccttatcctcgtttctttgtaatgaaatatttctattcttgtccttcttttgtcatgaaatttactaataataagctctgaaagtatactgggagactccatgtataattacacataattgatttctccactttttgacatattacaaaggacagattatgattctagtaaatttgtatcatgcagagaaaagatttcagataaaagtgatccatgaaaatagagactgacatcttgtttcctttaagaagccacaactaaatagctggcaaagtgttgaattaccctgtggacacatgaatgggagtcttggcgagaagtagttttaatcagaggtagtttttaaccttattattaggacttttacatcagatgtagctaaataggatgaggtacataatttgttatcaacatagttaatgtatttattggtatttattggtatatactgaaaacatacctttaaaaggtaactaaattagaaatctgagtaaaatgtcaactgatttgcagatatagtaggtgattcgtaataggtgattaataaacatctttttcagggacaagcctgtttcagtgagtagaaactgagcttcttccatctctggaggcactggctgagtcttggggcacagggaggcaaaggaccaaatctgccacagacaaaactttactgggacaattagaaaccaggcaatttttaaagtgtacttttgtaaaaactgctttatataattcccatgctataccagtcaactatttacagtgtccaatttcatttttcttttatgatattcacagagttgtgcaactatcaccagaatataattttagaagattttgtctcccctaaaagaaacccaaaactcattagcagtcactctccattcctccaacctcctgccaatcctagacaaccacttatctactttctgtctctataggtttgcctattttggatactttattcagacttttagtggctaaatattattccattgtatgaaaatataccacattttgtttttcattcatttcttgatggacattgggttatttccacagtacatctattgttaacgtagctacaaacatatttgtacaagtttttctatggatatatattttcatttctcttgggtatatacttaggagtggaattgttgtatcatatggtagttctacctttttgagaaactgtgaaactgctttccaaaatgtctgaatcacattacatccccatcagcaatgtatgagggttccaatttcttcacatccttaccaacagttgttactgcctaaatctttttgattatagccattccagtggctgtaaagtgatatctcagtgtggtttttgacttgcatttctccaatgactaatgataaacatctatgcatgtgctattggccatgtgtatatattctttggataaatgtctcttccaatcctttgcccatgttttacttggctatttgtcttttttattgtcaagttataaacttctttatatattctggatacaagtctctttttagatatatgacttgcaagtattttctcacattctatgggttgtcttttcacttttcggattgtatcatttggagcacaaaatttaaaaatttttagtgaagtccaagttatatagtttttcttttgttgcttatgcttttgatgtcatgtgataaacatttgaatgtgtatgcaagaagcatatactctgtactgtgaacagtgcatataaaaatcttgaatgaaatgtcatcccagttcagatactgcctttgcctgttgctcactaggtgaaatgcaaagttctcaatatactactcagtgcttccaagtgaactatccgatattatcagatccaatatttggtgctaactgaccatgatagccagagctttcctttttatgtcccagccaattccctcagtcatggtgcatttccagatctgtgcttttgcttgtgcagttcctagcatttaggctgttctgctttcctcttgtttgtattctgtaaatcatttaacaccctattccagttctgcttctttttcctttactgctcatcatgatttcctattacgcttgactgagccagacactgagtacctattaggaactgtttatatatatatataaagtactttaacaattacatatatatcatttccatatgtgtatatatagatatacaaactgtagtttctaatagtttgtacatttccacttaacactttaagaatatatactcttattgtttcatggtttcatgttaataagacttttcttagtagataacaggcttcttgtgagcaagtcaatagctgcacttctaccacagtgcctgaaatgtggcagatggtcaagaagcatttagtgttggctactgtctgagaccttttggaatcttgtttgagtctcatcagtaagcttatgacttttatttaataattataataagttattttacctgttttgattctgaggaaaagaatgtgtgaccaagatcactctgcactttccttctctttgaatgagtttaattctacataaatatgtttttctcaggtcggaaagtgttgtttttataataatgactcaatattgaagtctcagggcctacatcaaaatatcgcaaagttgttgttgataaagaaaatgatgcatcgttcatttcctgtagttctgtataaaagtttggggattttcttgaatatgatcttcaaactttttcttcttaaaaagcagctaaccaacctacagccatattaaggtagtgtggagtttttcctcttctctgagtggaatggcaaatcaacggtgtgtacttgctatgcatgtagatgacaaaaagcagtgaactgtgcttgaatactcacgtctgtcaattttagtacagcgtgatggctgtgctagtttctaggctgcagtttgaatctccagcagaaaattattgacacgtctccataaccaacacacttgatctttggcaatgttttgtcctagcaagtaacttgaaaatttgttttacattttatcaaataataaaaaatttagagagtatgtttctaaatctctcaggtgtaaactctacagtgttcttgctattactttatcatcttgatcaactaccttgcagttacatccaaagataaaataaaagttaaaaatgcagagggaagagaaatcagaaggacatttgttgtgccaattacataaatttactgtagcagttatcaaattgtcatcattagattgtgatcttttatagtatagttactatgctttatttctgaacccagtacaatgtgtgactcatagtatatgctcaataaatggctgtggatttctccgtatgtttttggaatgtgctaatatataatcaatctttaataatttagattgaaaaagtggattcttaaccaatattcaactcactgaccaaaaactatattctaatatagtcataaatagccattaacactcacataatattttatacttgacaaaatgctttttctatctattggatcattgagcaaataaattacataaattctaattgaccaaaatactggacagacactaagtatactacagtgtaaatgtgtataggcttaatctcatagtggaaatgacttgaatagccagtggtttgaaaatatttatgtcttctaaatatgaaccatataatttttgttttctgttttaaaaactaccttgcctcctgtttatacccagataacacttgtagaatgtggaaaattaccctgacaaagcaccagagaactttctagatgagacattcaggaactggtgctctatcacaaggccacagaagagacagagctattagatggaaaatatgtgaaattaagttataggtcaccattgcccacctttcttctgtgtattcactccttcctttctctcccacattttcaatgttgcctgcattagataagaaaataatgctactctaaaaagtcatctacatgctccctatgcacttacactgtgtcaaatccatgtttctctggatgaaattttttctttttgcttggcatattaagatggctttggggagaatttatggagaactttattcgtataacattatggttaatagcacaggcctggggaataaggctagaccaaattctcactccatctcttagtagcaatggcagaaattactaatttgctgctctggcttctatctacaatcaccttcttcctagccatcttccagttaggggtgaccatgtaacacagttctggccaatgacaaataggcaaaagcctgctgggtaaaacccctgaggaagctaggggattcagccagtatgacccttatgtcttctttctcttcactttttcatatatattgtgtagtggtgaagtcttggctattagtgtactcatcacccgtctttctttatttattttacctggagtcctgtgattccagaagatatagcagcgatcatataactatgaggaaggtagtacactgtgcgtgggggtggggacagcaaaagaaacagcctacccgtccttgtccaaattacttagtaggtaaaacagacctgaattgcctatctccaatccccttttttactttttgaagaataacagccattgtttgtttatgccctgaagttggtttttctgttactcacaggtgaacacacttctaactctatgtcctcagtttcctcttttattatttgaaaatgttaatagtacctacttcatagggttgttgcagggatgaaatgaaaagatgcaagtgagtgacttaacaaagtgcctgtctcagagtaaacactcagtgggggcttgccaatatcattattccaacttgaatattttctttattatatttaatgttagaaatttagattttaatgtagatcatatgctactcagtgcagctataacataatatatctctttcatcttccaagattgttttcagtgtttttaagatagttttgttgaggtataattggctacagtaaactgcacatatttagattagtttagtaagttttgacgtatgtattacccatgaaacaaacatagggcacagtagaacaaaatacaatgtgactaattttgcttggaggaagaggggtcagaaaaagtttcacatcatgatcacaataaaaataataactatatcatcacctctgatgacttcttcattctcctttgtaatccttcctttccatcactctccatcccctcctccttctacaccatcactcatatgctttctatcactatagattagtttttattttctagagttttctacaaatggaaatatataatgtgtacttttttgggggaaggtaagtctggcttctttcactcaacactattactttgagattcatctatgttgttgcaagtttaatattttgcttcttttaattgctggataacattctactgtgtggatatacaaatatttgtttttcatctaacgatggagaatttttaatattttattacatgaagtatctgtcttccacagcactttgtccataagtctagtggaacatttcccatagtgtagtaaacaaagttgttttcatatattctgcattagactttgtgactacccttcaaattggtattgtgtcttattataaataagagacacaaattggaattgtgtcttatttatccttgctcttccagcccctagcataatggcttggctttgaacgggcactccatgtaaacaaacctataatgtgaggccaaaacattctgtttctcctctactctcaccatcatcaccacttattcattcaagtcaggaacttgagagatgtttgtttgctcttttttttagtcaattttgtttaggtataaattatatacagtaaaacctacatattcaaagtgtacaggtcaatgactttgagaaacatatacatttgtagagccaccaaaccaattaagatatagaacattttcatctccctaaaaagctcattcttacatctttgaagtcaatatcttgcactaacgagtttttcaggcaaccactgatctgatttttatcaatataaagtggttttgtctgatttaaacttttatataaattaacattatttagtatgtacttgtttgtgtccaatttctttcatgtggcacaatatctgtgaggttcaaccatgttgcatttatttgacttttaattggagtgtctagtccatttacatttaatgtaattgttgaaatgttggcgttaagtgtactgtctttatttgttttcattctgtctttctatttttttctctctttcttttttctgccttcttatgagctggttgaatttgtatgtgtgtgttccattttattttctctattagcttcttagatataccttttattattgtgttttggtgtttactctagagctaataatatgtatccttaacataactgaatctatttaaaggcagtatcttatttttttgtatttcctacttccataataatatttattagtataattctatttacaccctaccctaaatttatatttttgtttaaaaccactcaaatgactgtccatttttttctggtactaaatttaaactcctaacatggcttatcaaatccattatgttttgggctctgtttacatctttaaccacatctactgtttcttcaactccaggaatacaggtactaattttctttcatttcttcaaatgtatcttgttgtttcaaacatctgtgtcatatgtattgttccttctgtctggactactaatccccttttggcatctgacacttcaattacattttttttttttttttttgacagagtcacactctgttgctcaggctggagtgcaatgagtgatgtgatcttggctcaccgcaacctctgtttcctgggttcaagcaattctcatggttcagactcctgagtagctgggactacaggcacacatcaccatgcctggctaatttttgtagagatgaagttttaccatgttagccagactggtctcaaactcctgacctcaaatgattcgcctgccttggcctctcaaagcactgggattacaggcatgagccactgcacccagcctgatacttcaattacttttaataatttttctgaggaattgtttgtgaagtttctgatccctttatctgcagacagaattaatcactctctattcagttctacttttgtgccttacatacacttttatcaaatgcttcttacacacggcttcaaatttcgttggcctcaactcttatcccagctgtggctgtggtgaccatttctatgaaagtgccgcccagtttcatgggggagcaacctgacagtgccctgcttcaggctggtgcaatttacccctagctcctcctcctcctcctcctcctcctcctcctgctccacaaggattccttactggtagtgaagcagtagggaataaaacatccctgagattttgctcagtattccatgcatgtgcaacctagaaatgatggggagttgaataattgggggaccacccttgatcaatagaaggcaacagtaatgaataaatacttcatactttctttctctaagaggttattaaggtgtcctgtaagactgaatatccagccatctgtatgggtgaccagtcaactcaacatggaatcttttattgacatacctttctttcctcccttctcccccattccctagctctggaccttaagttacattttttgtgtcttaggcttggtattctggggaacccagggtaagacaatgcttttattattacctgaatgatgatgtattgtaattacttaaatttttctagcttccctcagaccagtaatttttcaaaaatattaaagcagttatatattaaacctcaaaatataaaactggcaaaagtaaaattatttgattaaaatggttgtggcagctgagatattgaaaaaacaatgaaaaaatttagtaatatgtgaacttcatgagagttagaaaatatgtcttattactcttgtactccttagaacctagcatagtggctggctcccaataggtagtcaataatacttgtgaaactgaactaattgaactgagagaaactgtagtatagaaaatatacataattgtattcatgccgtagtcatggtgagtaaatgaagaacaaaataagaaatcagaaatatagtctacttcttttttggaaaatgtgaagtttgttagaaaagacaacacaactttttctgcaagctcaagtttttcatttttgacttggtacgtaatttttgaactggtgtcctgatttctgttaaatgtcaggaacgatagattaaaatggaatttaaaaaaacctccctcattctttaaaccgtttattaacaaaggtgaaagcatggaaaagttatcatttataattgttttgtagccacaaatgtgaattagttgagctaaaaagccaaagataatttctagaaagtatgccaccaaaaaataaaagagcttctcttaggtactgtgattctaatcagtgttgaagagtgtcatcatttctttaaagcaacagacactccaaaaggatagatttgttaaattagttattgtgaacaatgctctctgggcattcagaggtgggaaaaagggcccaaatgaaaaaaaaaaaaaaaccagccatacaatttatgctttaaaaaattcaacaagttttgatcaatcgatagatacattcattcattcatatatgtttatatgatgttgaggttggcatatagaatgcctatatgagagtctgttttcaaatttcagcctatatatttttttgccgttatattttttaaggcttagaacttttaaacttttgtgtaaagcaagttagtgactgattttccttttctttattgtaaaaatggggcttatttatgagatttgtgaaccaaatataggcctaaaatacatacattcaatcattcaacatatatgtcaatagcacctatgggtgctaagtgctgagaatttagtagtgaatatagtttacagatactagggatggaaaggacactaagagacattataggatgggctggtgaggcacgtttgctgactaatgagacacagacatgtagaaaggttaagtggcttgcccaagatcacagggtttgtgagctaattattcctcagaatatatacgattattctcagatagcactttcatttgcactaatactttctttaagcattattgagtgatgaactatggagacagccaattgcaaaaggcagctgcccaaatgagaaaacactaaaaaagaaatttttcagagaaaggaaaattagggattgactgagatggagcacaaaaagtgtaggatcatttcagttcatctgaaatttttcagacttggattcttttcccttgtgagttgcatatgatttaaaaaataaaaaataaactcatgttgaccgagagtctaacatgtgccaggcactttaatatacattaactccttaatattcacaattctgtacaaaattgtattgtgacgtctgagtggctgtttctagcctggtgatacagtgtatgtgtcatttcttgttggcttttcattgcccaggttctgatatgcagctttcaggttcagaaactgggttattatgtggacacctagaggttaacagacccaggcaaattgatcccttctgaccaaacttacaagagtctgattataaaccagaacatcaatttagacgtctctatgaggaagttaactgccaagtagactggaatactcctgtcagcttgtcagcacattttaatccctgtgggagagaaagcttggggaaataaaattaaggataggaggatcccaagaaagcataaaattagaagaaagtgagttggatgcttttaaaagtaaaattgtcatacggttattggagctcagtgtgccttctccaccataggaatatacttgcctggctaaggaatatgaatattattttcaaccagacaggtccctccctgtcaatatatctgagattatgactagttatggactcattagctgcagtaaaatggagcaaattgggagggcttgaaacttcattcaaaaccagcccttttgggtgggctaagcatctgcagaagctgaaagtgggaacagagaatcagcatacggaataagtatagtaattaaaacaaagattataacaacaataataatctctaatagtgattgagggtctactgtgtgttaagaactgtgctaaaaactttacatcaattacctaacttctttctaacaacaattatcttagatagacactattaatatttctattttgtagatgagaaaagtgaagtttagaaaagttaaagtaatattctaaagtgtggaagtgtcttagcataggatatcctagactgggtcatgggcatctcaaggttaatgagtccaaagctaagcccttcatttcctcttgaaacatgttcttctttcattcagaagcttctgagtaattctggatgtcttccttcctctctgcttccttctccctgattcagttactgacatcatcaaatcctgtgaaatttacagtggatcttccccatttcttggtctctgctgttactgcttttgtccatgtatggagattactccctcagcagctagcccctctctcttgcaaagtagtctattgttcaaataatgatcttttttttttattaaggtaaaattttcataatgtaaaatttatcatgtttgccattttagaagtgtacaatgaagtggctttcaatacattcacaatgttttgcaagcatcactggtgtctaattgcaggacatcttcctcacccccaaaagaaaccctcatccattaagcagtcacatcccatgcccatcctccagcccctggaagccactaatctatttctgtctctatgaattcacctattctggacatttcatttaaatggaatcatgtatttctggctttttgtgtctggcttctttcacttagcatgttttcaaggttaacccatgatgttcattcctttttatggccaaataatatttcattacatggttatttagcattttgtttatctgttcatcagttgatagacatttgggttgtttccactttttggttcttatgaaaaatgttgctatgaacatttgtatacatgtctttgtttgaatgcctgttttcaactcagcagaataatcttttaaaaatgaaaactatgtttttttcttcacttaaaaacatgacctctcattacaattatattttaattaaaatgctttcccatggcccacaagggtttgtacaatctgcttctcttttctcatttaatcagctttcctcttccctcaatatattccagccatactgatctctgtttactttccccaatttcccgagcctttacaggatgttcacatctgctggttccttgtctgaaatactttttccactgcttcgcaagctagttcatttttatccttcaaatctccagatataatgttacttctccagaaaacttttccctgactaaactgggtaattctgtgtttccttcctgatgcttttctcaccttgtaagtacacggttttatctgtgtaccatttacaatctgttgccgtcacaagactgtaaatcccttaaggtcaggaattaaagtataactatttttcattcctaccatctgcacctatgcttagcacaatatttgacatacaagagacactccataaatgtttgttgaataaatgaataaaatgagaaaggtcacaggtattgaaaatgagatagagtaatccaatacatcgtgatagaggtgtactaagaagaaggaagagtggggcggtggagaatttttagtttcatgaatatttgaagatgtaggcagctgcatcattaaatgatggagcaggccaattggtctgagatttgtggttaacttttctttctgtaggaagaagcagagcttggtaagaacaacatacagtcctagccttagtattttactaggcagctatccaagactggaactcaagaacagagaacaatgccaatctcagtgtctagttacccaaactgtattcaagaagggaatttggtcaaagagtcaaagcaaaacctctggaaataaaatcagagcttaggtaaaaaaagaacatgtttaatttgatatcaattctgcagatgttgactagatttccttaaatctcatctgtcttcaacgaggattgtttccagaaacctggctgagattatagccatagcttttgggataggaaagatggaagatatgggaaaccagactggacttgacaaaccctaaattgtgttatagaaacactaatgaacttagactcttcaaattaccaacctcctgtttgtctcttaattaacattttatccttatttactttgacatgaattggctgtggtcaaattatgacatgtctctttgtatcaatttcttcatctacaaagtgggagctttgggctgaatatgaccaccaaggtcctttccagctatgaaaatctatgaggctctatgccacagtttccaagtttcaaattttcactctaaacaattgatgttggctgtttcttgatgatctcattagtaaacagtcttcacagatgcgagatgtgttatgtgtattctttgagtcctttttagccccttttagacagaatggcatttcttgacatggttacttgacttgggaaaaccgcatatttgggaccaatagctcttaatctgcagtctagaaagagagcttcagaaataaaaaaaaattagtaatatttagtagcaaaattgcttaaattattatttagtatagtggttgcttaatggtaaacacatttttaaagatcattaaatttcataaagttaaaagatcattaaatttcataaagttagcatctaaagtattttttcactgaaactattagatcgatccattttctgaggattttattttgattcttgtctgaacacagaattgaactagttgaagagaaggaaactggtctctaaattaaaagattagactaagtcctccttaatctccactgtgtaatgaaacataataaaaatgagacttggtctgtctaaaactagagatgtgaggagacttcaaaaagttcatggaaaaatattgtgcagaatctggattttatgaaaataaatttttatgtggaaaatggaaataaagtattaaaataaaaagtataaggttaatttttaaacataagctccatcaaattcaagacacttgtgatgataccagccatttagcccatccctaaaaaactgagggttctgggaatttaattcagtcaatgcagactttagactattaactgaagaaaaatgggtttcttttacagattttttaagactaagaaacaaaaagaagttagaaggcgccaaatcaggactgtaaggtggatgtctaatgacttcccattgaaactcttgcaaaattgcccttgtttcttaagaggaatgagcaggtgcatttttatagtggagaaagactatggtgaagcttacctgggtgttttgtttgtttgtttgtttttgctaaagctttggcttgctttctcaaaaacattctcatgataagtagatgttattgttctttggtccaacaaagactcaaaaagcaaaatgtcttgagcatccccaaaaactgttgccatgatgttctctcttgaccaggacacttttgctttgactggaccacttacacctcttggtagccattactgtaattgtgctttgtctttagaatcacagctaagtttcatctcctgttacaattctttgaagaaatgcttcaggatctcagttccacttatttaaaatttccattgagagttctgctcttttctgtggctgatctgggtgcaatagttttggcacccattgagtggaaagtttgctcatctataatttttcagacagaattgtgtaagctgaaccaatgcagatggctatggtgttggctattgtttgtgctgttaatccttggttttcttcaattaggacataataaagttgaatttttttccttggaaattgatgtggatggtctcctgcacaggtttcatcttcagtgtggtcttatccctttttaaaatgagttaactcttaaaatgagttatccatttgtaaactgctgatttctttgggccattcctataaacttttcataaaacatgaatgatttcattattctttcatccaaactttaccataaatttaatgtttgttcttgcttcaattttagcagaattcatgttgctgtgataaggggtattttcaaagtgatgtcttagcatctcaaactagatcctcttcagacatttttataacaagttagtatgagtttattttggtgcaaagtttttaaaatccatgcatggttctttttttcataatacacactttccatgaaccttctgaagacccttaatataatcaccagattcctaggtaggagttagacattttcgaggactgattaaggagcattggaacaagacagagctagtcttcgattttagttagaagtttgtggcaagacttagaagtttcaaagttttacaaagtagaaaatggttgagtaacatagaatgtcggctgtaggtgtccttaacatgttacattggaaatgtaaaaattaaagaaaaatgcgattaaaatttaaaaataggtttaaagataccacttttaaaaattttgaatttgggccgggcgcggtggctcacgcctgtaatcccagcactttgggaggccgaggcgggtggatcatgaggtcgggagatcgagaccatcctggctaacagggtgaaaccccgtctctactaaaaaaaaatacaaaaaattagccgggcgcggtggcgggcgcctgtagtcccagctactcgggaggctgaggcaggagaatggcgtgaacctgggaagcggagcttgcagtgagccgagattgcgccactgcagtccgcagtccgacctgggcgacagagcgagactccgtctcaaaaaaaaaaaaaaaaaaaaaaaaaaattttgaatttgaacagtcttatgaagaataaaaatacaaactaaggagaagaactttcaaaaaaagaatgggctgggcaccttggctaggagttgtaaccccagcactttgggaagctgaggtgggaggatcacttgagcccaggagttcaagaccatcttgggtaacatagggagaccccatctgggcaaaaaaaattagcttggtgtggtggcacacacccatcatcccagctacttgggaggttgagttgggacgaatcacttgagccgaggaggttgaggtttcagtgagccatgcttgtgctgctgcaatccagcagcctgggtgacagaacaagaccctgactcaaagaaaaaaaaaaaaagaaaagaaaaaagaatggttaattaactaataaatgtagaagaaatagtaaaggtagaagatcaacattttgcaatcattataaaatgatttattcagaagaataatcaataagctaaaggtttgaagaggaacaggatatttacatttcatcaaagtatctccctggaggttacttattaattacagaatgaaaagtggagaagcctgaccaatgccgccttactgagtagtcaaagttaacatcaccaatgatgagataaattgaggtatgatccctgacatgttatactgagaaatgtacaacaatgtttatgcagtattcctgctgaaaaagcataatctgaatctaaccaagtggaaacatcatacagaaccaaagggacattctttaaaataatctcttggtgatctagaactagaaataccatttgacccagcaatcccattactgggtatatacccaaaggattataagtcattctactataaagacacatgaacacgtatgtttattgtggcactattcacaatagcaaagacttgtaaccaacccaaatgtctatcaacgatagactggataaaggaaatgtggcacagatacaccatggaataccatgcagccattaaaaaggatgagatcgtgtcctttgcagagacatggatgaaactggaaaccatcattctcagcaaactatcacaagaacggaaaaccaaacactgcatgttcccactcataagtgggagttgaacaatgaggacacatggacacagggaggggaacgtcacacaccagggccttttggagggtggggggctaggggacggatagcattaggagaaatacctaatgtagattacaggttgatgggtgcagcaaaccaccatggcacgtgtatacacctatgtaacaaaactgcacatgtaccccagaacttaaggtataaaaaaaaatcccttggtacttctgaataatttcgatgtcatgaaaaacaaaatgtgaagtgtcccagatgaaggagattaacagacatgccaactacatgtaatgtgtgatcttgaatctggatcagagaaaaaaattctgtaaaggacattattgggacaattagaggaaaatgaatataggctgtatattggataacagtattgcgtaaatgttaaattcttggatttgataaatatactgtgttaatttatgagaacattctttattgggaaatgaacactgaagtatttagagataaagggacataatctgcaagtaactcttaaatggttcagcaaaagtattttgttgtgtgtgtgtgtgtgtgtgtgtgcacatgcacacagaaagagaaatcaaaagtggcaaaatggtaacaattgaggagtatggttaaagaatatacaacagttctttgtttcattcttctgtcttagtctgttttgtgctgctgtaacagaataccacagattgggtaatttataataaacagaaacatagtggcttatagttctaaaggctgggaagtctaagatcgagaggctgcatttggtgaggactttcttgctgtatcataatggcagaaggcatcacatggtggaagggcaaagagagggggagaaagtaagcaacaaatcgggccaaactcatccttttataagcaaccgacgcccttgataacagcattaattcattcataacagcagagccctcatggcctaatcacctcttaaagatcccacttcttaatattgttacaatggcaattaaatttcaccataagtttgagaggggaaaactttcaaaccatagcattttccaactcttctgtaagtttgaaattatttcaatataaaaagtctttataaagagtgattattaatcacctgcctgagcaaagatgttatctttggcttgagtcactcatcacagaatagaaagcatttgacattgccaaaatgaagtgtggatcccatgagacaactgattgcagagctggaagatgaacttgcagtattatttgtcagtacaatttagcaaacaaggttgggcttcttagaactctcccagatgattgctaccttatatggataattcattttataaacattaaagaagttccaattatatatatatatgtatatatatgtgtatatatatgtgtgtatatatgtgtgtatatatgtgtatatatatgtgtatatatacgtatatatatgtgtgtgtgtatatatatatatatttatttatatatatatataggaacttttctagcctcactggaattacagcgatgataatttaatatcgagaacagtctctgacagttgcgaggggcaacagctacataacaaaatgccaggataatgcagcggtgaaagtaaacatggagaaaaagttagcagagaatacaacaactcagatatttttgcgggatggtttggtggagaggaatgacaatgaggcacacaagctttccacttgattgaggtggaggaatggagtgagagagtactccaggcaaagggagcagaggtagttgacataagagctaggggtgccttgggacttttaagcaatttagtattgtagaagtgaaatacagctttttgatgttcagcttgtaacaacacaaaagaaattagttgtcagttatgagtatttataagacattaaaatagtataaaataattaacactagaaaacatacaatactaactgatcctttgataaagtgtttttattgtgtatgcatggcatcttattaaacatggaattcctcctttgacttttgtaccttttgcagtaattgtcaaacttgaataatatatagactcttttaaggaaggaaattcctatcattcccaagagtcacatgttcagataactagtggttgatagatcttagtttgagaaatactgagttgaagaatggaaggaagttttactttatagaaaagttatttaattacaaattacaactataaaagagatatgttgttttcagtcagcaaaattattttggattattgcaataaaaacaaaataatcaaaaggtgaatacaaaacaataaaacactttgtaatctttgagtcaaaagcttaatcttaaatatgtaagctttacataactttgtaagtaatacattcagacaccaatcagtacaaggaaaagggcctgaataaacagtttacaaaagatgaaataaaaactgtaagcatttaaaatgttcaccttcaataataactacaaaaaagcaatttaaaatgagagactacctttttgacccataaaattagtagatacttaaaaaatgataacatgttgatgagagtttttaataatagaaaaaatcacaatctcaatatccaacagtatggaaataattaattaaaatattcatttatgtagtatgacattacttggacattaaaatatttttgaagaacttaatataaatgcttatgctatcatattaaatgcaaaaaaagcaatgaacaaaaaatataaattcaaccttgtcaaaatatacatagaagatctaggcaactatactatggttatggaagtcattaacatattaatggtagaagctgggtgaagggtacatggtaactctctgtatatttctgcagcttttctgtaagtctgaaattatttcaaaatgaaaagttaaaaaacatacatagaaaaaaatgctgcaaggaaaaataccaaaattttagcagtggtttctatgtggtaaaattgaatagcttttccccttcatttggaaaaaggcttttctttaacttaaatttttatagagtgatatgccatataattttaaatgccatataataccatttaaaaaacccctcgccctaaaactaaaacagaaacaaaatgctgaactcaaaacaaaaatgtcatccaccaccatttggtaatcagtgtggcagcaaaacataaaacataaatgtaaatgctaaatggtgcatgaggatggaagataagatagaatatcaactggttaggggtgcattttacagggggaacgtgaagtgtgaaaatagataaaagataaatataaggactgaaatagatttaggaagctgtggcactaagaatttcattttggtaaaaaggagaaaggctgcttctccaaagagagaaaatatctgcggtattttatgtgtagaagagaattaggctaattctctgagtttttggggagagtaaattatagtaagttatgagagcattcccaaaaggttagttgttaatgagtaaaaataatttgctttaggtaactatcttcatacttgtttttatcacagactcttttctaagcaactcaagtttgcagtgattcaggcctacttctgaagagacagccttttatctcaatgaatgacacaggtaatcacctacttgaattaagttcctcttgatctggacttttgtgccaaatattcttttttatttaatattaaataaggacaaatagaaaaatgagtatatactatgttgtcactggaagctgcacctggaaaactacagcatgttagaccttgtggttctccgtctttgcctgtctcaagattctgagacgcatgacgtcttcctttctatacctggactccctatagcagtgattcttgggaacatggcaagctgggggtatgtggtttgtaaaggaacatcctcaggcacacttatgtcaattctgaaactgttccctttctccagcgttgccccctctccctcagagttattggtagaaccagaatcttttagttttaacagtttatcctagacaattattgtttagccccctttctcgtattgagacaaagttagagcttgctccttagagaaacaatactgtgtcagaaattgttctttggagagggagtgtgaggctttacttcaaacttagccctgattcagtttctgtccccatagttagattttaagccccttacaggcataggttaggtcttatccatctttttaccttcttcggacttagtctttgacttttgaaaaagtagttacttaccaaatgtttattgaaaatgaataccatttccttaagggcaaattgtattccttcgtgaaggtaaatctatctcttgctatgaaaaaaaaatgtggcataagtacaagttaaagtagaaaatacagaatgtatagcttaaagttaagcagcagctttgatctttggctgagtatataaaaaagattaagagttattaaaaataagatctaaaggtctgtctaacaagattcttaaaagaggaacccagaatatgtttgaatctacacatgttcctcaaggctgcaaatacattgtactatatggacagtcactgacagaggcatttatctgatcttgtgaacatgttacagggaattctgtgtccagagcctctgccctttgactgtggattgcttcttgtttattaagtatgaaaactggagaacgacagacttagaggacattttctcttatgcatacatacagcattattaacatactctcgcctatagcagattgttttagaattttagatttgtttgcgcatctgtaaaaaataacaataataattatcttacagactgaggtaaggattaaattggcacagtgcctgagaagtagtacatatatgctcaataaatggtgttttttcattattattcacagatagaaattcagaagtgtgttacaaagggttaggtgaatttaatatagaattaccagggcaatattatatttcaactacattatatttagattggcttatgtgagctgaaagcaaagtgtttctaccatgtctaacaataccgtaagggaaaatactttcttaaaactatacaactggcatgctcttggagttttgaagctgctcataagttgggtgttacctagtccttttctatgttgctcatttatctctttttttctgaatattggctattgttaataaataacctagaagagatatcacacctttcatcatcagaaataagccattgctttcacagtgacgtctactttttaaacatttccactaattaatgtttctgttggcctccatttattgtcaagtagcttgcatgtctttgaccttaagttaatgaatgactttctccgtagcatttatgagtcagattccttgggcttgagccattactcaaggcttgagccattactgcgtaaggacatttactttttatttttaaattccattttttttttgcagtttttacatacgcagggaatgaaaaattatgttggctagaaatttgtaataaaaggcatagaaaataacgtagatcttggcaaaactttattcactcataggacaacacttggatacttgttggagtggaacagaaaagctggcaacacctctagcaccaccactatcaatagaaaacattcatttaaaataaagttgcctgtgaagctgtgctagatattattaaaagagaaacacattgagaacagtgacctcaaattacttatacagagttgacaagtggaaagaataaaaacattaagctatatccacaggcattgtggttttcattacatgtaggtaaggtacaaatgaaattttgatatgtgaaaaaagtcaattatctgactaaagtagagattagaggtaagtttaggactttttatgtcttgtacaattgatggataataataacaatgtgactatattctcttgaattcgtcaggggatagactatttaagttttggtgtccaccaggacagagacaggcaaagtgacagctgttactctttggagtgggttcttcaaagcagacttagaccctggctaagcctgatgcttaaaaccatggtgctcctggggcaagcaaatgtcttggatacctttcagaatgtgccactggctcctgtgactggggcatggagggggaacaccaatattattactcaaatagctccaggccaatgtatggtttcaggaacagcacagaggaatgcctgggacacccaagatgagacttgggtaaattagcacaaaaaattgcctcaaagaggaacaataaattttattggaaaccgatgtgaattttgtttccaaattagtgtgctagtaacaaagccaacagacatttaaacagtaagctgacagtttacccacactttctactttagctgaaattggagtgcctcaattcgttccttcttcatttctgtaatcgaaaagaagcctttatagtatgtctaaaagcacactaaggttgtatttgtattaacatcttaattttgctaagtgccaataaatgctatgccttatcttcacttttctgttaggaaattacctaaaagacaatgctttattgtaaaatttaaaaaatatattgtaagtagtatttccagagacaagaagctatctaaatctattttacaatctgcatctatatctacatttatatcatatctatatctgtgttttccagtggtcataccctcaagcatactgatatagaatacagaggttgagacatttagatgctattactaaggttaaaaattatatcataaacatacacacacataaaaaagactgtaacaaatgaagataaagacaataaacacttttttctcctaccctaagataagcataactcatcaagatccatctgtttattcttggatgttctattctacttctgtggttggtctcactcctgtagtggtctcattcctgttggtatcaacactggaatattacagagaagattagcatagcctcttgcaaagatgcctcacaaatttgtaaacctgctatatttttgcatagttaattacttctttctttgggttccaatagcacattgtatgtatattagctgtcatcttactgtattataattatttgtttacttctctgtccccctcagaaaacagaatcgctaaagaaagaaattattctttatattcctagtggccagcacagtgcctagatcctaaaacgcatccagaaaatgtttaataaatgaaaaaaaagaatgaaagaagttttatatttatgtgtaagaaacaagcaacaattctttatatacatcatgccaaagcagaaatggattctgaaacaatttcttccctcctcaccttgtattcccaatggcagaaattctattttagtgtgatgcccactggccaccccctgctgataactagtggacacagttcagtttgatgatgggcagatggacaagcctgctgttgtccttggccataggctgtttctgcctgttctcttagatgcatcaaacatgcatttctttctctcctcctttttcagaattgtacatacttgcttctaaaactgaacagaatgatatatttgcaatataagatgcataagcaggctctagaagacagataagcaaaaatactttgagagatacatgttatctaacacaaaagaaatggactcagtagaaaagaagccataacacattgctattattcaactgatgagggatagattttccctctttctcttccatcataatgagattgattagaagagaaataaagttgcaatgtatttctggaaaaggagatccagattatggtaccaatttgaattgttcaactagatgattgcccagagttataattcattcaaatttcacatataattacatacataaatagtagttgcttcaaattaccaatacaaacaacagtttcatagataagacactggcatgttacttaagtttttaagctatatacatattcagaatcatttggcatagatatatatttttttttttttttttttttttttttttgagatggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctagatattttctttgctagtaaaaagaaaatgggagaagaaaataataattatttatttatttattttttatcatgggccaggctttttttttctttcttttcttttcttttttttttttttttgagatggagtcttgctctgtcgcccaggctggagtgcagtggcgcgatctcggctcactgcaagcttcgcttcccgggttcatgccattctcctacctcagcctccggagtagctgggactacaggcgcccgccaccatgcccagccaattttttttgtatttttagtagagacggggtttcactgtgttagccaggatggtctcgatctcctgacctcgtgatccacccgcctcggcctcccaaagggctgggattacaggcgtgagccaccgcgtctggccgggccaggcatttttatgaagacactttttccgtgttttttatgtaatcctcaggactctgctgggaaattagttttattatgattatttttaaaaagagaaaagttagactgagagataggaagtaatttcactcaaggttacagagctgagcagtgaccaaactgtaattccctatcaagtcctttctactcttaaacttattttctacctactgtttcggatttagcaagcatatagccatttctcaaggattttttttttttttttttcaagagacgaagtcttgctatgttgcccaggctgctcacaaattcctgggctcaaacaatcctcccgcctccgcctcccaaagtgttgagattacaggcatggaccaccgctcctggccttgggtttttattatgaaagtggtagtgttttatagggtttccagtaattgtgaatggtgtcttagatgccaactactaaaaatgtttctgctgagtgagttggggtacttgtactcttttccagatgattaaatctattgcctgaaaaactcattcagtaatgtgatacaggggaagccatctctgattttttgtaatgactaggctagagagtagagttctccagtgtttcctgcaccattctttaggaaatactagtctactttctagaagtcaaaatttgtcctggctaccctgtttgtctaaaggtaccatgcccaggctagcatggtgggatatggccagaactcttggtgacattcttgctttgaccccaattcatggtacaccagtgatctttgggctaacttagggggctaaggtgagaatcactccagctttgtggctggatttttctgagggcctttggcattgtttccacacgatggaagaaccctagaactgacttgcccttttgcatggaggaggggcagcacagaccctgaacttcagctgcggattcagcatttctcccagggtggtggcagggtgcgtgctgagaagtgattctgtgtacttgctgctttcctccttcttccttcaaatatgtatcaggctcaccttctcagggcgaaaggacaaactataggaccaactgctggtaccttgtaactaagtaacataggtgctaaaatggattaactctgtgaagtaacagaactgcctgttatcctggtttccttaggtaagcagattgtgccagaagcattttctgtgttagatgatgatttttctttaaaaaaaaaaaaaaaaaagcagcttcaattatagtaagcctaaaaaatgagagttaatcaagatagaattatcaattgactaggtacaatttgacaagtcagtttttattccaactgcattatagaggtgattttaatatttagaagctgtgattcagagagaggctccagaaaaattataatgtgggcataatttccatagtaagggaatggtcattatattaaagtagatgtttatctctctctcacctctttttcttatttttccaattctgtatgtctgcctataatttaaactgagtaattaaagctatgcttaaaatgctttgccattaataaacgaaaagtcacctttaaaaagttgattcagtaatggaagttatttcaggactggatttgagcccagttcctattaatgaggactattttccttttctttttctaggacagtggaattagaataatctgttttgtctatttccagtcatgacacattctaggtttaggtaaataaactgaactgaaaaataacaggctaaccaaccctgtctgtcacttgacttgaagctgtcatttttcatttcagcattatattaatgagcattagtatgaaaactctctgtcaaaggtttgcttcttatgttttgattgctttagaatgaaaatgtaggtactgaatttcagaaatggagtaggaggggcagagagccctggacagaatcaggaggctggcttaggtcttggttctgtcaccatgtatgaccatgtatgtacctggacaaatggagcccggctttattttttttttcttttttacataagtgactccattttgattccgacgactttaacaggtgatttgcaaaaggtaaatcactttaaaattttaaatatctgtttcctttacatttaaaagcagaatggttagagtaagatagcatggcaaataggtgtccccttttctgccagctctgatcaattgataatgcctgtctcgagtactgcatggggatgatggtgaaaccttttgcagatccagttggcaggaggactcagggcaaaagagccacttattttccatccctgaacttgacaacttcttgggtaattatctgctttttttatgacttttgcaatttattcttatgttttacagttcaggaaatggtctcttcataatttacctaaagacgtttcgaaaatttgagaccaaggatacatagtctttgagatcatctaatcaaaattaggatgatatgttaaaaagtgtgtcaacttaagtcacagagaagctctctaaaagaaaatattcaagaatagggtattgcaatggggaaatgtgcatagtaaactatgtgtgtattcagataggtaaaggaagacaaagagtttttacagaaaaaatgaggagtattacataattttattgaaatggttatctttgggtacaaagacatataataacatggataacgtcagtctgaggttggacacaagggtgcagtggccttcctgcaaggttttggtatttgcagtcttttgtgataagttttgtaatcaggtatacaagtgtgagagccttcttttcgttgccttccctggctctatttgtcagatatttttttaaacataagggactccattttgattccaacagccttaatgggttatttgtaaaatgtaaagtgctatttttattatttaaggacaacatggataattaatgataaggttttctattgtttccgttggggcctcgttcctccaatttttcatggaatatttattgcatgaatgacacagactctttcagtaaattccttaaaagttactcattctactgacactagattaagataattaagtgctaaattgtatggcacagatagtaaacaatgtagacattcagagagctatagagccagaatcatcagagtcattcagtcatcagagaactttaaaggaaaaggcagaacttgagcagggtctacaatgggctgaatttaggcagaagggcatcttagaaatggggcataatttgagtagagcatggaatgggacataagtgcaatttgtggcgatgaacaagaagtagaaactgtttcaataaggaaagtttagattgctaattattagtaataagataaatatcaataatagttaacatttattcacttattcatccaacctatatatattaatttgtatttttggtagagatgggtttttgctatgttgcccaggcttgtctcgaactcttgagctcaggctatctgcccaccttggcctcccaaagtgctgggattacaggcatgagccaccacacccagccccaaccaatatgttttgagtgcttataatgtgccaaactctatactgaacactggggatacagctcttagcaaaatggacaaaaatctttggcagttttatagctcttacattctagtggaaaatgatagtaaagaaagcaacaatttaaatatgtagtatgttagagaataataactgcaaaggagaaaaataaagcagggaaggggacaaggaaatggtaggggtgggtggcaattttggatagagtggccaaagaaggccttattaagagggtaatgactgtgttatgatctgaagcaccacatgccaggcatcttgcctggttggctacttattatagtttatttaattttcagaacaaccgtatgaaaataggaactattattgccctcattttatagatgataatctgaagcattagacaactgaagtaacgtgcaagtgtaaacagcaattaagtgtaagaggtggattttaaatcccggaagttaattcccgagagtatgcttttagtttataaaagtctggataacaaaaatcattgaaagaggtatcagcagtcaaaatgatagaattttagagctggagagaaacttactgattgtctaatccagtggttttcaaccacctggagagcttgttaaaactcagatttctagaccccacttctgaagtttttgattaagtaggtctaggatgagccctgagaatttgcattctaacaagtttccaggtgatgctgatggtttccattgatggtttgggcaacacactttgggaattattggtctagtcatgtagcacgttcaaattactgaaattagctattctctactgttttggctcccagcattctgtgccttgtttcttacccacctctttcttgagtatatagggacagaggctttcttaatctatttaccacacaataaaggtttaataaatgtctatcattgaatgactaatgtggaagagaagagggaagcactgaaagttttgaccagcaaagtgacataatgaaagcagtattttaggaagatttgttactaaggatggtaagataaagagattggagatatgaatattttcccattgccaggtccctgtagagctttgtcaaagtgtgacacggaccagcagcattggcatcaactggaggcttgttagaaaccccaactctcagagcccaccttagacctactgaatcagaatctatgtttttacaagatccccagtgactcatatgcatgtagaagtttaagaaacacagctttaggacatcaaatggtcaatgcctgaccttatagggtagccctaggtgatcaagaagcagcagcatatatgaatgactgagcaggtcagctttttctcaagcatatttcttgggataccagttctctgagatcttaataggtattcagtggtcaaaaaagtttggcaatatattttacaagataaatgtatacaaattaaaaataatttttaaaaatgtttggcagaaagcagattaaatatcagattaaacagagataaataggtctatttatggacaggctttaaaaaatcttttaatatgctaatgcgctttctgaatctccaagagaaaagctgtgttgtgtagctgcttctacatttattgctcatgaaaggcaatctggggggcatcttcccatgttattgtcctgtggagcgcatcttgataaagctgcaataggccatttgtggttattagagttctagacttgtcaggttttctaatctctgggcaggaaagcaccttacactttctaactttaatatccattaaacttcctcactttaatattcattaattttctgttcaaatgcccaacctttccatcactggtccaggtatgtgacctacttctgactcactttgatggctgaactgtatttatttggaaagtcataggatgggattgcaggctctgtcaggtatggaaaaaatattcaagaattagttgctggttttggcatctgaggaaataaggagctactagaaaatgtcagggtcactcgtaaagtacccaagtttagtttttggtaaaagtaaagtcgggaggtagtactgagagcaattagtgggtaaacaaagaagaaatatcaaaatttgactattaagagacacaacatctgtcagcaaatttgtagtcaggcataaaaagaagcacatgaacagacatatttgggaactagggctattttagatttaggacagtccaaatagcttttctacagtttatttctattgatgtcctttttgaaaatctgtggcccatttgaaccctgaaaggttgattattccacattctataactcaaaaagcatttgattttaaattacacttactaataaattaccaatagtttgggtagcattttgctgtacctccactctcctggacatgaagcttcactttgtttttatttttggtagcagaatttttatactcttgatattaagaggagtgaaaatactttcttagtgatgcccttagtttgggcagtaagccagataattttcatgtttttcccttttctgttaataataataaaaaacaatgaaaactatttttctttgaatttgttcctccaaatgctcaaaggctttctttatttcttattaccttttgcactccagcctgggccacagagcaagactccgtctcaaaaaaaagatgttatttcttgcaaaatcaaggtagtacttaatgatattcacataatttttaaaggaagttttctcctgagtcactaaatttgatactttggagcataaacttcaatatgtaaatattccaaatctgattcaatacagtttccctttactgtaccctccactggttgaatttcctgcccttgcaggagaaattttgaaaaggagggaatgaagtttttaaaatcaagcagaatattttgaattaagtagttttttatttcagagacttctagaggggattagtacagctttgagccacttttctctatctctaaatctaaagttcccaggatactatttctaagatgaggactctgagatcttataagctgcttagtcattccaaagagatgcaatttttcttattgtactagatttactaagacagaaaagtagactgattcattacacaatagaaagaggctgactgcctttggaaggagtacttttccttctaaaatgcttaatccatcctattgtcaggctaaaaattgtgggagatggcatttactgggccaccctgattcttctgtagagtagaacctggaaggttttggtggctaaatgagtacctctaaacaggtgaagatggactgtgtgggtgctaagagaaccccaactgctgaattttgaacatgatgggcatcttttatcactacaagcccttatggttagtaggaaagagataatagaggcatcaactgtcccatatcccaaaggtatcctgctaatgagccatttttaatgcacatgctaagggttgccagttcttattttggagagattttcaacaagaattgcaaccagaggttaaaattagaccttgggttactaaatatttgtacgacatccatccaacaaagcatttatcagtcttcatcaggtgctaggtacagtgccgggtgctgggatattggcaaaaatgataaatatttgtcattaccatcctattgcttgctgaataaagtgggttgcaggtaagtaaacaagataatgtaacagtgagttatgtgttatgataggagaaatacaatgaactataataatacacagaagcgagttgcttaatttttacttgagtcaggtaagaagaggcatttacatgaaagatgaataagcaatagacagaccaagaggagttggggcaggaaagagcattctgagaaaccagtgtatacaaaggtccagaggaaaaccataagaacattttgtttggaacatacagcttttgggaagaaagggaagtggctagaaatgaagaaagaaaagtaaatagggtccagatagttagggttttataggcatttgggctttattctagaatggagagtcattaaaagcttttccagcagagaaatgattaaagatgcattttatggtaaggactctggctgcattctggagaaagttggagggaaataatactgggtagagtgggacaaatgaggagactgtcgcacatgttttcatagaagaagatgtttgcctgcatttgacaaatgataacattcttcacagctagtgcttttgtgtttggtgcactagacgttaaagttgtatactcttaatttcgtaaaatccatgtgtttatactgtgctttaactcaatgtttcccatattatatttctttaagaaaccatcctttttttctccttctcataattttataaaatatatattttttgcttcctgaatattctgaaatgtcttgtctgttcttgacacatgtatcttttctacattttgtcactttggtttctttttcaaatatgcctatagagagctcatgttgaaagagaagtaattatgtttctagtgaatagatcttggcatcacaacaggatagtctgagatttcctggaaagagcagtagaaagaaatttagtggttctcagaactggaaaaaaaatagcttaaagataaatagtgttcccagagggaaggaggcttgttgtatagcaatcaatatagtaggattagaaaagaccaacacagttgaaccccaaagtacaaaatgtaattaagggcacaaaagacacataatgcatgtcaagtttaaaagagaagctgagcaattacagagtgaagttcagaacttaaaagtgacagaaagagcaaagggggaaaatgacaaaaacatttcatgtaagactaaaagtgctgcaatcgtatatgtgatacaaaaggtcagtgaacagcctagaaaggtgtctaatggatagcaagggtaatccattgactggaagggtcttgtagacattgatttcaaaaagtaaaattaaatgattttttttttttgcctcagtgctctcaaaaagcaaagtcttgctaaaaagagaaatcaatttaaaatgaaataagtaaaattgttcattggaaatgttgccaatcaataggtggtaaagaaatcaagaaatctgaattctcatacagagccagccagatatgttttcttccaggattaatgctgtcattgtccaaggcaataattcatttttaggcttagaaatcctttctaagaaaatattatgtttttatgtttttgttcccaagtcaccaaattgtagcccattttaatgcttttttggctttctgtgtgtctgggtgtgacacatctgacccatacaggaggatatgtagaagtcctggcaaaagaacttcctaacctattaagcaatctctcctccctccctccctcccttcctttctgtctctctttctctctttctccctttctccctttctaactttctctctctttccttctctctcactttttctctctctctctgtcttcctccctccttcactcccttccttccttctctttttttctttccttttctttttcttttcttttcttttttttttctttttttttgcgacagtgtcttgctctgccaccgaggctggagtgcagtggtgcaatctcggctcactgcagcctctgcctcccagcttcaagcgattctcctgcctcagcttcctgagtagctgggattacaggtgcatgccaccatgcccggctagttttttgcatttttagtagaggcagagtttcaccatgttgcccaggctggtctcgaactcctgacctcaggtgatccgcccacctcagcctcccaaatgctgggattacaggtgtgagccaccgcacccagccttttttcttttctttttgaggaaatggtcaaatgtgcttgttgttatgttaagtagagatttggaagaatgcgcattgtttactctgaaaattgtgggagataaaatttcctaagggaacaccaatagttttttcttaattgcatattaaaggcaatattcaaagaaagggtaaactggatgcagtagtagaggggtttcctgttagcctctcagaaagatttagaaactaagaaattctgactagctgttgtaacagacaaaccctgaaatctcagtggctttagcacaacagacatgtatttcttgttcatatcacagtctaatatgaatgggggatcttccttcattttgcagccacactaagggcctctgcgataagggtagacaaagatggaagtggctgcatagctcatagctgtcttggcctggaaccggccttttccctctgagccagttacatgaccccaacctaactgtgaggtagcctgggaaaagtaggggagtacctgggagtaattaatttgacattaactgtttttgccactagaaggaagttagttactgattctgtgctctatttccattgttcctggggagataaggaccctcaaagatggaggaggtagaagaaggtggtactgtctgtggtggaggggacggaaactgaaatatatcacaggaagtgacgagacccatagaagtgaaactggaaaagctggcctgaagtggtgtgcagaataagggaatggctgtaggttcaccatttccatgtaacctacaaagacaaaggttaactctgggactactaattatgctgctttaaatgtaatcacactgcttcaaatatattacattaaacgtacctttttggatatttttccattaactttaaacattttctaaatatacagaaagattgaaagaatagtacaatatgaacgcttgtatactcattaccttcgttcagcggttattcatgttttgccatatttactttgtatagctatttgtaagtatgtgaacttttttccgaacaccttgaaaatatgttgcagacataatatttaccataatatttcatataactgcaatgccatcatcatatctaagacaattttatattcatattatacccacacacatgataatataaccaatttatattcaatttatattcaaatttccccaattatctaaagatgacatttatctctctcattctctctctttttttcaaacaaagttcacagattgtattcatgttacatttctctagtgtcttttaatctcaaaatccctttatttcttttttatagcatttactttttgaagacatggcaggacagttgtattgtcccacattctggatttgtctgatttcttctgcatgctgtggttctccttgttcttatactctttggatttcttataaactaaaatgggtctaatggcttaattagatttaaattaaacatttttggctaggatattccataagtgatattcttatttcatgttacatcacaacagaaggcatataatgccaggtttttcactaaaatgatgttaaatttgatcactttgttggtatggtcatcaccaaatctcttcattgtgaaggtttatttttcactttacaattagcaactaacttgttggttaataccttagcaccttgtgagtatctcaacaatctttcacctaaatattttaaaatgcattgacgatctttgcctgaaataattatttcattgggaggtataaaaagtgtgatttttctaatttatatcattttttctatatttagtagctgacattgttctgtgaagaataactttgcctcatcaactgggactgaattacatttcttcttaaagaagcaggatatatttataatttaaaaaaattataggcaattttgaatatagagaaaaaccaaaatcatcagctgtaatttcaacagccagtgaactaatgttaaaaatgctatgtactatatctttccattcttttttcaatacagataaggatatatattataaaatttgattcataaatatatctagccttataaagggctggatatataaaatacattattaacactttacaatgttgttaaatatcctttaaaatatttttgctgactacatatcattccataacaacaatgtgacatactttattttcgcattctcttataaccagggaaccatataaccttgtttgcccagagaaatcctgatatatgaccattatcctgaaaaattaataaaataccctcctttactcctcatatcatacaagtttgggaaacaaattgtatggttacctttcctgtaatcacttaatctacaattgacaagtagctgttttgaattttccaatctatttgctcttatgaaaatttttgggtgcattcatgagggtgaattcaccctcatgttgtattagttcattctcacactgctataaagaactacctgcgactgggtaatttataaagaaaagaggtttaattgtcttatagttccataggctgtacaggagacacgtctggggaggcctcagggaacttacaatcatggtgtaagggtgaaggggaagcaagcacatcttcacatggcagcagaagagagagagctaagggggaagtgccacacacttttaaacaaccagatcttgtgagaactcactcactatcatgagaacagcaaagaagagatctgttcccaggatccaatcacctcccacgtggtcctttctcaaacactgcagattataattcaacctgagatgtgggtggaaacatagagccaaaccatgtcacttgtatttctgttaaataagtagaatgtcatcaattggtcttaacagatttatctgatttcaactttgcctactttattcccttggagaagggtttctcaacattgccactattaatattttggcccagaaaattctttgtttttaagagggctgtctgcattgtagtatgatttagcagcaaccttggcctctgtttcttagatgccagtagcattgccactctccggcgtagcaatcaacaacaactccagatattgtcaaatgtcccctgtggggcaaaattgcctcaagcgtgaaccactggtttaggaaaatgtgcaggaataatagcagcaacatccttcacatctagcttatttgtcttaagttgttgtgtttttgttgtaagaattgtttaggctggggatggtggctcacgcctgtaatcccaacactttgggaggccgaggcgggtggatcaactgaggtcaggagttcaagactggcctggccaacatggcaaaactccatctctattaaaaatacaaaaaaaaaaaaaattagctgggcgtggtgttaggtgcctgtaatcccagctactggggaggctgaggcaggagaatggcttgaacgtgggaggtggaggttgcagtgggctgagatcacacaactgcactccagcctgggggatctaacataacagaaatggtagatatttcttgctcaagattatatgaacaaaagtgacccaataggaatttaaaactaggcttgtctgtccccagagtcatatccacatgctacctgaagggcacaggtaagtactactctcatgcactagtcattgctaaacaggcaagcagtaggaaaagaagcattttctcttcagtgagttcttggcaatcatttgggaactaccatggtagttcttatgttttatcatttgtaaatggggtatggttgtgtagaatcaatgaatagaaacatgcaacttaggtcctggcacatagtaggtgctaaatatgcattcatttctagctgcacttgtactagggttatcttagccctctgctaatgagtctttgcagaactctaaggggaatcaaatgaagtgagacagagtatctttccttctttctaccttcaagagctgccctctctgctttcccttatgttgagaactcacacttagaagaaaagaacaggatgtgaacagactccaaggcatcccaaaatgaagcaagtacaatttaagtcacagaaagaaatgttggtccctctcatttccttctgtttcaaaagctgttcgttcataataagaaagtccttcaagctccagaagtagagcgctgcatatctagtttagttcaaggttgtttggggacaggttctaagccattatgcatatgactaaagagtcgggagaggaccagactgggaagagcaactttcacacattcttgtgctggagttaatccaccagcactgccagttgatgcctgagagatgagggggtgggaaaaagaatctggcagggcagactcttgaaaggaaaagcagagagataagatgtctgaatcacttttccccttgaaaacattacaccaggaaagaaaaaagtgacctggatcccaaatacagggatttctcaattattcttaacttattctttttttttttttaaaaaaaagtcctgattgttttcatgaatatattatgatacatatttacaaaatttatacagtttacgtcatgccataacacactggtgcattatacacatagaacactccagcagtttgctcaaaacattaagaaaccaggttctgttacatgtcgtttgtactaaagtcacaagcatcctcctcctctttggtcattttatccaaattaaaagaccttgaaaactattcacctgctgtagactcctcaggcagttgcttttgcaggggagatatctgagctcttttaaacaacttcttcaccatcaccactttcctgggcactgtgagtgttgtgcttcctctcctcctgctccttctcttcctgttttgggatttcttcagagtatgtctttttcctctattattttgtgaaacccaaagaccagaaaaggatgctgctggctaaacgagggcccctgatgacttgtacactgcgtgcattgttttttttctagttcttccagattaagcctcatgtgatgtctgtcccaatactctcattagaatgtggaggagtccaggatgtaggcaagtgacatttgtaacttaaaggggcacctattcactcagaccacagcagtacggcagcacctcctatatttgagcttctacctttttggtgtattccttttctctgcacaagcaaagcaaaaaattccggagaattactatagtttggggcagcaaattccagttttacctgtcaagcatcagcctgggaccagatgacactgggagcctccattatcttaacctgtttttaaattcaaattctcctttatgttttgtagtactctatggtttttaaactgttttcacaaatattagctctttaatcactataaaatgatctcaagaggcaagtcagacagatattcacatttcagaagagaaaatgaaacctgaagaagttgtgattttttttatagaattaagaatgacagaagatccttgacgcctacctctgtgctgtctgcacttcatcccaatgcttatgtcgtcccagacgttacactatttccctgcttttagactttttcttgttttgactgcattttaaactagtccatctgtgaatagtatttaaaagtatgatcatgtggttgacttccctcaacttcaatgtgatatttcagtgggcccactatgctgtttgaaatttgaatgctacccctgtttttgtttttcacttttgtgtccttgtgtaaggttgaacagagtttattgctgtatgtacatcccattttgagcttatgagagcttttctgttaacgagttaagtgttactgtgtttcaacccctgctaccctgtgtcaggacaactgacctcaggaatatattgctgagtcatatttaaaaaaaacccttgacctttctccctgtcaaagcaaacttgaacatatgacagtgttgtctaaaataggacagagttggaatttatttttcagtaaattatggataattgaaaaatagtgtattgttaaaaacagtacaatctccccctgcccactgccccactgtactctattttcttacaagcatactctaaagtggtggaaatgattttctttagctatcatgatgctattttaacttatgcctcttaattctacttcattttgcgagtctttcagaccaaaattattatttcttctaaactgacttcttatagtttatcattcccagttgaaattctcattgtctccctcctttcctcccttcttacccacctttcccctcctctttctcattctttctttcaattatccctgtctattctttcatctatatctactgtctgtccatccttctgttcatgcccccattcatccatttatttggctttaggtaatagggaagcccattattagcatgcataattgtcaaagaacaatttcaaaatttgaagtttaaaagtcttcttaaattgggtatgtttaagtgagtttgggattggcctgcccatcccaatttaaaaacaatttttagagacatggtttaactatgttgcccaggctggtcttgaactcctgggctcaagcaatcctcccacctctgtctctcaggtagctggattgcaacatcactctgggcatgccactccaatttcaagagtgtttcatcataacaatattatattattatcccttaaaatataatcatttaacctagtgctcacaatttataggacattgtgtgatgacaaaaacaaagacagcctttgcttaagagattgaaacttaaagtcagttcagagtgtgataaaaatgggtttctgtctccatcatggtatgtttttaaaaaatgacctttatgatttcagtgactatgccatttcagtcccgaccacttttctccatgattgagctggtcctacatcagctgtctcaagattattccacactgtaaactctaaagggaaatggccattggccaaggagcttgctttcagcaatccaaagagatgtcttactttctaagagacaaccctacctccctcttgtgaaagacattatgaggaatttagttgactcagagcaaagttgttagagagttgttgttaaatgataagatatattctttaggagatgatagagatgttcactaaaggaagaaaggtagtaatggctttagtctgctgagctattatttgtggaatattgcatatttttcaaacataataggtttcctgtgttttgttattgagaattgtgtgtatatgtgtgtgcatgatgcaaataataatttttttttttttgagacggagtctagctctgttgcccaggctggagtgcaggggtgtgatcttggctcactgcaacctctgcttcccgggttcaagcaattctcctgcctcagcctcccaagtcgctgggattacaggcatgtgccgccatgcccggctaatttttgcatttttagcagagacgaggttttgccatgttggccagggtggtctcgaactcctgatctcaagttattttccctcctcagcctctcaaagtgttgggattacaggcgtgagccaccacacctcgccaataatgttttaagcccagaaaaattcatcttaaggtaacctaccttatcaactaagaaatatctctcctgaaagcgctcacactttgtgcgaaacttgtctattgccctttgttgagaaattaggatgaaaaagttaatttttagagagatattcagagttataacaccaaagccctgtttgtgggttcaaatgaaaaaataagagctagtaatgatttatttttactaataactttaaagtattctaaacggctttattgagatataatttacatttcacaaaattctcccatttaaagtatgcagttcagtgcttttgaatgtatatacagagttgtgaaaccatcaccagcatttaattttaggacatttttgtcatgccaacaagaaatctcgttagcattcactccctgtccctgtcacacccagcccccagccctaggcaactactaatctgactctctctgttgattttcctagtctggacatctcacatgtatggaatcatacaatatgtgctctttgggactggattcttttactaataactttttgtgattatggaagttattctaattttagaagtttttaacagatagaatgttcaaagaagaaaattaaaacgacttctaatgacattactccaaagaaaacaagtttaattatatcgtatgttgcttttcagatttttttctatttatttgtttatttctctcattaatttgcttagcaacatctattgagtactcagtatggatcaactacagtgctgggcactgggcatgccagatacacaagacaaacagcttacgggttattgaggaaataagtaataaccatcacagcgagtgctacaaatgataaatacagactgctcgtagtatacaatggggacttaatttaattttctctaaagaaattattcaatatatgcctatttatatgtattataaataattggaactgtattcttaaaactatatcatgaatattctctcatttattagttctttgagactgctatttttaatgacttcataattttctgctggatggatataccaagtttattggaaatttgaatatttcctcgaatttaaactgctcataaatgacattcatcctgaggtttaaagtagaaaaaagcttacatgtggaagcaaatgaacttatggccaatatttgccaattaattccttcgaatatatatgtagctttaagatccctctagaatcaggacctaagatttatggcttctgaagataaaggtgttcacagcattccttgtttaataactactctcactgccattgacttaagacatttgggaaatctcagagaaatccagtagaaaggatggccaaaaagagctctgaggggatttcttggccctctctggcctccaaagcactttctaactattctcagaagagcctggagagattgtcaataagacagggacaggaaagttactgttgaaaactcttagagatgctgatgatagaatcgttgatgttcaagaaatattttttctttgatgtttatgagtttatttgctttctacttttctttttcaagccttttgcttcttctgctttttgcatgacatgtcctctatttatgtgaaatccttcctgttgcatgcagtcagatcttattgtcagctgtctcccccggggtcaaagacatccaaacataaatcctctcttgtcggcctcttgcttttctcctaccctttgtgttttgccattttcttcccgccttttgctttcccgcttttgtttttttggggctgtttgatccacctccactccttttttttaggtcataaagtttttttttgtcactgactttttttgggtcacaaggtctttttttaaattcagtggtatagctgtcccccttttcaatctattgtgccttggtgttctctgctgcctctctttctctctctctccctccctctcactgtgtgtttatttaatatgtgtttcaccttagctctcctcatttgtgatcctgaatttgtgcaggagcgtctcacacattctatatagtctcggaaagggcagacaaattaaaagaaaaggattgagactgaaagaaaacattgaaatgaacagagcagctattgatccttgatgaaacaacagctccaaatgtagattcactttaaagaaggacaaactgaagaggaaatttctcaacatattgctcctattaagaagttccctaccttaagtccagagattcatcattgttttgaaggaagacctctaaaaataggctagttatagaagtatgattatttagagagccacatgcaattcttcccatgaacagaattgataattttagagacttataatgggagatactctaggatgcagcagctaagagccactttgaaatagattttaaatgatagattttaaaatttaaatacaccatatgacaaaaaatcgttatttaaaagttcttaccccagcttgcaggaagagatggtcaaagagcttatttgacaaaacttgttgggcgactgtgtgccatgcattgtgctggatgctgggaacctgtaggtgaatcagcatgcacggtgcctaccctggtcataatctaacatagaacttagattcattctcccatcagttcatttatttattcccttaatataaatgaacaaagtcttaaaccttgacctcatgtaatccacagtctgagtgtagcttattttttttatttttaattttttttagtaagacggaatcttgctctgtcccccaggctggagtgcagtggtgcgatctccgctcactgcaagctccgcctcccaggttcacgccattctcctgcctcagcctcctgagtagctgggactacaggcgcccgccaccaccacgcccggctaattttttgtatttttagtagagacagggtttcaccttgttagccaggatggtctctatctcctgacctcgtgatccacccgcctgggcctcccaaagtgctgggattacaggcgtgagccaccgcgcccggcctgtgtttattatctatgggaactcaggctttagataaggaatttggaaactcacatcttaaatctagaaagaatggtatttctgcaaagatagatgatttcagattgatatacgatttttgaaataaccaagaattttttatagtggctctattataattggaaaactgaactgaataatttcttaagcccctttcaattatttaaaaagtttttttaatactcgacattgctaatcactagagaaaagcaaattaaaaccacaatgatatattatctcacacctgtcagaatggctgttatcaaaaacacaaaagatagcagtgttggcaaggatggggaaaaaaaaaaacccttgtacactgtgatgggaatgtaaagccattatataaaattctatagaggttcttcagcaagctaaaaatagaactaccatatgatccagcaatcctatctctgggtatgaacccccaatatttgaaatcagtttgttgaagagatgtctgcactcccacgttcattgcagaattactgacaatgaccagttatggaatcagactaaatgtccatcaacagatgaatggattaaaaaaatgaaataagtgttcagccttaaagaagatagaaattctgtcatctgcaacaacattgatggaattggagaacatcgtgctgagtgaaataagtcaggcacagaaagaaaaatatctcacattcttacctacatgtggaatctaaaacagttgaactaacagaagcggaaggtagaatggtggttacagaggctgaggtgtgtggggaatgggaagataatggttaaaggtacaaaatttcagacaagagaaatatgcttgcttttttttttgacatctatcatgcagcattgtgaatatagttgataatagaatattgtatatttcaaaattgctaagagtaaagttcaaatgttcttaccacaaaaacattaagtatttgacgtgatgaatatgttagctagcttgatttagttattccacatgacattcataaataataacatcatttgtaccccataaatttatacaattataagttgtcaatttacaataaaataaacatttacaataaccaaaaacggagaaaatagtgaaacaacacacaaaaagtgaagagtaagagaatgataagctgaactgcattaatactgtggttttcaagttatgctgcaattaatattgccgagatgtattgtgcatacagtctaactatgagatcctaatatagttcaataaaattacttggattaaaaaaccttttctgattttatttatgtctattttatcagttgatctccatccatagggtccatgtacctgaaagacagatactcagagaagataaaattacagtttctgtagcaaaacatcatattttcttttcagtcttaacaggtaccccaaaattgtactggaaatatggtctgggtttgtacttatagatcagtgtagttcttttgactctaacaattcacttttattcataatttaatatttaaatcaaaagtctgttgttgcctttgcatagtctaaaatgaactgcttagctggtgcaacccatgtgttttcctatgatgtgtgtttaaagacactaattacttaatgaagtaccaaataatgtgttccaaataaaatttattttggtgaaagagagattctcagattagagggaaggagtccaaaaagaaatgaatcatgcccattcagtgtctgttatgtctctgtttttcacttggatgccatgttagcatttcctttggggcctgtagagtatctgagtacttcacatgatgaccgcactgactcatctggaaatgtaacacatttttacaaattgttgtcactctcagaattttggtgtgacagacaaatgttggctgaaagataagtatataagaatatagatcagctttgagaggctcagaaggtggatttaaagtatacagctatcaagtcttagctcataatttttggttcaaacaaatgtgaagaagagacattaaacaagagccaaccagtacagagttcttttttatattaatagtgacaaggggactgggtgctcatggcccactccagtaacgccagtgctttcggaggatgaagagggcgaattgcttgaggccaagagttcaggacaaacctgggcactatagagagactccagctctacaaaaaaaaattttttttaaattagccagctgtggtagccaggtgtgatgcctgtactactagctacttgggaggctgaggcaggaggattgcttgagcccagtagttcaaggctgcagtgaactatgattgtgccactgcactccaggctgtgcaacagagctgtaattcaaatagacaatgataatatggcagtcctttatatagcattgatttaaaattagaataagattcaatatactcatcatacaatgaagagaagagccaataggaaaagtataattttctcttcaaaggctcccttttgtatgttggattggaactccttgtctacctctagctgtgtaccaatcaagattggtgcatagcattcatttccaagtgagtggctggcaagtttaactaggaatttaaatctaactagagttgttttagatgtaaaaaagaaaaacatatttttgtttgtatcttccatttgagataagcttcaaatttagtattagccctctgatatattctacaaatcaagctggttttgttcttaagcttttatgttatagggcagtttattccatccaattatctagtaccaattggtaaagctatggacaaagctgcactttacaaatgctcagattttaaactctatgaataaaatatctaactatgaatttgagaagccaagtgactgcattgtaataaacatgattcctccattaaaatagtgtataccggcaagtggatttgtggaatgtgttatgccagttcatttaattcagactccacatgagctttgcctcaattataaatgttggctgtctgtataagccactattggacttatcccttctgtttaatcttgtctgtgtagttgagattcaagtctctcttcagttgcactggacagaagatttgacttccaattctggatttgctatttactaaccatatgacattgagcaagtattttatctcaggctcaaggttctcatatgtgaaatgaacctaacagtatcatccttcttaattgatagagtcattgtgagaatcaaatagaattaagataatggatgaaaaagtcccgaatactatgatcagcccaagtaaattagtaataataatgaagtaggcatggttagcaaacacacaacaaagtgaaactcatggcataaaatatctgtgggaaatgtaaatatgggatatgattccatagctatttctttcccatccctctttggctagttagctctgcatcagccttcctcaggagaatcttaccaactgccttctcctctactcctactccattacaatgggtactacgtgtattacctccaatatactcttatgatcactacgcttcatagtactacatccaatatctacttgtgtgcatattatgttgtctctctcattagcttcatgagagtaggaacttgtttgttttgctcacatactttaacatcaatacactgtgtctgacaccaaatcattgttgaatgattgttggataaaagtttcagctgttaatatgcttatctaaatcaacttcagacactaactaaaaattggattcagaaaatgctaaaaaaaactcaagaaagtaatctacagaggtgaaggcatagtcagtcattctagttaaaatgggattaattttgcttagtctaaacccagatgcagactgccatcttttgggccttcggctcggagtaaacttgattcttttaatattacatgaaagggatttctggttttagtactctttattgaactgcagtcagtcatcttagatgttgaaaatctgcttgtaaataaattttgagtcaatttttatttttcatttataaaataattccttaaagtagattatatatttagggagaaatccgtatctcaacgcttttattttttacgtgggctgtgcttatttacatgagcacattttcatttattgaggccaagctatagcacatcaacttgattgctctgtggacttagcacaggactcagaagctaatgagttcctgtcacagccctccacataacttttcgtggccttctgcagtcagtaagcccttctggacttaatgtcctagctatgtagttgagattataatatgagtttctttaatgcctcacttgaatgggaagaggattaatgaatagtctggcttgaccctaatggcgagaaagaaataaatcatttgctttttaaggggttcactaactctttgaagctagcagctatttagtgcttggaaagataatttattaaatgaccccaggctagccttaaagatgtaatgcacatccccaaactgagaaattgtccacttcttactggcaaaaacaggcatcccatcttttaagagtgactttcataaaagtgcattagttatatcactttgttaatcccttgtaaaaataatgctggtgaaattgtactgggaatatattaaaataaatttaatagatgatattttttaaataagaaatactctgctaggctgattttatattattctgcatttgtagtttttttggataaaaatttcaagcagattctaaaaatcacatgtgcttttatcgtagctgtgtttattcaatacccctgcccatccatagcctttatgtatatttttaattaactgatataattaccgtgtaaaagtctatgaaacatgtttgacatttaaaagaagtccctatacttgaaaagttcagaaagtaatgtccaataacaaatctaactatatttagaatacaagtctgactacatttagcatttctgttcctgactatagcaagatctaaggcaacattttgaatttttcccaaggtttgtgccattttttcttttctttttcttttctttttttctgagacggagtctcgctccgtcgcccaggctggagtgcagttgcgcgatctcagctcgctgcaagctccgcctcccaggttcacgtcattctcctgcctcagcctcccgagtagctgggactacaggctcctgccaccacgcccagctaatttttctgtacttttagtagagactgggtttcaccgtgttagccaggatggtctcgatctcctaacctcgtcatccacctgcctcggcctcccaaagtgctgggattacaggcgtgagccacagcgcccggcctaccatttttctttaactatttttgttgttgttgttgatcagaattgggttcagagattagatatctttatttttttcttctaacttctcaaacagggacttttatcaaggcacattaagaatttatgagatgcactgaatttagcaaatagacttccacagaatgcctggctatttaaggtttcccataatttttatatcttgaggcagtatatgtgaatttgtttagcatagtcttgtagctccatagtgatgttcagtaaatttgagttttcatttcctgtttgcctttaaaatgtatcaggaatgcgatattcatattccccaactggccaaatagcctatagtacatgacctgaataagtctcatgtctctttctctctccttttgtctttttcaatttttgtacccatatcactgctctgtcttcaatcttgatttcttttcactggcatataaatttttatctcttaaatctagttggaaatttatcttatcaaatttgagaaatacagtatttttcttattttcctagaacatccttggactttctgctgcattttaggactcttcaaggtctacttacttttagttttttcatgactgtctggtgtgcgttagatgtccctcatctcagattttatagtgatattgtttggctgtgtccccacccaaatctcaccttgaattgtagctcccataattctcatgtctcatgggagggacccagtgggaggtaattgaatcatggaggtgggtctttcccatgctgttcccatgatagtgaataagtctcatgagatctgatggttttataaaggggagtttccctgcacatgctctttcttgctgccatgtaagatgtgtcttgcttctcctttgtcctccatcatgattgtgagacctccccagtcatgtggaactgtgagtcaattaaactctttcctttataaattacccagtctcgggtatgtttttattagcatcatgagaacagactactacacatagaaatccatatgaatctttaccagtatttaaaatactatactttaattgtaagccctataatctgcgtcattcactagactgtgggtcttagggactgaggttctcaggcactgtattttgtctctgtaacacagggcttagcacatagttagcattcaataaataaaattccatttacttccttgtgttagttcttaaatttatgaaccatggtgctttggaggatagataacttacatcataactcttatatctgcctcctctttacaaatagttttctcctataaattactgggtatcttttccattgtgagtcttcttccagtatctcatgtcctccaaagtaaccattctattttcattgttttaaccaaacatttttattttaccactttcatttcctatttaaagcctttccgatcaaagttgtgaatttgtgggcaaacatattgagtcttctagttctcaaaagatgagtgtttgtcccaactaaaaaatttatgtttttgatatcaaacagtttcagaaatacgaatcacactgcataatctcataatcattcatttctcttactcttttctcatcccaaactcaagctttcagtttgaataaaaaaatgaaaccttactttcccaagtcttgagttttctgttagcaaagatatttatagatattccttcatagtagtttttatctcagtgtgaagcacgaggtgtggggcatggtctgtggatatgcctgagaaaaatcaactgcttctgaaggcccatgccagtctgtccaagtcatttccattcccctaacccaaatccaaattccatgtactttcactggttcccagctttgtcattgtcatcatgacgtgtatttccttttaattctagaaaaataatttacatagccttcttcagaaggtctagaaaaacccactgtgggtcaacatctcaaaggtgtggcataggtcaaatgatttagcattttttcactctcttccctagattccctaaattattctctcatattaatatactaagaatatttcatttattcccattctatttgtaaccttttcttacataaagaaggaagtctccatttcatctagattttttagtttgtttgcatagagatgttcataatagtctctgagaatcttttgtatttctgtgggattggttgtaatgtcatcttgttcatttctgattgtgcttatttggatcctctcttttttttccttcttcatctagttaccagtctatcaaacatgtttatccttttaaagaaccaacttttgattttattaattatatggatttttgtgtctcaatactgttcagttgtactttgattttagttacttattttcttctgctagcattggggttagtttgtccttgttgttctggttcctctaggtatgatgttagaatgttaatttgagatttttctaaattttgatgtaggtgtttagtgtgataagctttcctcttaccattgcttttgctacatcctagaaattttgggatgacatgtctctgttttcatttattccaaagaatttttgttgtttctgccttaattttattgtttccccaaaagtattcaggagcaagttgtttaatttccatataatggtgtagtattttggtattgatttctatttttattctactatggtccaagagtatgattggtatgattttttttaaatttattgagacttactttatggctgagcatgtggtcaattttagggtatgtttcatgtgtagatgagaagaatgtttattccatggttgatggatggaatattctgtagatatccaattgatgaagtgttaaatttaagtccagaattttcttgttagctttctgtcttgatggtctatctaacactgtcagtgggatgttgaagtctcccactattattgtgtgactatctaagtctttttgtaggcctagaagtacttgttttgtgaatctgggtgttccaatgttgagtgggtactctattcacacaaactaaaaagtatacagaaaatggttaaattcttagaaacacacaacttctcaagattgaatcaggacaaatgtgataccttgaacaaaccaatattgagttctgaaatggaatcagtcataaaaaacctaccaactccccaaaagtcctggaccagacagactcacagctgaattctaccataggtacagagaagagctggtaccaattctactgaaaccatttaaaaaatcgaggaggagggacttctccctaactgattctataaagccagcctcgccatagtaccaaaacctggcaaagacacaatgaaaaaataaaaccacaggtcagtacccctaataaacatagacacaaaaaaattctcaacaaaatgctagcaaaccaaatccagtagcacatcaaaaagttaatttgtcacgatcacgtaggcttcattcctgggatgcaaggtcagttcaacatatgcaaatcaatgaatgtgatcaaccacacaaatggaaataaaagcaacaaccatacaatcatctcaatagatgcagagaaagctttaaataaaatctaacatcctttcacgataaaaactctcaacaaactaggcattgaaagaatgtatctcaaaataattagcaccatctgtgataaacccattgccaacatcatactgaatgggcaaaagttggaagcatcctctttaagaataggaactatcagacttagtgacatggtaaaaccccatctctacaaaaaatgcaaaaattagctgggcattgtgcctgtggttccattctacttggaaggttgaggtgggaagatcacttagcctgggaggcagagattacagtgagccaagatcaagccactgcattccagcctgggcagtgagacacagtctcaaaaaaaaaaaaaaaaaaaaaaaaagaataggaataggaaccagacaaggattcctactcctcttcaacatagcacagaaagtcctagacagagcaatcaggtaagagaaataaattaaagggatccaaataggaaaataagtcaaattatctctctttactgacaatatgattatatacctagaaaacccaaaagactccaccaaaaacctgataaacaacttcagtaaagtgtcagcatacaaaatcaatgtaaaaaatctgtaggatttctacaccaataacattcaagctgagagtcaaaccaagaatataatcccatttacaaaagccacaaaaatatataaaataccaaggagtacatccaatcatggaggtgacggagctctccaagaactacgaaacactgctgaatgaaataacagatgacacaaatggaaatacattccatgctcgtcaattggaaaaattaatataattaaaatagcaatactacccaaagcaatctatagattcaagcctgttcttatcaatcaacatcatttttcatagaattagaaacaaactattctaaagttcacatagaaccaaaaaggaacctgaatagccaaagtaatcctaagcaaaaagaacaaagcttgaggcatcacatgatccaacttcaaatgatattataaatctacagtaaccaaaacaacatcgtactggtacaaaaacagacatacagaccaatggaacagaagagagaacccagaaataaacccacacacctacaactgtctggtcttcaacaaaatcaacaaaaataagcaatggggaaaggacttcctattcaataaatggtactgggatagtttgctggccatatgcagaagaatgaaactagacccctaccttgaaccatatacaaaaattaatgtgagatggattaaatatttagatgtaaacctcaaactataaaaaacctagaaaaaattctaggaaatgccattttggacactagtcttggcaaatagtttatgactaagtctttcctcaaaagtaatttcaataaaacaaaaaacaagtgagacctagctaaactaaatagattttgcacaacaaaagaaactatcaacaaattaaacaacaacacacagaataggagaaaatatttgcaactatgcatccaacaaaggtccaatatctgaaatccaaaagtatcttatagaactcaacaagcaaaacccagataaccccattaaaaagtgggcaaaggacatgagcagacacttctgaaaagaagacattcaaacagcgaaaaaagtatgaataaatgctccataccgttaatcatcagaggcatgaaaatcaaacccataatgaaataccatctcacactagtcagaatgacttattgaaaagaccaaaaataacagatgatggtgaggctgcagagaaaagggaagacttatatactgttggtggaaaagtaaattagttcagccactgtggaaagcagtttggagacttctcaaagaacttaaaacggaactacaatttattccagctatcccattagtatcccaaagaaaaacaaatcattctaccaaaaggacacatgcactcatttgttcatcacagcactattcacagtagcaaagacatggaatcaaactaggtgcccattatcagtggattgaatacagaaaatgtgaataaagaaaatattttccatatactgtgaaataccatggaatactatgcagccataaaaagaacaaaatcatgtcctttgcagcaacatgggtgcagctctaggtcatcatcctaaatgaaatgatgaaggaacaaaaaccaaaatattgtgattctcactgacagctaaacattgggtacctatggacacaaagatgggaaaaatagacactgaagactactagagaggggagagggggaagaggaaagagctgaaaaaccactctattgggtactgtgctcactatttggatgatgggatcattcataacgcaaacatgagtatcatgcaatatacccatgtaacaaacctatgtatgtatcccttgaatctaaaataaaagttgaaattataaaaaagggaaataattatttacactgacaaactgggggatagagcggtatttccctagttacagaaaacttttgtatactgaggcaaagaagataatgattttgccctaatttagaactttaatgacaggcttccacaatgattttacatgtacagatttcaaattagtttccagtattgacatcctttacttggtcctttatataaaagatttatattttttagtagaaacaaaaagaaaagaaaaggtatatatctatggttgtgtctacattttatctgtaaaactgaaaatttcataaatatggggttagcatagtgattgaggtataaattttcaatattcctatgttctatgcaatttttaatgttttttattgacatacatacaaagaaaaatatacacatcattatatgatagcagcttgatgaattattgcaaaataaacagatccatgtaactaccacaaacattaagaaatatatgttattggtcccccagaatccctttaatgccccttcccaattactaccacttcccctaaaggtaactattattttaacagcagtgcttgcttttccctgttttttaatgaccaaaagtaaaattacaaatgtgagaatttctcatttgtggaataaggataaccttggggaaaatggaaatactgtatattaattattttaagataactttatgacacacaagcatgtatcgagttactttgccgatttagagttataaaaatacttgtgtagtttgattatctcataaaagttacaaaaatgaatctttaaaagtggaaaaaatgataaagattagtaaaaaaaatcccctcactgtttaggggcaaaatacaaaacataactaagcagcaaaatgtagacaaaaaaaatctctctttaaaaatatcctacatttcctcaggtctttgcatattcagcctacacatatagtggcaggatacactacagacctggttttccagctttcacttttggtgactcagagcatattccatgttggattagcctgaccgagtattattgtcagagtagttccatggccgtttatgtagacacaatctttttctctcattgcaacctaagtattatgacaggccaataattctttcagcatgtgtgggaacttgatttaccaatggacaatttgattacagcacatattacttgagaggtttataagagtgtgttagtgctttctcacactgctataaagaactacctgagactaggtaatttataaagaaaagaggtttaattgacacatagttccacaggctgtataggaggcatgactggggacgcctcaggaaacttaaaatcatggcagaagggtgaagaggaagcaagcatgtcttcgcatggctgcaggagagagagagcaaagggggaagtgttacacacttttaaataaccggatctcgtgagaactcactggctatcacaaaaaaagaaaggggaaatctgaccccatgatccagtcacctcccaccgtaacatatggttggggacacagagccaaaccagagttagtgcattttttgaagagaatgtgattcaagtactgagatagtgactccacaactataaattattaatatgtattaacactatccaggagaagtgttaattggcctgacttgagagaagatttgagaaagagttgaggtaaagtgaaactatacaggaatatctgtgtatttttgtaaagattcctgtggctgtattacttcgaataaaacataatgacaatagtaccttttgttcatgtaacactctaattgtcagagtatgtttatcttatttaattctcagaataactctgtgacgtaagcaaggaaaatgtgagtcagataaggaaattaaggctcatgagcggttgagtggtttgaggcatggcagagcaaattgctagctcagcaaggcggagcccccactcttaagttcccagtgcgaggcctattacattacaatactgggacttattcaaaaaatatgctaaaatcctatttgagccatttttgtaatattaatttttctaagtccatttataggtgaaaagaatataaatttttattttaagaaagtgggtactgttgtggagtagggggaggggggagggatagcattaggagatatacctaatgctaaatgaccagttaatgggtgcagcacaccaacatggcacatgtatacatatgtaacaaacctgcacgttgtgcacatgtaccctagaacttaaagtataataataaaaaaataaacaaataaaaaagaaagtagagatcttgaaatatatctttattttcttcatgcatgattattaattgagggtccatactgtagttggcactgtaaatgactaatttcttgtgagttcagacttcccatgaggccatgttaaggtaaaacgctgctggctaaaaacatgctgccagatatacaggcaaaaatgtttttctgtcctttgatcagtgtttagtcttattcagctaaatctgtgccctcctctgcaggaaaacaaggtctatcaggcacagaactgtcactgactttgaaacaagtagctctgtactcagagaagcttcatgtgtgtgtatgtgcatgttgtgcgtgcctgtgagtgtgcatgtgtgtgtagtacagaatttgaccatttacttggtgcatcaaaattgcggcctttcttctgttgcttttgttaacaaaactattgttggcacgtcactgggtaccatgtgctgatttttacacttgcttttagggcttgaatctatcttatgcattgtttcatcacaaagaacttcagtaattttattctcattgtatttgaattatcagctttgtatgtgtgacttgaacttgttagattcatttttagcacatgtgtgcctagacagaaagcaggtttttaaaaagaactatggaagttaattattttgctgtataacgctgttttattaagcatttggctttggcattattcattggcatctgtcatttctctatgcctgaagcttttgattcagataacaattcatcagataagcataattactcagcaagaagcctctgtgtaagaacctggagtgtaaactatttcagatgtcctttggggtgatatggcagtttaccggagactgacaaaaccaacataaactctccttggcccatgaaattcatgactgcaaggtttacttgatcatgtttctttcaatataatgagaaagtggatttgaaaatgctttgaactttatagaatgcttagcaaacataaaagtattgctatcattatcagttatgcttactggaatgctccccttaataatgtgagattaccttgaaaaagtagcaagatctgctatctttagttttgtgcaaattatgggaatgtagtaacaatctctgttgacaaagaaatatctgatttattatctattttgtcactgtcttttaggctttcagcacttggcaaaggagagtgagattgaggaggtatagaggaatcaagatataggagggaaataattcctggagaggcttttactgaaatgtgctgggaagactggctctttgtctctccctgaccctattaatctgtacttgtattatgcctttattatgtttttttattaatgttcattggagttggatggagttttttactaaattaaatcttctcttctgaagtgatcttatatatcaatacaaactactagttttctaaggttcatttagtactctgaaaatacgataggatgaggaaagaatcaactgagcactttattaaatgcgtgactttgccttaagcatattgtgtatattgtaatattgttatggcaaccctacaaattagggcaagttatcctcaatttatgcatgagaacaaagaggtttcaagatgatacatcgatttgttcaaggccatacaactagaaaatgagagagttggcattcaagactagactccttggaaccctttactcatgcttttaatccttacccgcaatactgactttgaagtgaaatgctcattgatttgaagttttcaaggttctttcaccaaagtaactttctctgttgttaccaataattgtactgaagagcagaagtgatttgcttcaattttacaaaggaacctcagagtgtttgtatcagtcaaaatatctactgtaacaaaaatacctaaaatgtgtaatggttctaatattgtaaagtttatttccatttcatataaagttaaaaaatatcttgtatataattgacagggttggcctctcctacaagcagtgactcaagcatctatgttccttcaattttatggagcctccattttaaacatatggcttccaagggtgtactggcagaaggtagataaagtgatggtaaatattacttttgtttatcttccagtttttgcaggcaatagttttaccaaatgctttgccactgcatgccaagaatctccatctttcgatcctcagacattaatttcttattatttactgcctggccacaagtgacacatattttagatttttctcatagcagtagtccattttgatgcatgactttcagtattgattgtgatagaatagttgctcttattaaataaaccttaaaattgccatggtttaacatagtagtttatttccggctcacataatagcaatattgggttcacaatggtatacttgtgtgttagggatggtagaaatcaggtttaggaggactgtgctacacatggccatttggacatcttggccttcattggtatgccatctttagcaggtggctttcaacatcacgtgggcattgacagccagatagtggatgggaggggtttatgggcagggtctagtaataatgcctatcacttctgtccacattttgttacctagaactaagttagcatacccacacctaactacaaaggaggctagaaagtgcagtagagctgtgtgcccaggagaagggataatgagttggcggacagctattctctgccatagtgggtaatgagcatatttacactagctgcatctgtacatttgacaaagaactgagtgtgttcacatgaaatgatacagtattgaaaaatattcctgccctgaaataagaagagaaagagatagggtagtcaaagaggtaactagctccagctaaaagttcctgtgccttatttgagtatacaaaatatatttataaatacagttatgcattgtttaataatggggatatgttctgagaaatgcgttgtttgctaggtaacttcataattgggtgaacaccttagagcagggttccccaacccccgaaccatggaccagtactggtatgtggcctgttagaaactgggccacacagcaggaggtgagtggcaggcaagcaggcattactgcctgagttctgcctcctgtcaagatcagaggtggcattagattctcataggagcacaaaccctgttgtgaactgcacgtgcgagggatctatgttgtgtgcaccttatgataatctaatgcctgatgatctgaggtggcacagtttcatcctgaaactaccaaaccactcccttccggcccccatccatggaaaaattgtcttccacaaaatcaggtccccggtgccaaaaaggttggggaacactgccttagagtatttttacacaaacctagatgttataacctacttcacacctaagctatatggtatagcttattgctcctatgctaccaacctacacagcatgctactgttttgaatactgcagctaactaggacactgtggtaagtattcatttagctaaacatagaaaaggcacagtaaaaatatggtattagaatcttatgggacctccttcatatatgtggtttgttgttggccaaaacatcgttacatggcatatgactatagacaaaacactaggtaaacctgttttgagtatatttgctgatagcaaaaacttgactttcaatatattgcatacaattctatcatttgagagaggaagtgtacttatgatctatgagttctctcatcttgaaaataatccatatttgcaactggattaaattcatttcatgaaaaatttacatgcctgctgatttaaaaaacatgattttgatgataatgtgtacttttctttcactaagtatgtctgactttagtgagaaagagaaagactgcatagctttcattgtattattaaatagaaaatatttttgaagacttaagttaaaaaaaactggattagcatgcagatgttataatcaaatctaaaaattgctattatgttaaagaaaatagattaagacagttgaatgagtaccatattttcctatgcattttaaagaatgcaacataaggttagaatttgtaaaaaggaaattatgattaaatggactgaagtaatatcaaattttaggaaggttgtgctgctactccagtagttttgttatgaaggtttattgttggttccttggcttggatatatttaagattagatatgtgggaaagggaaagtttacactgagcaggtgcagtgtacatgcaccattatatctgacctactgggaaacatagacctaaaaccaggttttaagaaatattgaatgaatgagtgaatgaatggcaaatttcaggttatttagtgtaatatactgtcagaaatagaagtcttattgtatacataatcttaattttgaaaaagtcttaatgtatacataatgatctttttctagcaattttcaagttgtattcttatcctcctcctcaacatgatgaaaaccttggcatgctttaaatatccactgattagcatcctccttatcttgttgtgtagaaattcggttttgcatttttaaacacatgaaatatgttactaattttgtagtcattagcaattaaatccagcagtactcaaaaaatcaatttctgtggtattgtttcttgtgagccacacctgacctctgagtttattttctttccagatgaagtatattcttaagtaattatttttcttatggaattaaacattttttaaattgaaatgtatatatttaaggtacacaatgtattgttttgatatacatatacaaaagaaactgattactacaaactgaatatagaattaacgtatccatctcttcacagagttaccattttgtgtgtgtatggtaagaacacctaagatctaatctcttaggaaatttcacatatgtcttacggtactattaactatagtcctcatgctgtacattagatctctacaacttatttattctacataatgacacactgttccatttgcccagcatctccacctaccactccccccacactccaggaaatcaccattgtactctcttcttctatgaatttgacttttttagattccacaaataagtgagattatgcagtaactttctttgtgtgtctgatttatttcacttaacatgatgtcctccaacttcatttacattgtaacaaatggcaggatttccttctttataaaagtctgaataaaacacccacacacacacacggcaattttttttcccattcatcagtctatagacacttaggttgttcccatattttggatattgtgaataatgctgcaatgaacatgggagcacagatatgtcgttgacatattgatatcattgcctttggatatgtactcagaaatgggattgctggatcgtatatatagcagtacttcctttaattttttgaggagcttccatactgttttccataatgactatatcaaattacattctcattgataactgtgcaagagttcccttttcctcacattctcataaacacttattttttgtctttttgataataaccattctaataggtgtgaagtgatatctcattgtggttttgatgtgcatttccctgatgattagtgatattaaccatctttttacatacttagtggcaaactctatgtcttccttggaaaaatttttatttaagtcctttgcccatatttttaattgggctatttgtatttttgctattaagttctatgagtttcttatatattttggatattaactctttattagatatatggtttggaatattttctttcattttgtaggttgccttttcatcttatcgtttcctttgctttgcagaagtttgtttttagcatgatgtagtcccacttttattgtttttttttttgttgttgttgtctgtttccttgtgtgcttgtgatgtcatatgcaaaaaaaaatcttcatcaagaccaacatcatagagcttgttccctatgttttctcttagaagttttacagtttcaagtctcaggtttaagtctttaatccattttgagttgatttttgtgtatattgtaagataagggtccaattccatttttcttttctttgcatatggatatccagtttttccaacaccatttattgaagagactgtcttttccccattgtctgttcttggtacccttgtcaattattatttgacaatttatttgtgggtttctttctgggctctcttattctgttccactggtctgtgtgtctgattttatactagtatcatcttgttttgattaggatagctttgtagtataatttgaaatcagaaagtgtgatgttgtcaactttgttcttctttctcaagattgtttgggctatttggggttgtttgtggttctgtacaaattttaggatttcatttctgtgaaaattgcttttaaaaatttgatagggattaccaaaaaaaaggatgaatgagatctagtatttgatcacacaacagggtgactatagttaataatgaataattgtatatttaaaaataactaaaagagtgtaatttgattgtttgtagcacaaaagataaatgcttgaggggatggaaaccccattctccatgatgtgattatttcatactgcatacctgtatcaaaacatcttatgtaccccttaagtatatacacatcctatatacccacaaaaactaaaaattttaaaaattaaattttttgtggagattgcatttttacagagattgcctctgatggtgttttacaattaccttaagctgtcttcactctttttcatttttttctttttgcttttttgactgaaggatttccgatacttgtctttgagtttgctgaacctttcttctccttatctagtctgctgttgagcccttgtattgaaatttttcagttattgtattattcagctctatgatacctggtacttttctgttttctgtttctttgctggaattctcactttgttcatacattattctccttatctcattgagcatctttatgactttttgtttgtttctttgtttttttgagatggagtctctctctgtcacccgggctggagtgcagtggcgcaatctcggctcactgcaaactctgcctcctgggttcacgccattctcctgcctcagcctcccaagtagctaggactacaggtgcccgccaccacacctggctaattttttgtattttcagtagagacagggtttcaccatgttagccaggatgatctcaatctcctgacctcatgatccacccgcctcagcctcccaaagtgctgggattataggcatgagccactgcgcctggcctatgatggttatttttaactccaacaggcaaattacatatctcaatttcattaggtcaagtatcttgttcttctgtttgtcacatatttccgtttcctcattttcctagttggtttctgtgcattaggtaagacagccatctctcccagtcttcagagattctgggtgcctctcaaattatgtgctgcaaagagccatcttttttctcaatggtctcggaagactgaagtttaccaagtttcatcagtgctctgagacagtgagataggatccattccctagagtagcagctagaaaagttggagtattagatgtatgatccaattccttttctcttcatggagaagctggaagctggggtttattcccctctcagtcttcactgagccagagaggagagctgtggaaaatttctgtgtgctcattctgactgaatgctctttcaaatcacttctttgctctctgtcactctcaggggtctagtgaatgccaggccccatcagctgtcagataaaggtggctagagaccagcttctcaggtaacgaccagaaaagttgggatactagacaggtaggccaactcctagggagaagttggaggcttggttttattcccagagaaggagctctgggcatgccacatgcctgtttaaattcccagggcattagtgattgcctgtctcatcagctccaggagccagtgactttgatgctagattctcaacttccagagatatgcaagtttggagttaattccttgggtactagctataagagttgggtgctacatgtgtggtccaggttcttccagggagaagttgggggtttgattttatcattggaggaggccgggggtaatgtctcagtcaattgtgtgttgctataacagaatagctgagactgggtaatttataatgatcagaaatttattttctcacagttctggaggctgggaagttcaagataaaggcactagcatctggcaaaggcattcctgctgtgtcaccacatggcagaaaacagaaaggcaaagagacaaaatggggccacactcaccctttgataatggcattgccccgatgacctaatcacctctcaaaggttccacttgttaatttcaatgtgagttttggagaggacaaacattcaaaccatagcagtgagagaagccataggaattgcccacattcccctttatgcttccagaggactagagattgcttacctcatcagcttccagcacaagctagttaaaagccagaacctcaggcagatgctgctttgaagtgagaatttcctcagtcactttgtgtacaggagtctataaacaagcttctggatttttctcagatgaaactgatccatgtgtagttgtttatttggtgtgtctgtgggtggagggagaatcctgtgcctcctattctgtcatcttgctgacatccttactgagatggtttgttttatattctgtaagtcattatatatctgaaaatatatctttattcctgatgacagtttagctaggtatagtttttttattaaaagctatttttttcccctcaggattttgaagatattattacattgtgttttcagtctctactgtggctgataattccattgtaaaatctaattagtgttgtcccatggctaatctctgtttcttctctaatagatttgctgcttgttgctgatttatctatttcttcttgcaattctgtttgttcttgcatattgtattttcaggctatattgttagattacacatatattgatgatacacatgtattcactggtatataattgtacatttgtattgttcgatatctggcttggacatgtaaaggttaaataccatctactttcaattatggagaaaaaagtcatcagacgcaaccaaaggcttgaaattctctggcattctttatgtatgtcattgttcttttagtttcaggggtcagaaatctgcaaagtagcttaaaaaaattaggggctttattaactcaactaattgtaaagggcaaacatgacgctgaatgtgtctggaatcagggaactagatgattccataatacttttttcacttctctgcattttgacttttcttctaatgcattcaggactcttcacatgatgaggtcatggtctttgtcacttctaggattttatatgaagggctttgtaaccagctaaaggaaggatactaccttcttaccttcaggtagaaaattccaaggaaaagtttttgttccaactttggacatttgcccattccttgcccaatctcctgtgcccaaatagatgagtaacatcattgatctagtttgtttaatatggtagcactgtggtcaggccaaggggtagaatttgttaccaaaggaagggagaagacgtgctgagtaaataaaagcaataatcataatacctttttccctctttcccagagactaagaacatggcccttctttaattctaagcttgttctagcaatatatctttatctttgcctttatggcacttccttagtcttatctatgtgtatttaataaagttttatgtgctttcttagcatgttgtattttatagaatttattaccttgcctcacagttatagcagtgtatatcttccttattagactataatctctgtggtaaaggactgtgtccttttcattttttaatctttatttattcattaattcaatcatacattcattctactaatatttattgagtgcttcctttttgccagatattgtcatagccactgggcaaatagtggacattcaataaataaatgtcttcttgaataaaacttcctggatattctcagaaaatgtttctgttatgctactaaagttttgacaggctagttgctttcatttcattttcctgttattgtaatttaaaagcacaaagtctagagaatgacctttgaaatgttacacatgatgtgcatttcaagagaaaaaatttggattggcataccaacctcctcatcatgttttgaaatgtgatacttcagggataaggcaaaagagcaaagcaggccaaaatcctctccacagagagatgaactgcagggcccggcacatccctgttttcattaaaacaggtaacatacccattgtgttcagtcagccacaggctatttcaggatactttttaacaccttgaagtcactaaaataaattccactgcttctcaaggtatcaccaagtagaacaaaaggtagaataaaaaatggaagaaatgaaaaccccatattctgtccacttgttgcaatcataaaaaatgttttaaaatcaagtccctctttctaagacaaaataacctttctttagaaacaagcaactgatgttcccacacagcttgatattttcctgcagatcctgtgatgttaccaaaaacctgcataatactgtgtgtgtgtgtgtgtgtgcgtgcgtgcgtgcttgtgtgtgtatgtatgcacaagtgtatgagtttattaaactctgtgacacttacctacacattttcccaggacagctgtatatggttttgggaaaaataaagcatcatgagccaggaagctccttagaaaatcaaaagtgcactcattcatttatttttatccaatattttatctcacctttgtgattttatacatcctgtttcttatatgtatactgctccccttcttctgtgtattcaattaattttaatcttccaactataagtaacaggaaatcttcaactcacgtaacttaaacaataaggaaatgtatcatgaaacctagagtttcctggattggttaattcacatcttagtgacatcactgagatcctagattcttgctgtctcaaaattctttgatcctcagcatatcaacttcgacctcaagctgtttatctgatggtggcaagatggtatcacaaccagtcacaataatttcctgctgaaaaggatctatcttttccatgtgtctttttcagagtagagaaactatacccagaagccccaggagacttcccctcatagctcatttgccagggttaggtcacaaaccctgactaagccaatccctggagaggggaatggggttactacgatggctttgaattaaaagtatttactttggagtggtaaaagaggagggtatatactgcacaaaatctaggctcttccagcaaggaagaaaaggaaatttgatatgaagcaagtgttaagaacaaataacttagatcactttttttttttaaaaaagtagatttacttgcctttaataataagcagaataagtaagtcgtacctactaaattaggaatatcaattctttactcagcttctgtatgcactaacccatgtaaagaattacactgttcttgaatgtgtctctccctgaccactggagatagaattaatctttctattctgtgctatccatacatacaaacttgaatgagcatgtggagacacatattttagtttttggagagaacaaaactctaacaatatttcaaagcatcttttacaaacttttctctcttcaatgaacaatagtggcaagattacatggataaagacaatgagagtgtagaaggttttgagtaactgtctcaataattattcttcagatattgatcaataatgtgtcataaaacagtgtaaagaaagatgctcttttcataaattataaatatttcttctatagagagaccaaccttattaattaaaaaagctattgtcccagtgtgttttttatggaaagcctagaaaaaagaagccatttgtaggtgagcaaagaaaatcacttaattcacaaagatatcctaaatgcctttgttaaagacataagcaattttaaatgaacgaatccattaatatctaccagtggttaaatgtagcattctgtttatttatgtcagtaattgctgtaaatgataatgattcttcatatcgctagatatccaatgcattattcattcctccttaggctgagatatgagaacatcagagctattataggttttatgtagtgatttataggaagaatagattatttattaaaataatagacaaatattagagagacattgttgactcactatttttctgatgttttattaactttatttttttttaattttacaatttaacatcttcatgtggagctgaaattctaattagtgtgaattttagtgtccttattggagatcaaatacctaagcgtattgaacatataataatatcacctcttgttttttgttaactctttatatgggttagtgtgtaatgaagctgagtaaaggattaatattcctaatttagtaggtacaaattatttattttgcttactattaaaagtgagtacatctactgttaaaatagttggagacctaagttgttattggttgtaaatatccttccttgaatattaaaatctacttattttttgtcagtatctttggcaaatttttttaagttgtcttttgtgttcttgacttgccaatgtactccatttgttatttcattcatgccatcacctaagatatgatggagactcactgtgctaacaaaggcaggccattccatctaaagcttctacctgctaaaacatagataactgtttagtgctgcttctgattttttaaggacttacgcctgaaaatttcctgtcttaaaaacaaccaaccaaacaaacaaacaaatgaaaaacctagttattgaccttgcatcctgtattccatggttacagggtgagcgtaaagacagaatatctgagagctggctctatgtttttctttttcatctaactattttggttctagacacacttttgttagtgaagcaagagttaaggagcaaaaattctgaatatttttattttcagttcattaaagctttctgactcctcctctcctcacacacatgaatttatgttttttttaaaataattactctctaaattcatgtataaattctgggcttatttttagtaaggaaagggtacttttattttggattggagaacagctatcatagtattaaaattgacttcaggcctgtaatcccaacactttgggaggctgaggcaggcagatcacctgaggttgggagtttgagacgagcctgaccaacatggagaaaccctatctccactaaaaatacaaaattagccaggcatggtggtgtatgcctgtaatcccagctacttgggaggctgaggcaggagaattgcttgaacctgggaggcagagtttgcagtgagccaagatcacgccattgcactccagcctgggcaacaagatcgaaactcagtctcaaaaaattaaattatttcttagacatttgacttgtacactttttagcaagttgtatatatgtcatcaggttatttcaccacagaacatataaattattgctataactacagaaaaatgtcacatacatctgattatcacatgacagatttcatcttagggaaataaatgattttttaaaaaaataattaaagttcaagtatttctagttactgccaacacattaatgcacaattgagtgactccagaagactaaatatgaatgatggcagttgattttttgaaaatccggattatttggacagtcattttaaaattcagacacaaattaactcagtactttgttaattttacaatcgtgtactgcatgatgacattttggtcaaatgtggaccacgtatgcaatggtgatcccctaatattatactacgttgtttttactttaccttttctatgtttagatacacaaatacttagcattgtgttccaattacctacagtgttcagtacagcaatatgttgtactggtttacctagaagcaatgggctataccagtggtccccaacctttttggtaccagggactggtttcttgggagacaatttttccacggactttgggaggggaatggttttgggatgatccaagcacattatattcatttggcatttcatttctatttttacattgtaacatataatgaaataattatagaactcatcatcatgtagaatcagtgggaggcctgagcttattttcctgcaaccagacagtcccatctgggggtgatgggagacagcaacagatcatcaggcattagattctcataagaagcatacaacgtagatcccctgcatgtgcagttcacaatagggtttgcactcctatgggaatctaatgccactgccaatctgacaggaggcagagctcaggtggtaatgtgagaaatggggaacagctataaatacagatgaagcttcactggctcacctgctgctcacccctcactgtgcagctcagttcctaacaggccatggactggtaccatctgtgacctggggactggggacccctgggctatatagtgtagcctaggtgggtagtaggcgatctcatataggtttttgtaagtatactctatgacattcacacaatgatggaatcccctaatgacacatttctcagaagtgattcatgatgttaagtgacagatgaccatattttagacttggccaaaaatcatctcaacgtagagtaccttgccctcagagggttcatagaaatgatcacagtccattgagctctgagtcaactctgtagtagcccattcagattatttctttagaccccgaacaattaactggtcttagataagacattttctatgcagtatgtgtgatgcacacttttctgtaattgtttgaaagtgccaaactctatcttgtctcggagctactatagatgtggtttcctctgcctggagctatttttgccctatttgcaaggctagattcattttatatatcaggtttcagccaagtatcatcacttctgagttgccagtttttcactactccataagagttcctcttcctgttattctctctctttatgcattgttatttacttctctttacttgttgcaacttataattatgtatctgtttattgtctgttgtcccttcattcctatctctcagagactgaaaactccataggagcaaggacacataatagatactattaatagatatttattaagtatttgatgactgaatgaatgatcctggtgtcaagaccagaacctaatcctaggtctccagaatccctattattgtacattagtcactgcacatttacaataaaatatcaattaaagtatttcctatcttctacccatgtagaaaataatccttcacatgacctaaattcaaccactgtctaatttccatgatatatttgggaagcataacagagctaagtaattaaggcctctctatgaatgttattgaaataatacaatatcaagaacagtaggattcagaacagaaagaaaatgaaagcttttttctattgtaggaacccacctcttgcatcggtgtgtgctggatgtgaggcatggagtcaaagaagatcattttagagctttaagatttaatgactgccccactgggtttcagactggcatggggcctgtggcctctttgttttggccaatttctcccatttggaagggaaacatttatcccaaaataaagtttttttaacagttaaaaagtttctgcttttcaaaaaggctgatcgactctaaaccaatcaaaacttttgactttaagtcaatagttaccttctttaaagataaatcatttcttttgtttgtgcttcttttctctgaattttggaaaattaatagaataagagtaaaacatttgatatctgttcaattcagcttaagatctatttattttcatttaaaaacagaacaaaacaaaaattaattattcaatatcactccctctacacacacagacatatgcccatcctgcatttttttcaaacagaagttatcttggagacttacttcattaacttaggtgtgaaataattttcttgtctatatcaaggacagaatgacaaatattctcagattctcttagcaacaggcatttgatttgctgtcttgaatagagccttgtaaagtttcctttgtaggagaaataccatatttgaaaatgttgtcatattgttgttttagtattttcatattattattttattactaaataagtttatgtaactttagaaatagaaactggtatggtttggctctgcattcccacccaaatctcaggttgaattgtaatctccacatgttggaagagaggcctggtgggagatgattggatcatggagtggatttctcccttgctgttcttacgatagtaagtgagttctcatgagaactgatggttttaaagtgtggtacttcctgcccctgaccatctctcctgccactatgtaaagtgtgccttgcttccccttcaccttccgccatgattgtaagtttcctgaggcctccccagccatgtggaactgtgaggcaattaaacctattttctttataaattacccactctcaggtagttctttgtcacagtgtgaaaaaggactaatatggaaaaattggtactgggagtttggggcactgctataaagatacctgaaaatgtggaagtgactttggaactgggaagcaggcagaggttggaacagtttggagggctcagaagaagaaaggaatatgtggggaagtttggaacttcctagagactagttgaatgattgtgaccaaaatgctgatagtgatatgaacaatgaagcccaggctggggtagtctcagatgaagaggagaaacttaccaggaactggagcaaaggtcactcttcctatgctttagcaaagagattagcagcattttgcccctgccctagagatcctagacatggaactttgaattcaaagagatgacttagggtgtctgacagaagaaatttctaagcagcaaagcattccagctttttctgaagcatacaatcatgtgtgttcacaaagagattgtctgaaattagagcttatgtttaaaagggaagtagagcgtaaaagtttggaaaatgtgcagcttgattgtgtgatgagaaaaaagaaaaacccattttatgggaagaaatttaagctgcttgctgttagaatttgcataagtaaagaaaagccaaatactaatagccaagacaatggggaaaatgtctccagggcatttcagagatctacatggcatagcctcctatcacaggcctggaggcctgggaggaaaaagtggttttgtgggccaggcccatggccttgctgctctgtgaaacctctggacatggtgccctgtgtcctggctggtccagctccagttgtggctaaaaggggccaaggaacagcttgggctgttgcttcagaaggtgcaagccccaaacctgtgcagctttcacgtggtgttgggcttacagttgtgcagaaggcaagagttgagctttgggagcctccacctagctttcaaaggatgtatggaaacacctagatgtccagacagaagtctgctgctggggtggaacccttgtggagaaccttcattagggcaatgcagaggggagggcaatgcagagggcaatgttgcctaggggagctgtaagaagagggccaccatcctccagaccctagaatggtagatacaccaacggcttgcactgtgcacctggaaaagccacaggcactcaatgccagctagtgaaagcagccacagggactgtacactgcagagtcacagaagtggagctgtctgaggctgtaggaacccacctcttgcatcagtgtgtgctggatatgaggcatggagtcaaagaagatcattttagagctttaagatttaatgactgccccactgggtttcagattggcatggggcctgtggcctctttgttttggccaatttctcccatttggaatggaaacatttacccaatgcctgtacccccattgcatcttggaagtaactaacttgtttttgattttacaggcttataggtggaagggacttgccttgtctcagaacttggacttttgagttaatgctggaatgagttaagactttgggggactgttgggaaggcatgattgatattgaaatgtgaaaaggacatgagattttggaggggccagggacagaatgatatggcttggctctgtgtcccctcccaaatctcattttgaattgtaattcccacatgttggaggaggggcctggtgggagataattggatcatgggggtggatttctcccttgctgttctcatgatagtgagtgagttctcatgagagctgatggttttgaagtgtggcacttcccacctcactctccctttatctctcctgccaccatgtaagatgtgccttgcttccccttcgccttctgccatgattgtaattttcctgatgcctccccagccatatggaactgtgattcaattaaacctcttttccttataaattacccagtattaggtagctctttatagcagtatgaaaatggactaacacagaaaatttcttagagatcatctagtccaataccctcgtttaaaatttattttttaaagtaacataattaacattttttgaaatgtagttgaaattaacaaattgtaaacaaatatttaaataaagaataatttcttattttcttatttcattaaaaagaaggggaaatctacttctctaaatgtttcagcaactcttttattcgagggtctcatttttgcccccatttggattttccttaacatattttctaaatcctagctagagcacatctctgttttatcttgtttcaaataatgaggactttttaatacctaaattatgctatgttctatgagactatttgtggctttagggaaccaaatgtttttaagctttttttgaggtttagaactttgattttaataacaccagtaataaaaatgatatctggatttttaaaacaaagctttgctcacctctttaccacatctaaggatctttttctcttaatttcagattgattaatctccatctgaggtagcacttctgtttccctcaggccagttttggccaacgcagttttccctttgtcctgaggtggcaagccatttcctgtctcctttcctctctaaatgtttacactaaagccttttctaatttattgttacgctcagcaaatagaagcagctcagtaaatattaattgaatgtgaataaaagtgtaatttattgtatttttaccataaatgttatttattcaattttcaaatttatttggttggtaaacttaacgtatcatgtgactttattttatttcatagtttatcataacatttatcctataagtaaatttccttagtgttttatattttcctgaaaaccttatcaagtaatacaggaagaaaatgatatatatctgagggaacaaattgaaacttatctttactttttaaaacaaaatattttaagactcttaaggacagaggctttgctatttatttgttttatgatcttccatttcatctgctatacaagttaaataacagattgctattaaagtcttagaattcaaaaaatagaagatttgtattagactcatgttcctgatatttcggagcaagaaggaattttagtgatggtccaatctaaacttctatttttcagacaaggaaactgaaacatcagagactgttgcagctaatatagtgtgtgccatatacacatgcacaaactcacacacacactaatacaaatagccaatgtgtattcagtattttggttaataggtagaattctttttttttattttttattttattattattatactttaagttttagggtacatgtgcacaatgtgcaggttagttgcatatgtacacatgtgccatgctggtgtgctacacccattaactcgtcatttagcattaggtatatctcctaatgctatccctcccccgtccccccaccccacaacagtccctagagtgtgatgttccccttcctgtgtccatgtgttctcattgttcagttcccacctatgagtgagaacatgtggtgtttggttttttatccttgtgatagtttactgagaatgatgatttccaatttcatccatgtccctagaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttacagcagcatgatttatagtcctttgggtatatacccagtaatgggatggctgggtcaaattctagtcaaaatctagaaatttcaagttctagatccctgaggaatcgccacactaacttccacaatggttgaactagtttacactcccaccaatagtgtaaaagtgttcctatttctccacatcttctccagcacctgttgtttcctgactttttcatggttgccattgtaactgatgtgagatggtatctcactgtggttttgatttgcatttctctgatggccagtgatggtgagcattttttcatgtgtctgttggctgcataaatgtcttcttttgagaagtgtctgttcatgtccttcgcccaccttttgatggggtcgtttgtttttttcttgtaaatttgtttgagctcattgtagattctggatattagccctttgtcagatgagtaggttgtgaaaattttctcccattttgtaggttgcctgttcagtctgatggtagtttcttttgctgtgcagaagctcttgagtttaactagatcccatttgtcaattttggcttttgttgccattgcttttggtgttttagatatgaagtccttgcccatgcctatgtcctgaatggtaatgcctaggttttcttctaggggttttatggttttaggtctaacatttaagtctttaatccatcttgaattaatttttgtataaggcataaggaagggatccagtttcagctttctacatatggctagccagttttcccagcaacatttattaaacagggaatcctttccccattgcttgtttttctcaggtttgccaaagatcagatagttgtagatatgtggcgttacttctgagggctctgttctgttccattgatctatatctctgttttggtaccagtaccatgctgttttggttactgtagccttgtagtatagtttgaagtcaggtagtgtgatgcctccagctttgttcttttcgcttaggattgacttgacgatgagggctcttttttggttccatatgaactttaaagtagttttttccaattctgtgaagaaagtcattggtagcttgatggggatggcattgaatctatatattaccttgggcagtatgaccattttcacaatgttgattctttctaccaatgagcatggaatgttcttccatttgtttgtatcctcttttatttcattgagcagtggtttgtagttctccttgaagaggtccttcacatcccttgtaaggtggattcctaggtattttattctctttgaagcaattgcgaatgggagttcactcatgatttggctctccgtttgtctgttattggtgtataagaatgcttgtgatttttgcacattgattttgtatcctgagattttgctgaagttgcttatcagcttaagaagattttgggctgagacaatggggttttctagatatgcaatcatgtcatctgcaaacagggacaatttgacttcctcttttcctaatcgaataccctttatttccttctcctgcctaattgccctggccagaacttccaacactatgttaaataggggtggtgagaaagagcatccctgtcttgtgccagttttcaaagggaatgcttccagttttttcccattcagtatgatattggctgtgggtttgtcatagatagctcttattattttgagatatgtcccatcaatacctaatttactgagagtttttagcatgaagtattgttgaattttgtcaaaggccttttctgcatctattgagataatcatgtggtttttgtcattggttctgtttatatgctggattacatttattgatttgcatatattgaaccagccttgcatcccagggatgaagcccacttgatcatggtggataagctttttgatgtgctgccagattcggtttgccagtattttattgaggatttttgcatcaatgttcatcaaggatattggtctaaaattctctttttttggttgtgtctctgcccggctttggtatcaggatgatgctggcctcctcaaatgagttagggaggattccctctttttctattgattggaatagtttcagaaggaatgataccagttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcaaggaatttatccatttcttctagattttctagttcatttgcgtagaggtgtttgtagtattctctgatggtagtttgtatttctgtgggatcagtggtgatatcccctttatcattttttattgcatctatttgattcttctctcttttcttcttcattagtcttgctagcggtctatcaattttgttgatcctttcaaaaaaccagctcctggattcattaatttttgaagggttttttgtgtctctatttccttcagttctgctctgattttagttatttcttgccttctgctagtttttgaatgtgtttgctcttgcttttctagttcttttaattgtgatgttagggtgtcagttttagatctttcctgctttctcttgtgggcatttagtgctataagtttcccgctacacactgctttgaatatgtcccagacattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttcttataatttctgttcttttacatttgctgaggacagctttacttccaagtatgcggtcaattttggaataggtgtggtgtggtgctgaaacaaatgtatattctgttgatttggggtggagagttctgtagatgtctattaggtcctcttggtgcagagctgagttcaattcctgggtatccttgttaactttctgtctcattgatctgtctaatgttgacagtggggtgttaaagtctccattattattgtgtgggagtctaaatctctttgtaggtcacttaggacttgctttatgaatctgggggctcctgtattgggtgcatatatatttaggatagttagctcttcttgttgaattgatccctttaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtctttccattggagcatttagtccatttacatttaaagttaatattgttattgtgaatttgatcctgtcattatgatgttagctggttattttgctcgttagttcatgcagtttcttcctagcctcgatggtctttacaatttggcatgattttgcagtggctggtactggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgacaattcttttctttaagaatgttgaatattggcccatactctcttctggcttgtagagtttctgccgggagatccgctgttagtctgatgggcttccctttgtgggtaacccgacctttctctctggctgcccttaacattttttccttcatttcaactttggtgaatctgacaattatgtgtcttggagttgctgttctcgaggagtatctttgtggcgttctctgtatttcctgaatctgaatgttggcctgccttgctagattggggaagttctcctggataatatcctgcagagtgttttccaacttggttccattctccccgtcactttcaggtacaccagtcagacgtagatttggtcttttcacatagtcccatatttcttggaggctttgttcgtttctttttattctcttttctctaaacttcccttctcgtttcatttcattcttttcatcttccatcactgataccctttcttccagttgatcacatcggctcctgaggcttctgcattcttcacgtagttctcgagccttggttttcagctccatcagctcctttaagcacttctctgtattggttattctagttatgcattcatctaaatttttttcaaaggttttaacttctttgcctttggtttgaatttactcctgtaactcggagtagtttgatcatctgaagccttctctcaactcgtcaaagtcattctccgtacagctttgttccgttgctggtgaggaactgcgttcctttggaggaggagaggcgctctgcttcttagagtttccagtttttctgctctgttttttcccccgtctttgtggttttatctacttttagtctttgatgatggtaatgtacagatgggtttttggcgtggatgtcctttctgtttgttagttttccttctaacagacaggaccctcagctgcaggcctgttggagtttgctaggggtccactccagaccctgtttgcctgggtaccagcagcggtggctgcagaacagcagattttcatgaaccgcgaacgctgctgtctgatcgtttctctggaagttttgtctcagaggagtaccgggtcctgtgaggtgtcagtctgcccctgctggggggtgcctcccagttaggctgctcaggggtcaggggtcagggacccacttgaggagacagtctgcccattctcagatctccagctgtgtgctgggagaagcactgctctcttcaaagctgtcagacaggaacatttaagtctgcagaggttactgctgtctttttgtttgtctgtgccctgcccccagaggtggagcctacagaggcaggcaggcctccttgagctgtggtgggctccacccagttcgagcttccctgctgctttgtctacctaagcaagcctgggtaatggcgggcgcccctcccgcagccttgctgccgccttgcagtttgatctcagactgctgtgctagcaatcagcgagactccgtgggcgtaggaccctccgagccaggtgtgggatataatctcctggtgcactgttttttaagcctgtcggaaaagcgcagtattcaggtgggagtgacctgattttccaggtgccgtctgtcacccctttctttgactaggaaagagaactccctgaccccttgcacttcccgagtgaggcaatgcctcgccctgcttcggctcgtgcacggtgcgctgcacccactgtcctgcgcccactgtctggcactccctagtgagatgaacccggtacctcagatagaaatgcagaaatcacccatcttctgcgtcactcacgctgggagctgtagaccagagctgttcctatgctaccatcttggctgctccccagttagtaggtagaattctaaatgctctaccttgttaatcttgataactttctatatatatatatatacttttttttttgatacagaatctctttctgtctcccaggctggagtgcagtggcctgatctcagctcactgcaacctctgcctcccgggttcaagcgattctcatgcctcagcctcctgagtagttgggattacaggtgcgcaccaccattcccagctaatttttgtatttttagtagagacagagcttcaccatattggtcaggctggtctttaactcctgacctcatgatccgcccacctcggcttcccgaagtgctgggattacaggcatgaaccaccacacccagccactgagatatatgttgtttttatctccattttacagatgaagaaattggcccagggaggttaaataagttcaccaccatcacataattagtaagtggtaaagctgggagtaggatctatttatttaatctctttagccctcactcttaaacacatatactatattgcttctctgattagagctgagatattctgagccctaattcctaatcctgtaatgtttccattatgggtattctctgaaaggtttggagatggctgagggttataagtgagacatatatattagagtggcagttaaaatagtgggaaatgggaatgaaagtaagctggtgaaactggcagaatgaaaagaggagcaaggagatattttagaaggaatgttggtttggaattctggctggacaagtaataataaaatatcggaagaaaatagatctttctgagtaatcagagaaataatacttgttcagaggagtttaaactcaatcgctaattgagggttggttcttcccaagaggagtagcaaaacaagaggtaatatcaaagctcatctactgaaatttctatcaaataccttcctcatcattcctttccttctttcgaaataaattttctatcatgattgttatttgtcttttacaaggtttcctcaaatgatattggaaggacatctagaaagaggacataaaggccactcttcttattaggcttttgctgagctgtgaatatttaagagatgaggcgtaagatcatcattattgatgttatttttccttatgaggggttctttcataaatgccacagagggcaagtggtaaaggacatggaattcaggctcctcatttcacttcctgctgatgtgtgaataactcaggggcgacacacaacgattttactttatgccatttggcatttcattcaggcagttgaattgttgctgctctcttaccagaggtcttagtagggccattttagtagacctgtgctttggaagaattcagaattacttgaaaattccagttactaacatatgctttttgaaacaaattatatgaaaagagcagttatattgtttattataaagttagcctaagtagaattttctggattgtttttaaaggaagcccactcacatcataattaaatatgtattgaaataagagaaatttggggtataaaattttactaattatgactctgtcttgtattgtcattttgaaaatgtgtttgagccacataattctatgccccacaaagaaaacttccaattaacttggactactaattggcaataacaaaacaaaacatccttgtgtaacattacacgtaaatgtcttactatcaagattagctaatgacctatatcttaattttatgaatgacaataactccactatattgattatcaatccagaaaatgttaaagtcagaggagaatattggcattgaggtgtgaatttgaaagcattagtattataagattgaaagtagtgttctcgtgaatgaatgtaagtatatatagagataattatcctgggaacatgtttaatttagctttagtatgcagtgttaaatgactttatttaataataaaacagaatgaatctagtaagtttagactggacaaatttactatcgacagtaagtgcctaggaattgacagaaggtgcagactgtatgacaaagaaatctaaatattcttagaagttccttctttttttatttttcagattgttgccattccccatctcctgccttgaatcttagaatgaaatctgttattgacagtgaactaatttaatgaagcagtgttaaatattcaatgaagcagcaaatctgctcacatttttattaacatatatttttgaagaaacaaagcaagtctacaggcataaaacaatgttatgtctatatgtcatgtatgtgcaggtattgaatcaggactaaaatatctctgatattctatgacaccaccacactacagagccacagagctcatatttagaagattcattatattacttagtactaaatatactgccaccagctaggctggacaaatttgctattggacaaagttggaaaaggccacaacagaggaaaaaattattttcttatttataaagaaagggaatttataaaattatggaaagaacataaaaaataaggctagagtcaagaaaaagcacttgtaaaataagatgctgattatagtgctagaattagagaagctgatacaatagggaaagtcatctgtaaaagtattatctcttgaaattaaacatagaaatgtgaataagaaaacatctatgtgtgaatggattttgagtggggcagataagtgtttttagcaaagaacagcgcaaatcaagtacccccaaattctgcaagaaacaaacaaaaccccatcgcctacctcaccaaaaattgtctgacacagttgggctaaatccatgtcatcaacttagaatttgctttggaaaccagcaagtgaagttgagtcatattttcagaggcttcctcttcctctttggaaaatcatcaacacattttcatcttgtaagctatgttttttttcttttataaccagcattgattttaaaagctttatccaattcttggttcttgaatgtccctgaagatatttttgaaggattatgcaaagtgttgctccctctggaactcccatgtaggccctggagatgttgggaaatgcttgtgagtaattttcatgcataaaaaaggacacttagctgaatgctagattgtaattcaatcaggaagttccgatgacattctaaaactgtacagtctgaatgctttatgaataataccacattgccaacactgaattacagctagtatttttacacgaggactaggaatactagcaacataaaacagttttatagccagttacctttgaggttgagggagatgacaattcatcacacagaagtctttagtgcatcccacaaagattataatatgtgtaagagtgaaggcttgccacttgttagtctatgagaaggatttaagtatagaggacacggtggtctgcaaaacattataggacttgtgaaatgaggacagggctgcaatgcttttgaggacactcgggttgccagaaacacaaatcctagtcctcataaataccacatttgtgctttaatcataaaaattctattgagactaacctttcagtgagggaatattatctaaagagagcacagtcatttcagctgctaaatgaaaaacttgtattttataagcctagaaaaaagtgagttgaatgttatcataagataacacatggtcttgaggcaccctggggcgctgatatctcacttcacagcgcaagctcaaaacactcctagcttgcttaataattgtcaaagttattttaatttgaaccataaccaattatttatgtaaaagaactgtaagaatgatagtaggagagcaagaacatgaaaatttattttttttcaggcttgttgagattaatgaaccctcaaagatgttattaactttgcagaatgggtaccacatctaaacagctatgcatttcaaaataccttggctttcttctcaaaagaaagaattaagttgatactcatgactgaatcagaaaggtactactgacaggtgctcggcacactttcccctgcatgactcaccctaaagataccttattttttccatgaagcctttttattctcatatttttctttggtcttgtttgaaagctctattcccagtggcttgagagaagaagaataaacacccaggccccagtagttttttttttttttttaaacccagggggatatgctctgcctattgtcctgaacactagccaaaatcctactaaaatacaatatctagtattgccaaatcctgcttagagagacatgagaaacctgagagttccttccatggcttgccacaaaacagattatgggtctggaaaataaaaataaccaggaagtggcattataaatatagatcagagaaaaaaaagccttagtggttccttgttcatggtccttaggaatgtgcagaagttttggacagaggatacaaactagcttatttgatcttctctaggcataggtagaataagagtaaatgcccataagaaactacacaaagggtttagagactgagctaagaaaaagctgccagtctggagtcagtagaagaaaattaagaaatagagggcagtggaatgccagagagaggaaatactttgaacacattagcaaaggaaaaatagaaaaaaaatcatatttggagaagagacatgagctctgcccgcattctcttgagatcttttgcttgattgagggcatgggctttccccctgccatgattgagataaaaggctatgatcaggtagaggcagtgctttggaagctgcttatgtcattcctccctccttttcttttgtcctggttctgatttaattcatgggtgtgtgtgtgtgtacgtgtgtgtgtgtgtgtgtgtgtgtgttttcatgcacacaagcttatgtattagatggagagggatttgaaatttttccttgttgaaaggaaggcttcaaatgaaacagcaatccatctcgcaggaaaattcccatcctggggattcccttcaaggcagaaattcaagcaatgatgagaaaggtgcccttagacttgcccagtaatgagatgttacaagccattaattttatgaaactccaaagaaacacagccaggccgtaaaaaaaaggttaaaaaatagatcttcaacgaatcactgagaaaatactaactttccaagtccagggaataaatttgtctgagccctctatttttccctctctgcattatatttgaagatagttgtgttttgttagctttttcatttacccccaaaatacttgcaaaatgctttagttttagaattttcatgtaattgaggagttagaaacccaccaaaggtagggagtcaaagcagaaacagttactcagatgcctctggtagctatccattgttctagagaacaagtccatactcgtagcttaaaagggatggcaggatggcactcttatttaactccttacccacatctctccacctggacagcccctcccaaccctcccaccatacttatctcagtttttcgacatgccatgccaggtcacgcttctctctggccttggacattccatttcctctgcttcaaattcctttcactaggctaacacctactcatggtgtaggtttagcttagacttcactttcttcaggaagctgacgccagtaacattccctccccctcacgtctgggttatggcccctcctgcgtgcttccattataccttccctatcttggtagtcttcacactatataataatttagatgcctatttacttggctgtagtagtcctcactagactataaattctaccgttatgttacagaagagctcatacaacataaactaccttttgtggaaggattatttcaaacgtggggacctaattttagctgtggcagtacgtgaggaacatttataaggtagggcacaactgtacattcacttggtttctcttgagtgctcattctcttccatctttgagtatgttttttactgctgttttaaagtatagccctagggttcttgaaaaccaaagcttttagcttcacgtgtagacttcattcaatttttttaaaaagtattgtcttgaggattgattggtttgaaagcttggttgttatgaaaagctcttatctttccagggttattccttagttgctcttacagaaacaccaaaactgtaggaatatctttaatatgctgtcaaatagaaaggttggtgataaatacttgcctctaaagaatgttttaggagcttaggaaatatgcaagtcatccgtgaagccctcctccctttgaactgcaattttttattatgggagtcaggatacgttgactctacttttttttttttttttttttttttcttcacaaggtctctctctgtcgcccaggctggagtgcagtggtgtgattatagctcactgtaacctcgaattcctgggcttaaatgatcctcccacctcagcttcctgagtagctaggactacaggcatacaccaccatgcccagataatatttacttatcgttcagacagcgtcttgctatgtctcccgttggtctcaagcaatccttctgcctcacctcccagaaggctggaattacaggcataagccactgtgctcagtctgactctactttttgtctcaaagccaggacaccttatcccaatggcataatatttttattccattatacgccgtaccattttagtgattttttcccctaagttctacacacactggtttcagaatgatattgccaaaaggaaagaagaagaaattcactacacttttttttttctgggaatgctagtaaaatctgcatctaaattatataaatggtattattgtcttcttaagtggcacatggtgttacagctcacgcttattatgtcatcatttacctttcataagtattttcaacattcttttatcaatcagttagtcttcaactgtgctgtccaagatggtagcctcttttcacatgaagctattgagcacctgaaatgtggctagtctgaattgagatgagctgtaaatgtaaaatacagaccagccttcaaagacttggttaaaacaaaaaggattcaaaatatctcatttttatctcaaataaatgaatttatattgattacatgttgaaatgataatctgaatatattgggttgagtaaaaggcattattaaaattaatttcatctgtttctttttacctttttaatgcagctactaaaaaattaaaacttgcatacctggcatgcaatatatatacatttttaatttttcattttaatttttgtgggtacatagcaggtgtatatatttatgaggtacatgagatattttgatgcaggtatgcaatgtataataatcacatcatgtaaaatgggtgtatccatcccctcaaacatttatctcttgggtcactaataatcaaattatgctcttcttgttatttttacatgtacaattaaattatcattgactatagtcaccctgttgtgctgtcaaatactaagtctaattcattctttctattttttttgtacccattaaccatccccacatcccccaaaccccattgctgcctttcccagcctgtggtaaccatccttctcctctctatcaacatgagttcaattattttgatttttagtttccacaaataagtgagaacatggaatgtttgtctttctgtgcctggcttatttcacttagcataatgacctccaatttcatccatgttgttgcatatgacaggctctagttcttttctatggctgaatagtactacatggtgtataatatgatgttttctttatttactcatttgttgatgaacacttaggttgcttccaaattttggctatcgtgaagagcgctacaacaaacatgggaatgcagatatctctttgatacactgatcttttttcttttgggtgtatacccagcagtaggattcctggatcatatagtatctctagttttaattttttgaggaatctcaaaactgttctccatagtagttgcactgatttacattcccaccaacagtgtatgaaagttcccttttctcctctcctttccagcatttgtttttgcctgtcttttggacataagccattttaaccgggatgagatgatatcttattgtagtttgacttgcattcctctgataatcaatggtgttgaaaaccttgttatatgccttttgtatgccttttttttgagaaatgtctattcaaatcttttgttcatcttttgattggattattagatttttttcctatagagttgagttccttatgtattctggttatgaatctcttgtcgtatggttgtttgcaaatattttctcccattttgtgagttgtctcttcactttgttgattgtttctttgttgtgcagaactttttaacttaatgttatctcatttgtccatttttgctttgattgcctgcacttgtggggtattactcaagaaattcttgcccagaacaatgtcctggagagtttccctgaagttttcttttagtaatttcatagattgaagtcttagatttacaccttcaatccattttgatttagtttttgtatatggcgagagataggcatctactttcgttcttctgcatatagataacctgttttcccagcatcatttatcgaagagactgtcttttcctcagtgtatgttcttggcacctttattgaaaatgagttcactgtaggtgtgtagatttatttctgtgttctctattctgttccattggtctatgtgtctgtttctatgtcactatcaagctgtttttggtttctatagctccatagtataatttgcaattaggtaatttgatttcttcaattttgttctttttgcttgggatagctttggttattctgggtcctctgtggttccatataaattttaggattgttttttctatttctgtggagaatatcattggtattttgatagtgattgaattgaatctgtagcttgctttgggtagtatggacattttaacaacattgattctttcagtatatgaacctggaatatttatctatttcttggtgtcctcttaaatttctttcatcagtgtttcatagttttcattatagaggtctttcagttctttagttcattcctaggtatttagtttaatttgtggctattgtacatgggattactttttaaatttcttttttcagattgtttattattggcatatagaaatgttaccgattttcgtacgttgattttgtatcttgcaactttactgaatttgttgatcaattctaatagttttttgtgcagtgtaggtttttccaaatacaaaatcatatcatctgcaaataggacaatttgacttcttcctttccaatttggatgctctttatttctttgtctcattgctctaactaggaatttcagtactatgttgaataacagtggtgaaagtgggtatccttggcatgttccagatcttagaggaaaggctttcagtttttccccattcagtatgataatagctatgaatctgttatatatggcttttattctattgaggtatgttccttctttttttttttttttttttttttaagatggcatcttgaactgtcacccaggctggagtgcagtggcacaatctcggctcactgccacctccaccttccaggttcaagcaattctcctgctttggccccccaagtagctgggattacaggcacctgccaccacgcccagctaactttttgtatttttagtagagacagggtttcactatgttggccaggctggtctcaaactcctgacctcgtgatccgcccacctcggcctgccaaagtgctgggattacaggcatgagccaccacacccggccagtgtgttctttctatttctagttgtttgaggatttttatcatgaaggatgttgaaatttatcaaatgctttttcagcatcaattgaaatgatcatatgggttttgtccttcattctgttaatatgatatatcacatggattggcttacgtatgttgaaccatccttgcatctcagggataaatcccatttggtcatgacaaatggccttttaaatgtattgttgaatttggtttgctagtattttgttgaagatatttgtgtcaatattcatcagagatattggcatgtagtttcctttttttgatgtctctttttctgatttggatataagagtaatactggcctcgtagaatgagtttggaagtatgctctcatcctctaattttggaatagtttgaggaaaatcgatattagcttttctttgaatgtttgtagaattcagcagtgaagccattgggtgctggtcttttctttactggaagactttataacagcttcaatcttgttacttgttattggtctattcaggttttggattttttcctggttcaatcttggtagtttgcatgtgtctaggagtttgtccatttcttctagattttttaatttattggcatatagttgctcatagtagccactaaggatcttttgaatttcttcagtatcagttgtaatatctcctttttcatttctgattttatttatttgggtcttctctctttttttcttagtctggataaaggtttgtctattttgtttatgttttttaaaaccaactttttgttttattgatcttttgtattgttttcttcatctcaatttcctttatttctgctctgatttttattatttcttttcgtctactaattttggttttggtttgctcttgcctttctagttctttaagatgcattgttaggttgtttgaagtttttcttctttttttgggtaggtatgtatgagtactgcttttgctatatcccataggttttggcatgttgtttccattatcattcgtttcaagaaattttcagtgttcttaatttcttcattggcccaatttccttcttaatgtcttcattgacccatatccaggagcatattgtttaatttccatgcatttgtatagtttccaagattcttcttgttgttgatttctagttttattccattgtgtacagagaagatgactgatattatttcatttaaaaatattttaagactagttttgtgacctaacataaggtctgtcattgagaatgatccatgtgctgatgaacaaaaaatgtgtattctgtagctcttggataaaatgttctgtaaatatctattagatccatttggtctatagtgcagatgaagtatgatgtttctttgttgattttctgtctagaatatctgtccaaggctgaaagtgaggtgttaaagtttccagctattattgtatattgtactggggcctctctctttctttagctgtaataatatttgctttatgtatctgggtgctccagtgttgggtgcatatatatttaaaattgttatattctctagctgaattgactcctttatcattatacagagacctttgtctcttcatatagtttttgtcttgaaatctattttgtctgatacaagcatagtgactcctgctgtcttttggtttccaatagcatgggatatcttttcccatccctttattttcagtttatgtgtgtattttttgtaggcaacaggttattacttcttttttttcccatccattcagtcagtatattttgactgaagagtttagtccatttacattcaacgttattattaataaataaggacttctgtcattttgttctatgttttctgcttgttttgtggtcttttcttccctttccttccttttaatgaaggcgattttctctggtgatgtgatttaatttcttgcttattttttgtgtatccattgtatgttttctggtttgaggttaccatgaggcttgcaaatactatcttataactcatattttaagctgataccaacactgtttcataaacaaacaagcaaaaagaaaacaaataaagactctatgccttagctttgtcctcctgctttttacctttttcttctttcttgcttttttttttttttttttttttgagacagagtctcactctgtcgcccaggctggagtgcagtggtgcaatctcggttcactgcaacctccaccttccaggttcaagtgattctcctgcctcagcctcccgagtagctaggactacaggtgcatgccaccatgcccagctaattttttgtgcttttagtagagatgggatttcaccatgttagccaggatgatcttgatttcctgacctcataaacctcctgccttggcctctcaaagtgctgggattacaggcatgagccactgcgcccggcctcttgtttctatttatatcttattgtgctatgtctcaaaaagttgttattgtttttgtttggttcattgtttaggctttctacttaggataacagtagtttacacaccacagttacagtgttgtaatattctgtgtttttctgtgtacttactattaccagtgagttttgtaacttcagatgatttcttattactaattaacattcctttctttctaagtgaagtactccctttaacatttcttgcaggatgagtctagtattgatgaaatccctcagcttttgtttgtctggggaagtctttatttctcctttatgtttgaaggatattttcaccagatatatactattctagggtaaaaattttttcctttattgctttaaatatatcatgcactctttcctggcctgtaagatttccactgaaaaatctgctgcccgacatattggagctccattgtacgttatttgtttcttttctgttgttgcttttaggatctttttttttttttttttttttttgagacagagtcccgctctttagcccaggctggagtgcagtggcacaatctcggctcactgcaagctccgcctcccaggttcacgccattctcctgcctcagcctcccgagtagctgggactacaggcgcctgccaccgcgcccagctaatttttgtatttttagtagagacggggtttcaccgtgttagccaagatggtctcgatctcctgaccttgtgatccgcctgcctcggccttccaaagtactgggattacaggcgtgagccaccgtgcccagccaggatctttttttattaatccttgatctttgggaatttgattgttaaatgccttgagacagacttctttgggttaaatctgcttgatgttctataaccttcttgtccttgaatattgatatctttctccaggtttgggaagttctctgtcattttccctttgaataaactttctactcctattcctttctctaccttctctttaaagccaataactattagatttgccctcttgaagctattttctagatatcgcaggtgtgcttcatttttttaaaaaaattctgttttcttttgtctcttctatgtattttcaaatagcctgtcttcaagctcactaattcattcttctgcttgatcatttctgttattaaaagactgtgatgcatccttcagtatgtcaattgcacttttcagctccagaatttctgcttgattctttttaattatttcaatctctttgttaaattttttctgatagcattttgaattccttctctgcgttatcttgaatttcattgcatttcctcaaaacagcttttgaattctttgtctgaaaggtcgcatatctgtttctccaggactggtccctgatgcgttatttagttcatttggtgatgttgtgttttcatggattgtcttcattcttgcagatgttcatctgtgtctgggcattgaagagttaagtatttattctagtcttctcagtgtgggctttcttgtaccagtctttcttgggagggctttccaggtattctaaaagacgtaagtgttgtgatctaagctgtatttgttttagggggtacccaaagtccagtaacactgtggttcttgcagacgtgtagaggtgccaccttgatgttcttggacaagcactgggagaattctttggattaccaggcagactcttgttctcttcccttactttctcccaaacaaacagagtttatatctttgttctgagtcaactggagatgggggtggagtgacataagcaccctttggctactaccgctaggaatgtcctgggtcagacctgaagccagcacagcactgggtcttgcccaaggcctgcttaactactccctggctatggcctatgtttgctcagtgccatagggctctacagtcagcaggtggcaaagtcagccaggcctgcgtccttccctgcaggattgtgattttctccaggacccaggagggtccataggtgttgtttgggagccaggaactagagtcaaaaaccttaaaaggccatctgatgttctattgtactttccatttttccctcccctttccaaaggcagaggagtcttatcccatacccaccaccactccaggccatgaggagtactggcagattactaccaatgttccccctaaggcccaagggctttttagtcagcttattgtgaatgctgcctggccttggactcactctttagggtagtaggcactcctctggccgagagcagtttcagaaatgctatccaagggtttgctttgtatttttattggacagtgctggcctagacagtaactcaataatgagaattttatgttttcttttgctaggaaagagctatttagtcaccgtggctagcaaaatttggtgacttggttgacttggacaaatgggatcctcaaaacacaattaaatatatctaatgtcctgagacacaccactcataataatattaatagttactccagtgaactaataatattatttacctctttggattttataaggattcaattaagataacacgtgtgtgaaggttgtgacctaaataatattatcttacagggagaaaggtgcatgtgaaaattgtcagagatgaaaatggttagggaacaattttaaaactattttcatacctgatgtatagtagtaatgtgctcgattatctgtggaattaatttgatcatcagagaagagatctcttttggtttatgtgaagactttgtatgccaaaagcattttttgtgttgctatataatctttgtaaacattcttgtaaatggtgcatgacattttgtttaatcaatataccagcctttatttaaccattttctttttctcggacattgggttgcttccattttttttttcactatcattaatattatggtgatatacatctgtaaaactctccccatattgtggataaatttgcaaggatgtcagactgattttaatggagatgaattatgtaagaatggaaaaccattcaaattcctgactaaaagtgaacaattatccaactagaaggtagttggatgtaagtgattttcttacctgtcttgcatttctagggtagaaaagataaatggagaaaagattggttaaatgttgacatgagattattcctattgagaatattggcaataaaaatagcaataatatcagtagagatttgggggatatttcaattccaatgtctagatcccttttattggaatcttgaatgttgagttttagtctcattgaataattttatctaaagtagtcaaaaagactctgagattgtcccacagctgcataaagacccatataaatgaccaacattacatgtgaattagtttaaatctacacagtaggtttagcaatacaccaactttgtttgtaaatgggcttatatcttccagtttcataaaacgtttttgggagaaaggtttcactttgtccatgactgtgcatctgtaaacattttatctttagagcagatgtttaaagccccaaaagttgagtttacattttgtgaaatatttattgtcttaatcacatagtttctgtactggtagtaggttagaaatttcaattcattccaaataaagttgggcggaagtaggaaggcaatgccaaattaaagcagagtactttaataatgattccttttaaaatagggcttctcattatcataacattataaactccatttgtcctcagagttccagagttcaagagctcctacagcagagctcattcatgtggagagaacagtgcagagaatgtatatatagtgaggcagatttgtatagtttatgttcgatgtgtatatagccattaattttaatatagtcgcccttactctcaggaacacctgctacctgaacaatccagttttaaaaccaactctccaagaattatttcctacttcttcttcctggttttcagggcattgcttaagcactgctttgtataagattcacgtgcctcctgtagttccaactgcagcaggaggatttcttgagcccaggagtttaaggccagcctgggcaacatagtgagaccctatctaaataatgataataaaagtaatatgtttttaagttacaattaccattatattggttgaacatttgaaagattctagatgctttacagactatgactattggcctgcattacatgccatgaattctaataattgtgtgctgataagatgacattctgggtttcaaaggaaagatattccatttagaattagaaccccagggctcaggtgctaactatgttacttgggcaagtcacataactctgaaagctactgtatttccttctcgggaaagggagggtgataataattaccatacctttcttgcacctcaccaaatgaacaaacatctgcgagtggttgtcaggtgctgggaatagaaggggatcctctacaaaggatcatataaaaagttttggaggatgaaagtgctttatatgttgatgatgttggtggctacatagctatgtacatttgtcaaggctcagaactgaatgtccaaaaaatggataaatttttactgtatgtaaattatacttaaaaacggaactttgtaaatactaaatactaaataaataaaggctattattttttctttccatgggatgtcaatttcgtaagacaggcaatagctttatagtgactattagaggagagatggttcttccttgtgcttggattagagcagacgtccttgtgactcttgaatcttcatctggataaattatctttctctatccttgggccaaaaagaatgaaacttttattaaagtgatttctccggggcactatccctcaccaatatcttttttcactctctgagctcatccattcttctggctttagttattctgatggggttcaattctctatctcttacttgaacctctttcttgaactctagatccgtattatttttgtatggaaattccacaggcatcttcaaactcattatattcaaaaacaaactcattttttccaccagttccttgctttttctcattaattcttcatatgtttattaagtgcacactttgtgaaggcattgggttaggcactggaaaagcaaataacatagttctttccttcattaagattatagactaatattaataaatatactataaattaagcaaagtataagagatattcccttccttagtttttgtgaaaggtagatagtatccttgattccttttcccttcattttttacatattcccaatgaatacattcttctgattttgtctctgtaatttttttctcaagtttatctccatcactctatccttctgtaatgtaacaacctttgatcaaattatcacagtctctttattgggctattgtaatagcatttctgattgtccttcaatcctccaggactgtttccctcaaacctatcatgagtgatcagcctaaactgtatgttttttcctaattgaaactcttcagtaattctatattatctgtaggatacagctcaagattcttagcaggatgttaattccccttcaatagtcagctcattcctttcactttagtctcatgaccaaaccatttcttcatgctttatgcccccagaaacactgaactacttatgtttgggtgagatctcacacaacatgccatttatcacctccaagcctgcacttgtaaaaatatttactggaaatactttttctaacttctgtttcaccatcctctggttatcttgttctcattctttaaggcttggctaggattcatctttcctgacttctggggtaagttagtgtcattcactatgacttagcttatcatacaatattgaaattctctgtttatgtgctgggctcatttacaagattgtaaacttattgagggtaaggactgtgtcttagtctttgtatcctcagggtttgacacatgctacaaggaatgtggtcctgatttttctccaaccacatttacttccacttgtttctccctccgttgttccacctcagtgaacttttttttttttttgagatggagtctcactctgttgcccaggctggagtgcagtggtgcaatctcagttcactgcaacctccgcctcgcgggttcaagctattttcctgcctcagcctccctagtagctggattacaggcatgcgcctccatgcccggctagtttttgtattttgagtagacatggggtttcatcatgttggccaggctgttctcaaacgcttgacctcaagtgatccacccacctcggcctcccaaagtgctgagattacaagagtgagccactgcacctggcctcggtgaactttttataatgccttgaatattgcacaacctagcttccagagagcttataggatgatgttcttccacagcctggaatactttttcccctgtttctctgtggggttagttattattattctttaagactgcagcttgacttaagcatgtcttccttttggaaggctctgtttttctttcccatgatgttaggatagatcagaaggttcatttctgtttttttaaagcatcttctgtgattgcaatactatttatgctaattgtctttttgggtttacttgtctttctcctccacttgggacttctggtgtctatcactgtcccaagcatacggtaggcacttgataaagcttttctttctttaaaagaaacatttttattactgcattaacaggcgaaagaaagaattaaaattttgagaaccttgtatattcctatcactatgtgctatatgcttacctacatagtatttgaataaaagtagtcacgggcaagaggcttagcaaacagaaagcctttgcagttctataatcttagatctgtgcttcctcatgggcttggggaatcgatattattttcctcctgtgtgttataacaggctgtttctcccatcagaaaatgtgtggacctattggggatgtccgtagatagttttcttttggtaatattctctgctttatttggagaagatgttatttaaatacactataaggtgcttcttataactgtggcaagcattctcttgggagtgtgaagccacagaataagcaggcacaactttctagtatattaacatttactcatggctacagatagttctagttaaagatggtggaataaaggcattttaatgctactttccttttagaaattcttaaaaacaataaaacaaacaaaaagccctcattctctcacaaatccccaaagaataaaaacctaaggaagaaaactccaagtgaaaacagaacagaaatacaattattaagactatcagccaaatgtagtgaaatttggatcaaatatgtaagactaattgggagccaaaatagcttattttttcaacttttatttttgattcagggtctacaagtgcaggcttgttacctgggtattttgtgtgatgttaaggtttggagtacaaatgtgatcctgtcacccaggtactgagcataatgcccaatagtttttcaactcttacttcccttttttctccctactttagtagtacccaatgttgactgttgcagtctttatgtccatgagtacctaatgtttagttcccacttgtgagaacatgcagtgtttggttttctgttcgtgtgttaattcatttaggataatggcctccagctgcttccatgttgctgcaaaggacatgatttcattctttttatgactgtagtattccacggtatatatgtacccattttccttgtccaatccattgttgatgggtatctgggttgatttcatgtctttgttgttattaatatgctgcagtgaacagggaagtacatgtgtctttttggtagaatggtttattttcttttggataagtactcaggtaatgagattgctggatcaaaggatagttctgttttaagttattggagaaatctccaaactgctttccacagtggctggactaatttacattcctaccaagagtgtttaaacattccctttctctgtagtctcaccaacatccactgtttttttgactttgtaatagtagccattctgactggtatgagatagtatctcattacggttttgatttggatttctctgatgcttagtgatgttgacaatcttttcatatatttgttggcctcttgtatgtcttattttgagaagtgtttgttcatgtcttttgcctacttttcaatggggttatttgttttttgcttgttaagttagttattgattctgaatattagaattttgttggatgtgtagtttgcaaatattttctctgattctgtaggctgtcctgtttaccttgttgatagtatcttttggtgtgaagaagtgctttagtttaattagttctcacttgttaatttttgcttttgttgcaattgctattgaggatttagtcataaattttatctcaaggccaatgtccagaattgttttgtctgaattttcttctaggattcttatagtttgaggtattatatttaaatatttaatccattttgagttaaattttgtctatggtgatatgtaggagtccagtttcactcttctgcacatggctagccagctatcccagcaccatatattgaatagagagtcctttccgcattgtttatttttgttgacttgctgaagatcatatggctttaggtatgtggctttatttctgagttctctattctgttctattgatccatgtgtctgtttttgtaccatgctgttttggttactacaaccttataatatagtttgaagtttggtaatgtgatgcttctgactttgttctttttgcttagaattgtctgggctatttgggctctttttgtgttccatatgaattttagaatagtttttttctatttctgtgaagatgatagtgtgataggaatagcattgaatctgtagattgctttgggcagtatgttcattttaatgatatttattctttcaatccatgagcatggaatgtttttgcatcatatctctatgatttctttagcagtgttttgtagctctccttgtagagatctttaaccaccatggttggatgcatttctaaatatttttgtgctattattttaattaaaattatgttcctgatttggctctcagcttgaatatttttgatgtatagaaatggtactgatttttgtacatttattttgtatcctgaaattttactgaagttgtttatcaggtctaggagccttttgggggattctttagggttttctaggtatagaattatattatctgtggggagagagtttgacttctcctatttggatactttttatttatttctcttatctgattgctctggctagcacttctagttctattttgactaggagtggtaaaagtgggcatctttgtctctttcagttctcaaggggaatgtttccagcttttgcctattcagtatgatgttggctgtgggttttcatagatggctcttattattttgagatatgttcctcgaatgccttgtttcttaagggttttaatcataaagtgaggttggatttcatcaaagctttttctgcatttattgagatgaccatatgttatttttatttttaattctgtttataagatgaatcacatttattgatttgcgcatgttgaaccaacttgtataccaaaaatgaagcccacttgatcatggagaattacattttttaatgtgatgctggattcatgttgctagtgttttgttgaggatttttatatctgtgttaatcaggaatattggcctatagttttcttttttcgttgtgtcctcacacacattgggatcagggtgaggatggcttcattgaatgagttagggaagagtccctctccctcaattttatgggatagtttcagtagaattggtagcagctcctctttgtatgtctgatagaatttggctgtgagttcatcttgcctagggcttcttttcattggtagctatttcattactgattcgatttcagcacttgatattgatctgttcaggatttcaattttttcctgattcaatcttgggagaatgtgtgtttcaaggcatttatacatttcctctagattttctagtttctgtgcataaaggtattcagaatagtctctgagggtcttttgtatttctatgggattggctgtaatgtcatcattgtcgctggtgattgagctcgtttgtatcctcactctatttttctttgttcatctagctagtggtctattgatcttgggtatcctttcaaataagcaacttttggtttcattgatcctttgtatcaatttcaaagggtctcaattgggtctcaatttcaattagttattctctgattttagttatttcttttcttccgttaggtttggggttaatttgttcttgtttttctagttcctctagatgtgatgttagattattaatttgagatctttctaactttttgatgtaggtgtttagtactgtaaactttcctcttaacactacttttgttgcatcccagacatttggttatgttgtgtctctgttttcattttatttcaaagaatttattgatttctccattactttaattgcttacctagaagttattgaacagcaagttgtttaatttctatgtaattgtgtggttttgagagatcttcttggtattgatttatatttttattccactatggtctgagataaagtatgagttcagtttttgaaaatttattgagactgctttatgatcaagaatgtggtccgtcttggattaatttctgtgtgcaaatgagaagaatatatattctgtggttgctagatggagtattctgtagatgactattaggtctaattggtgaagtgttgaacttttagtctagaatttctttgttagttttctgccttgatggtctgaatagtgtttttggtgggaagctgaagtccctcactattatgtggctgtttaagtcttttcataggtctagaagtacttgttttatgattctgtgtgctccaatcttgggtgcatatagatttaggatagttacatcttcttgttgagttgaatccctaataattttgtaatgcccccctttgcccttgtttgttgctagtttaaagtctgttttatcggatgtaagtgtagtgacctctgctcttttttcatttggatgataaatctttctccaaccctttacttagagcctatgggtgtcattacaagtgagataggtctcttgaaggtaatagacagatgtgtctggtttacttattcaacttgccactctttgccttttaactgaggaatttagactatttacatttaagattaatattgatatgtgaggttttgatcctattatgaagttgttagctggttgctttttactttctattgtgtgggggctttacagggtctgtgggctctgtacttaagtgtgtgtttgtggtagcaagtatcattctgtcatttccatgtttagagctctcttaaggatctcttgtaagactgatctagtgatagcaaattcccttagtgcttgcttgtctggaaaagattttatttctcctttgtttattaagcgtagtttggcaggatatgaaattcttggtcagaatttctcatctttaagaacactgaaaataggccctcaatctctcctggcttgtaaggtttctgctgaaaagtccaccgttagactgacggagttacctttgtatgtgatctgacctttttctctagctgcctttaagattttttctttagcattgacctttgacagtctggtgactatatacctttgtggggtttgttttgtatagtatcttactggtgttctctggatttcttgtatctggatgcctccctctctagcagagtagggaaatatttataaattatttcctcaaatatgttttccaggttgtatcgcttcttggccttttggctaagatcaagtgttttcaaggttgtttactttttctccttctttctggaatgccaataattcataggtttggttgctttaaataatcccatattttttgaagactttgtttactttttaaaattttttttaaaaaaattttgtctgactgatttagttagaaagatcagtcttcaagttctgaaataattatttctttttcttggtctagtctctcaatatagttttcacttatattttgaaattccttaagtgagtttttcaatttcagaagacagaatgcaatcttttaatgatgacactaccttcagattttccatggtgccagaattcttcagctggttgcttctcatctggagatgctattagttttaatttttgtcattgttttcatgctggtaggattttttatttttttctttttgtataatattattatttttttgttcattttcctatcccttcccttcctagggagtacgatggtagagaatgctgggtagggttctttggttttgcttctatagccttatgcacatttttttggcaggtattatattgggctgtgcagttcaacctacaagcccatagattgtgcttataggtaagaattggctgcggctaacatgtctgggtacttacttgatccttatttactagcaaaagctctttgttgcctcagataatgggccaattcatggaatgcatagtggtctgagctccctgctcagctctggtgggcagtggaggccatgatgggcaagaccaagatggcccacctagaagtcgcctgctggcaggcacaagcaccagtcccaagggagaatccagtgggtagctaccaagtgcttagaggtgtgcctaagcatgcagctgggaaacctccttggctccaacttccttgcctggggttgtggggtgagctgaactcctaatccaagacagtggatgctccagatgcctaaagacctgcttggatgtggaacagagaaggccttgctgtaacacactctaagtcaggaaaggtggggtggctcaggaggctggaccagttgagtggatgccccaaatacctggagttctgcccatgcatgaaggagggagggccttcctgtactaggatctttgcacaggaagagtggtgtagctcaggctgctgatccaggtgagcaggtgctccaagtccctggaaatctgcctgggcatggggtggagagggccccacttcatcacaacctcagggtagcagactggggtacccagcaatagcgtacatagacccgtttcatgtcttcaagctggctgtggctacaagtcttgccagccagaggaaactgcagcagtagcagcttttcttctgccccaggattgcagttggggggtagggagcaaaattccagcacctactactgaggtgtgttccacagttcttgctatgtaagcccttaccctgatccagagcaggttctccaatctctggcctgagactaaagtgcctacatggcaatgctgccaggtggccaaagaatggctgattttgtatgtgaccagattaaaaatgacatctagctctcaaccctgggtctgggaaaatgtctacagcttttcctggcgcctttccctcacagtatcaggaagcctctccccaacttagctccagggcttgggagaaacacagtgctcccccttgaccttggttgatcagatcctcagtggaaagatgagtcacagagggaggctctctgcctctctcaagtactggagcttcactcgcttttatcagcaaattggtgtcacgggggaagtttgctcgtgttcacctccctgggatctggggtgtcctacatgattcaagtggattttcatttttcttcttgaattaaataaagctcacaaagttgatcattatgcattatcctgcgattaatttttttttttgagatagagtcttgctctgtcaccaggctggagtgcagtggcatgatcttggcttactgcaacctctgcctccctgattcaagagattctcctgcctcagcctcctgagtagctggtactacaggcatgcgccagcatgcccagctaatttttgtatttttagtagagacgaagtttcaccatgttggccaggatggtcttggtctcttgaccttgtgatccgcccttctcggcctcccaaagtgctaggattacaggcgtgagccaccatgatattttcaagtggctgaggcacactaaaagcctcttatcctctatcttggggaaaaaaaaccactcgtcttagatcttgggttaaatagatttctataaacatatatgtcacagttctgaaaggcccatttaatgaactttcaattgaagaaaatagttataggggcatgggagagctgtaggagaagtgaggaagattcccgcaaagtccaagttccactcttaaaaccccaagagagtggggcaaaaaggggagccacataggctaactatcttggtaactgtaacctagattcttacctgagggagattgctagaggtgagaatgggtaaaggaacaaaaagggaagctaatattatcaggatttgtaatttgaggttcttcactgtaagccagaccagtctcatgaatgtctaaagctggaaggagacaagcacccagagaagagaacacaaccaatgtggcaagacataattgaaagcaacaagccaaaattaaagctgcagacttccccagctcaaataatcacaaaaataaatgtatcattaccaacactgacaaaattgcagggagctatgacaatgtattacaggggatttgacaatgtctggctcagggatgctttctctgagaaagcagttgggagtggagaactgatgtataagtcagtgaggcaaatggaagagaatattcttgtcagagggatgaacacattcagaatcttagtggtgggagagagcatgctgtggttgagaaagagaaggcaaatgtgattgcagtactgagtgggagtggagtggagagaggagaatagtgagaggtgagactagaggaaaggagagtcaaatctgtaggactttagagttcttgtcaaggattcctaagaataatgataagcaattgaaaatttttattcagagttatgacatggttagatttacatttcaaaatgagccttttggctgtaatgaagacaattgttttgggagcaaaggctaatgtaaaggtagggagactagtcaggaggttattgtagcaaaacaggtgagaggtgatcatatctcagacaaggtctgtggcagtggaaatggagggaaatgtgtgcttttgtgaaatgtctaggaggcaaatagatttacctcagtgatggattagatttaggatgtgtgtagcagaaaccattaaataccccagtatctattattcctttcttccatttagagatagtgccacctacgtcactctgagtttgagctgcacaggtgaccacctagctaacgtcttcttttgtcaagttgtctttcagttacatatgatcgtgaactaaatttgggccaacattcgggccccctcctaaaatacaaagttgcttgccctggactctaagtgccttcccatgggctgggacatggacaccttgctgatgatcatgtttccatctatgcagacttgaacattaggacaagatagacaaagcccagattcttgaatagtcttgtggagcagagcctccccactgcctttgttctactcattttgcattttttatttgtgatagagcattttttggattcctttgttacagcaacttagccaaattgtttcagatggtggagaggactgaactggataaatggtgatgccattcactgagatggaaaacattcataatctttttcagcttttggtcttttatatatttaattgaatattattttatatttaatttgagtagttaataaaaatgttttaaaactttttcattccttgggttgtcacagactcattcttttttacaaaattaagctttgggaattataattttatctaactgtgctatcatttgcttatatttactaaaccattaaggtataatgaaaaacaaaactgacttactgaaacctagatatatttgtttctataactatgaactagcctatcaatctaattcaacaaacaaggtgcaaataaggcaaaaaattaataaagaggaggagagaaaaaagaaaagaaaaaattagggtatttttgtgtgagtttagtttttagttcacctatgagagcctctagaaatcatcactttcaattttaagaagggtttacatgctctacacttaatacagttgattttatttgaaatagaatccagactcagtattcagaataaaccctctttcctttcaaaaattaaaacagccatcaaatgcagatttttagcatctcttgttttccatgatatctcaaagattattttaaaatatttctatcaaaacactttctatattatttatccagagacttaattattaacaaagtattagaagctagaagtaggtaaaataagtgattattttaataaaaattatccttactttacaaaatccatattaacctcacttgaaattttatgagcttttcctataagtttaaagagatagaaatcagtgaaagacctcagtaattcctgcaatgatcttaatagaaaatattttataccttctctcccaacacttcaactcctttatacttattcatagataattctttgaaagcatattagggcagctgttcctgtttaacacatgaagtggtggaatcattgattaacaaaagctttcgtaggtttctatactaatcagagactaagtaaggcatccactctgagtgttctgacatcagcaccgggtaccttccacaggcctgtgctttcttatggcaaatggaagttcatgatcaaattaaagaataatacaatgtatttgaaatgatgctgatgaatgaatgattgcatctaaatagtgatctctgtcggtacttaattcccaaaattttcagtgttattttaaagatgggaaagtcagtttaagaaataactattctactaggaagcaagcagattttagagggtacaggatccatatgttaataaacataatgcaaacaaaattagttaaaagacagatttaccaaatagaaagagagaatttagtcatgatttccaaagccaattgaaatgggcttgaatacattcaaccattgtgtgtgtgtatgtgtgtgtgtgtgtgtgtgtgtgtgtatagccaggcactattcacagttcacagtggtgacaaggcaatctctgcctttataggaccttctttctaatggaggagatttacaaaatatctaaaacaaaataacatccatgcaatcaagaaaaataaagcataataaagagggagagataaagaagacagggttttttttggataaaaatgtaagctcgaagaggtgatatttaggcagagactcaaaagagtgagtaatctcaacatttctggggtaccattcaaaacagatacaaagaccctgaagtaggatgagcttgacatctgctagaaacagtaaaactactggtatggctgaagtagattgagtgagggggagatatgattagagaggcagccaaggccagatcatgtagggccgggtagatcacagtgaagactggactttgtacaaaatgctataaaaaaatggaaagttttgaacaagagactatgtgacttgatccgtttttaaaagatcactccactgcatgtagagaatgaaccaggactgggagtagaactaatggggggtcagagaaactactgcaacgatgttgagaagagatgctggtagcttagagtagtagtggtggaggtggtgagaggaattcaatttggagtttgttttggaggtagagctcatatgagttgctgatggattggatgtgaggtacaagagaaacagaaatcaaggggaaagctaagtttcttccccgagcaacttgatgaatggtggtgtcatttactgaactgtcgaagactgaatggaaacaggttggagagaaaaataaaaagtttgttttggacatgttgaacttgaggtgctttttagctatccaagcatagatgccacatgggcagttggagagaaaggtctggagctcctggcagaggaagaagatgtaaatacaaatttatgagtccttaccatgttgatggtatttaaagccctgggagtaggtgagctcacacagaaacataatgaaaagaagatatctgaggactgagttcaggcactccaatatttagaggtcaggaagaggagaaaaatccaggaaaggattatatatataatttatacatatatatgtatatattacgtaatatatacatatattatattgtgtgtataatattatatatattttatatagtaaggattggacagtgagcatattagtccatttgtgttaccacaaaaaatatctgaggctgagtaatttaaaaggagatttatttagctcatggttctacaggctgtacaaagatggcaccagcatctgcttggcttctggtgaggcctaaggatgcctttactcatggcagaagacacaaggggagcaggcgtgtcacatggcaagagaaggagcaagagagataccaggcatgttaaacaacccgctctcacgtgaactaatagagtgagaattcactcattaccgtggagagggcagcaacccattcatgagggatccactcccatgacccatacatcacccactaggcccacctctaatattgaggatcacatttcagcatgagatttggagtggacaaatatccaaaccatatcagtgagatgaggaaataccaagagaatttacatcaagagagaggatgtctcattacattttcttgttcaatatactctcctactctcacggttaattatttcccaccttcttctttctcctcaatctccatcattctctcctctacctaacccaatctcaccattagcttttgaccctgctttgtacttcacagagaaaacagagtggctcagaagagtacttcatgatcttcccatcacaagtatatcatctgtgtctaatctgccttcccatctgctaaaacaagtggactgcctctgctccactgtaggatggaaccctccccttatgcatgggatctgatttcctctttctggtacaagaactctgttcttataatcatcctgctatctcttgctgcatctatcactaccatgttgcttgtatcatctctattagcatacaaatatgctgtattatctcccatcttaaaaaaaaaacaaagcaaaaataacaataaaatttttccttattcctatgtctccttcgatcttcagcactttcttttctttttctttctttctttctttctttcttctttctttctctttctttttttctttttctttctttctttctttctctgtctttctttctctctctctctttctctttctctccttccttccttcttcccttccttctttcctccctccctccctcccttccttccttccctccttctttctttcttttttttttttttgacagagttttgttttgtcactcatgctagagtgcagtggagcaatctcagctcactgcaacctccaccttccaggttcaagtgattctcctgcctcagcctctcaagcacctgggattacagctatgcgtcaccatgcccagctaatttttgtatttttagtagaggtagggtttcaccatgttggccaggctggtctcaaactcctgaactcaggtgatccgcccacctcagcctcccaaagagctgggattacaggcatgagccaccatgcctggccatcagcactatttattttcttctctttacagtaaaactctgggtaaaatgatgccatatgtataattgttctttgacaatatccattcagatgatcatatggtttttaaaaatcatttactgtgaaaataacatttataaatttttctatttttaaatggtcttttcatttcttaccacgtttttcttatattgttagattttcttaaaaaattaatttggaatttttgtatctatgtttatgattgggaaaggctgaagttttcctttaataaacagtaattttgtttgcttttgggattaagattatactagataataaaatgggagtttgggaatattttctttttattttgttctttggaacattttgaatattgagatatgttcctcacaactttggtagaccttgcctataaaataatataggtctttaaaaaaatatggattttgcattgtcatttaaatgcttcaatagttataattcaggcttcctattgagtaagttttggtcagttatatttttctatgaatttatacatttttataagtttataaatattggcataaagttgttcatgtttttatctttaaacattcctatgtttgtagttatacacccctttcatattcaatatccatttatttgtgttttctttttttatgtatcaatcaatgagttttctcaaagcttttagtctttctgaggcaggattttttctgctttgcttatttttaattttaaatttatttacttttttctattttctttgagtttattctattgttttctgacttcttaagttcaaagctgtactcattaattttcagcatttcttattttctaatataagcatgtaaggctacaggtttagcttaaaccataggaaattgctgatatttggctgctattgaattaccaaaaatggtaattttttatgattaacttaatgttcccctcaaagtattgctttcacagcttcccacaagtttcagtatgcaatagtttattaatcaattccaagatttttgaaaaggttttgttatgatttcttctttggcccatgagttatttagaagtatgtggaagtatgcatgtttgctttaaatatccaacttatggagtttaaaattatccttttctgttattcttgttattgacttctaaatgaacagtattgcatcaagagcatgtggactgtgttgaaaattatttaggcacttgttaaagatggtcaagaaactttattcaagaaggggattattgcaatagggttttgcagtagggggaagcgatggctgcagaggggtcttgcagtaagtgaaagagtcttcgctgaactctgaatacaagaaggacaaatgggatttgatagccaaggatcatggtgggagtcagtggaaagaaaattactaagaggaaaacatcagggcaagggagattttgtaatggctgacttgaaagtattcttcctgaagaagatatcaagggtggagaatgaggcatctgattagatattgagggaggggaattcttactaaagtaacacaacaggatggttgctaaaattggaataagcagacaaagggcagaacctaagatcagggcctagtcaagaagaggtctcagaggaacctgactcaaggttaagaagacactttttgtcagggagttgagttcaatctcttttccctaccgcaaagcccgattgcagtagtctcctgaatagtcttcctttaccatctttaacaaggttcattattttttttcctttagcagctataaatttgttaaatttgtgaaaatttctaagtattatgttgtgaaaatattccttcagaaaatgttttatatgggttaaacacatgggcactagagccgaattacaaagggtcagatttaaactttgtccttacaaagctatctcttggcagttttatgagaattaactgaattagttaatgcctgtcaagtgtctgtaatattctttggcacattatcactcaaccaagaaattagttaaatgatcattcttataaaagaagaatatgtgttcacccattttaggtatagaaatatatgtaggaatatatggacacacatcttcaaacttgctaattgagttgttcaaatcacttatacattacttgtggttttgtgtccttgacctggcaataattaaagcatgtcaaaatctcctaatatacactatctaatagtatatacatcttgtaatatatctaataatataatctaactttcttctggctaatatttaaaaacacttgaattttttaacatttaaaaaatgttaaaatccagcagcagagaagaccatgctgtattctaatgcttaaaaaaatctttctgtgttcttaagttttagaagtgttacttgtacacaatgtaattatgtaattgggtaatatatttttttaattcaaccaatactccagcaaatttaattcaattatgtttattattataattagttatatactgttttttcacctttggcctctctatttgttttttttttccttgactttttttaaatcttgctttttattttgagtgtggctaaacttttatattaatttgttttctccatgaacttcagtggttctcatgtaaaggtgatacagtactctccctgcaaacatttggaaatctgtggtgtttttagattatcacaatgactgaagtgggtgctacttgcatttggagagcagagttcaggaatgctgaatatgttgcataaatggcagaatagttttgtctaatgaataattgtcctgcacaaattgtcatttacacttcccttgagaaacattgctctactggtttgaaagtcatgcactatttctattgttccagttatccttgtaagcttaccacagatgcttaatttaaaataatttaaaatcttattcctcctctttaacaattcaaggattccagaacatttgtgctgtaattaaccttcttgtgttatgtatgctattttgcagaattttaattctatcattttttatttggaacccaagaaattatgcattattgtcattatcattatttaattatattagtaatatattatttaatattaatatttgtattataacctcccaatatcattgcctgccatactttcttaaatttcgagttttcttcagagatgatttctttgctttctgaaattccttcagtgaagtactattgctggtaaattgagttatcacttatgtgaaaatgtttttttcttgccctcattcttgaaagagttttccttaaagcacactaccacccttgtacatggcaccgtgtttaccataatctagattattgcaatagtttcccagctggtttccttgcttctctttccatcttataatctcattcaagtcattctttacaaatgtaaaagagatcacgagatggctctgatcaaaaccctctaatagcttttcatttcactcagagtaaaatggaaaaatcttcgtagtcacctggaaggtctcagtggtatcctttaccctagctttgttatctctccaaccttgtttcctgctgctctcactgtcactcccactgctatggccacactggcattcttgcttttcctcagccatgtcctggagctaccacatggcctttgaatttgccatcttttccttaatgccttcttcataactatctttttaactttctttccaacttccctcaggtctttgtccaaatgtcacttgatcagtgagaacttctcaaaccacaatgattttaaaaattgcaaattctcctttttcttggtactactattcccttttctattctatttgcaccattgtatctgacatatttaattacattttcattatctgttcccaccactacaatgtaagttacatgaaggcaatttttttctgtttctgacacatagtggcatctaaataaatgtgaatgaataaagacatgtacaattttatgtcactttttttcagtacttcttaatgttattttccccctgtcttcttggcttccatttttttctgttcaaaagtgtgctgtcaatctttagataatattagcttgctttctgactggcttaagattttctcattatgtatacttcttcagtttttattatagtgtgtcttagaatggatattttttctttgtcctgtttgtagatattgtgtctcttgtgtctttggattcatgtcttttatcaatttgagattctctgccattaccttttccagtattgccttttctccattttctctttctggactttgcatagaggattgttagatcttttaaatctactctttgtttcttttatatcactttaatattacatattgtgtttttctgagctgcattgtggattatctatttatttctgtcttctagtcactgattctatcttcagctttgctaaaatgttgttatttcaaccattgagatttttttccccttagagacagggtctcactatgttgccccagttgatcttaaactcctgggctcaagtgatcctcctgcctcagcctcctgagtagcttggattacaggcatgcaccattttgcctagatccattgagtttttaatatcaacaataatgtttttaatttataaaagttttgttagttacttttcaaatctccttggtcattttttttaccacatgttaccacagactagtcaacttatataaacagaaatttattggctcatggctccaaaggtggagaaacctaagactgaggggctggcatctggcaagtgccttcttgctgtgtcatcccatggcagatgagcaaagaaagggcaagagagagtaaaggggtctgaactcattcttttatatggaatccactcccacaataacaaatctgcccccaagatcatggcattaattcattaatgaaggctgtgactccaggatccaaacacctcccattaggccccaccttccagtgctgaagcactggggatcgtcaagttgtcaatacatgaactttgggggaacatttaaaccatagcatattgcttgcttattttgtgctttcatgtattatttctttggtattttcatagatagtctttatcctaaaagactttgactttatttttttgctgttaatttcaatatctgaagtctttgaagagatctaaatctatcatttgtttcggtttgtttttgcttatggtgtgttaggtgattttttaattgaaagtttatatttgttataccttaattattgagagtgctatgggcctaaattgggatgcttttcttcagaaagagtcccaggcttttttgttcagagcctaggatcctatcaacctggaccattgtagcctctttgaggtatctggactaatttgagaatctgaggttcagcttccctgtcttgcagctgcctaaagcttagtcttagttagttgtgatgaggtcagcaattgtttgccttgcacataccccacttcctcttctcatttagtactgcacagtgctccctacttaggtttcagctcctggatttgttctatgttgtgctgtgttttggtggtggttatagagatgcttggatattgttcttagtttctgcaaacccagcagttctttaaagcagaatgttttattcatgatatacttggtttattgcagaagggtctctttcagaaactctagtttgccatttctggaaaccgtcattctgtctgaaaaccactccaatcaggctttcttccccatgatttcatgtcgtaaaactacacttgtcaaggtcatcaataacttccagattgctgaatccaatgactagccttcatttctcttaatatcttagcatgatttctccccatttcttgaatgaaaactttaacattctttcacataacctgttgagtagctgggctttgaattgcttgattttctgagatgtttcttttttattagagtgaataagaagacggctaagtagttcttaacagtggctcactctgggggctaatcctactcaaaatcactgcatcacacagttcaggaatccaaaaggacaaatacagtactaacaatagatcaaaagaaatgtgcattattggaaacccactatactcacacaaaatttatctctccccttagctaactcagtctttcaacagggaagctgatgctcttttaacaatctctcctcagaaataaaggggtcagagaaaaattattgctttcttgctggctctggtaaattttcagaagcttacaaaactattgcccacctatcaataccagtgagagtgttggagatgatgctaatcattctggtgtttttgtaccatcctgctttatcatcgctgtgatgccccataggcccttcttcaccttggacaactctgttatttcattaacaataactgaagccactcttcatgaaattctacaattcccacaaagacaagttcttccagtaaatactgttaaagactaaatacagacatcagaattcaggataaaattttgtttgtcttataagtcctttaagtcaggatagaggcaaatgatgtcactggctcattctttatatgaaaagtgaggagctgcatgtacagtcatgtgctgcataatgatatttcagttaatgaaagactgcatatacagtgatagtcccataatattacaaaagaactgaaaaattcctatcacctagtgatatcatagccattgtaatattgtagttgagttgatgctattgtaaacaaaacgattgccctgtcagctgtataaaaatatagcacatacaactatggacagtacagaatacttgataatggtaataaatgactgtgtaactgatttatgtatttatatatttcctatactatacttttcattattattttagagtgtacttattctacttattttttaaaaaagtaaactgtaaaacagcctcaggcaggtcctttaggaggtattccagaagatggccttgttatcatagaagatgacagctccatgtgtgttattgcccctgaagaccttccagtgggtcaagaccatggtacaagacagtgatactgacgatcctaacctcgtgttggcctaggctaatatgtgtgtttatgtcttagcttttaacaaaaaagtttaaaaagttttaaaaaagcaataaaaaatttaaaaatagaagaaagctaaagactaaggacaaaaagaaaacagactttttttataactgtatattgtgcttttgttttaagctaaatgttactacaaaatagtcaaaacatttaaaatattaaaaaagttcctaagctaaagaaattagtaagctaaggttaattatcgttgaagaaagaaaaatatttgtgtataaattttgtgtagcccaaatgttgagtggttgtatagtctacagtagtgtacagtaatgtcctaggccttcacatttactcagcactcactcactgactcacccaaagcatctcccatacctgcaccctccattcatggtaagtgctctatacaggtatacaatttttaatcttttatagtgtatttttactgtaccttttctgtttagatatttttacatacatgaatatttactattgtgttaccaattgaaagtttctttagaaagaaatagaactttaaataatcagtgatagaaaaagagtattataattgtgacatgtatagaagttgtgaaacctaaaaaaatgtataatacagaaggaagccacatttaccctattacttaaattcatcgtgataattatgaacattagctgctactccctgtgaactaaccaaactgagggttttacacacacacataatttagatgattctttatggtaaagataaagatgtttacatcttgaaaaccaatttactcttttatcatgataagtagatactttatagtcaggaaataaaatacaaatttgttaaaactcagtgccatgtacaaatataattttgtaaactagtgtgtcttcatttatgtttttaaatttatttttaatggctactcttatttgcgattataacttctaatgtaatctccctgaagttaacaggtgaaatgttttttagatcaggttgtagtagttttgtgagcatgtgtatgtgtgtgtatatgtgtgtgtatgtgtgtgtggtggtggtgatggtgcaaaaggtggagagcaaaatacaaagacatgggttttaaagatgtctttgaaagaatgctgataacattgctgatgatctttttattttttatgaggtaagcagtatagaattcagttgttacaatcttaagtttgagtcttgggttctcataaaccaataaaaggacatcatgtgtgagtttgctcctataggaatgagccagctttacctgacctagaggagtgaagtaggtctttgtctccacagctccacagtggagtctttctttccacagttgtgtgggaagaagagaagtcattatatgaggtgtggagaatagtcactcttggagtatccttttggtgtataaaaatctggaatcagagatcatggaagcatccctggaatgaacaaccttagaaaagaaggctcctttttccccccaagggccaagagtgatgctgatgtaaaagattaatgatttaaaacgtaagatttattgacaggattcttaatttccatgttaaaaccacacagatagcatttatcttacatgtagattttagttaataggtattaacgtatttcagttaattgacatatatatttcagttaactgaaactctagtaccttgtacaaagagtgcttttggggatggaggtagcctgggtgaacagaatacatctaagtattttggaccaaatatggcagtaacagagaggaaagtactaaaattactaaactgggctcttgtaaaatgagatgaaagaagagttattaagtgactttagtaatcctttattgaatctttctattgtgaggcactggcctaagcatagtgggggatttaagatgtccttacagagtgtgtgtgaggctggttaaggaaacacgtatccatacctaactgtaatatggggcatagcacagtgtgggccatgtggaagtacaaagtgccagggtacatgagagggaagcaattactccttacaggaagacttggagaaaaatttatggagaaggtgaaattgtagtttgaccttaaaagttgagtaggatttcaataggcagggatgcaaaacaggcacaccaaaccatggatggagtaatacagagtggattctagaaataagtggaaagactaaatagtggctggagtggcagataggtgggaggcgtgaggtgggagggagatcaggcaaaacagtaggttaggacccggccacagcagactgagtgtcacatgaaggagttttccctttattctgcagcaagagtcattgaagatttggaggcagtgaatttataggaacagatttgtattttaggaagataattgctggcagtgggagttcatttccacaaatatgtattgagcagttgtgcagaggaatatgaaggtgactaagacatttctactctcagagaacttagtctattaatatgaaaaaatgggttgggaacggatgagattggaggcagagagatcagttaatagcttctgtaattgtcccattgagaaattctaaaaatttaagctaggacaatagcaaggaaaatggaaaagtatgaggcaaactcaagagacatttcaaaaaagtatcaagagttgttgacactgagtggaagctgcaggtaagggaaatgggagcctccttaaaaatcactcaagtttctaactatgtaaccaggaggatggtgctgttattcggctaaggtgagaacacagaggaaaggagggcttagagatgagagggtgatgtggtttggctgtgtctccatccgaatttcatcttgaattgtagctcccataattcccatgtgttgcgggaggggcccagttggagataatttaatcatgggcgtggtttttcccatactattctcggggcagtgaataagtctcatgagagctgatggttttataaggggcttcccatttcacttggttctcattctgtcttgcctgctgccatgtaagacttcccttactcttctgccatgactgtgaagcctcctcagccatgtggaactgtgaatcaattaaacctctttcgtttataaatgacccagtctcgggtacatctttatcagcagtgtgaaaacaaacaaatacagagaaagagcagattgaattctgtttcagatctgtttagtttgaggtgccaacatgattttctatcaggagaggtacaaaaggaatttagaaagacagatctaagagatgaagaaagaaaaagagaactaagattataaatttggaagaggctgccagagaaggtagttgaaattttgtctgtgggtgagatctcccattggaatagtgtagagcaaaaaggaggagagggttagaaaaacatgtgccatcagtgagttttcaaagaactggtgatataattgacttaggatattataagaaaattcaagaaagagagagtattcctaatgagggctggttagcaatatcaaatgctgtgtagaggtcagctagaatgaagggtaaagagctcagggaactttttaatgagaaagttattggccacctctggagaccagctgtggtagaggaatgggctcagtagtttctatctattgcagtggaatgaggagtaagtgtgagatgaagcaatagggaaatagatttctctttacccatttaatccataaatatttattgagcatttgcttctcatttgtgaagtgaggagaagggggagacatgagatagttatatagaggagaaatcagggtcaaggaaacattatttttggtgggaaagataaaactatagcagaagaaaaagaggcagtgcagagggagagactgaggctacaaaaatgaaaaataaataatagaaccaagttcccaacaggtaggaagggataaactccaagcacaggtagagagatttgctttggtccagaagatgttagggtgggtggggaaaagggtgtggttgatttggggctgtatattcagaactctcagtttaaatccacactaacaagtggctttctttgtggcttgttattgtctgtgataattgtttatgacacagcataataatagaatttttctttggaatggaccctcgcatttttttttcaggtgaacagagatctctaaacatcatttgaaatgtattttgagctacagtactaagactccacctagccatttaagacaatattacaaaatgaagctgggtataattttcagtagtgtagtcacacagcaaaaatagtctctcaagcaataatttacttgccatgtagaccattataaccagtctctggaaatgattcctattggcatcaattggtgatcatgtaaaataatagcagtgtcagcctctgaatgtataatgatacacataatatttaaacatttttgagagctgaagaaactattatgcttttattcataaaaaatatgacagtgtttagagcatgtactagtcttgcagaagagaccctttgtttactttgtgatgtaaagatgactgtttccccctgtgtgagttgcagaaaatgtttgcaggggctagttgaaacagcctcatagtgggataaaagaagcttggtttctggtgaagaatattcatacttcgattcaatttgtgtagaaactcctttggctgcaaaggtattgtttaataaagattcattttaggaaggttcaccaggcagcctgggaaatggatttcttagaggatttagagcaattgaggagagatcaaagttgacaagataacttaactttgatttaatgcaaattgctacaaaaatgaagggggaggagtcacaagggaatcctattttcattattgacatgaactggcttgacattcacatattctaagtggagactgtctacacataggcaagaataaaatgaactgaagaatgcactaaaattcgacactgtgaaataatactcctctcctcccttggcaaaggaatgaactttgatacagagacattactttctgactactaggaaatacgcaaattatacttttgagcatttacttgaattacctgttttcatctaaaggactgacctattcctccccttctcctcggatgattgtttttattgcttagtttttgctatgtcgtcaaaaaccttgtatatttctcattggacatgaattaataatgctttacctgcaacacaaagaactattaaagtgataaaaagacaatgagtgtatttcagctctccaataaaaaacaaaaacccactcctcctcgccactagactattaaatgctgaagaaatccacaggctctctgcaaagaaggtcacatatgagtctgttaaataaataagttaattaaaccttgacattctaaaacaattctgaaaagttctaattaatttttaaacaatattgaaataatgatttcatatctcacattcatttaaagtagtgtaacccaatcaatcccacacacagtatgccacaataagctgctgattttctaatggttagaaacacagttcattggtctgaatagtaatcatgatagcttgcggggaggggaaccactgagggtttatagaagtgatcagaatctttaatgactttattgactccctaagtatttgctttgtttcttccttgataatatattgaggcccagaaactaatatattcaagtgcattgttttttaaagccggtgtttacttcaagtattggattggctcttttgactggagagatttttccagttcaataaaacggtttggattttttttcccatggaattctcaattatgtctccatcctcccctcacataactgtacaggtgtatgataaaaccagttcttaatcactggtaaagattcatcgctttattgtagtgtccattgctgctgctgtttattctgttgttggtatgttttaatgctggatgtttaaatgaaattgtgtgcttgggcaaagttacaagagaggtggtggggaatagtagagagtgagctgaatctggttggagcccagaggcctgagctcaaggccagtgatctttctaaaatgtattgctgcccttgagactatcttgcttatctacagcagagtttctaaccacctgggtgagatttcctgatgtgctggttaaaaaggcagacccaaggagctccattccaacctattgagtcagattctctggggatggtgtccacatacttgcattttaaacaagattcaggccttcatattaaagtctgaggacctgacctatatgataaagtctaagtttcttggcacatcaatgacagcccttccagagctgttatctctcatctctcaccattcccactaacagtgatcagtaaggaaacatatgcatttttctccacatcatactgtttcaggatcagcaaatgctattgtacatgattgtcttagtccatttgcgcttctataacaaaataccacagactgggtagtttttaaacaatagaaatttatttttcacagttctggaggctgggagctcaagatcaaggaatgagcaggttctgtatctagtgagtgactggtctctgcttccaagatggcaccttgttgctacatcttccagaggggaggaatgctgtgtcctcatgtggtaaaagggatggaaagggaagaaaaaggaccaagctcacttcattaagcccttttataatggtaataatccattcataaaggcagagcctaaacacttcccagaaggtcccatctcccaacactgctgcactgaggattaagtttccaacacataaatgttgggggacacattcagaccacagcaatgactttgctccaaactgctcacctgactattcctatgggtacgtttatattagaaagctctgtgagacagcaagctccatgagggccatgattttatctattttggaatttgtatccttagctcccagcacaatagatgttgatatggtttggatgtttgtcccttcaaatctcatgttgaaatgtaatccccagtgttagtggtggggcctgatgggaggcatttggagctccctcatgaatagcatggtgccatccttgcagtaatgagtgagttctcactctgagttcacacgagatctggcatgtgtggcataaacccaccccttgcttgatctctcactctctcttgccatgtgacacatgttccccttcatcttccaccatgactggaaatttcctggggctctcaccagaagcagatgctggcaccatgcttcttatacagcctgcagagctgtgagccaaaataaacctcattttctttataaattagtctcgggtattcctttatagcaacgtaaacagaccaacacttatgcccacaaatattctttgaatggatcagtgcttagacatcatagccctcacttgcccaagaaagatggctttctactcttacttttgtacatagtcttaacacaaagctagttcatgatagtgaggatccagatatactgaccctggagcctgtttcttggtttgttagaatatattcctccaacaagaacttgtagcacaagtcgaataacttagaatgtggcacacattcattcagtactgctacctagaggggcacattaacgtagctttaggctgatgatgattcctattttcctgatctctcctaacacaaaaacattccaggtattcttttaggaagtagttagttgtttaaatattagaaatggttattgctgaaattggcagtgagttcaactgttgccaagcaccagttccataatcagaatccctaaggatggagctcaggcacatgtcctctttaaaacctacagggaggatgctgatatttaaccagtgttaaaacactgcttataactgcatgcaaaataatgtatttagtgaccacctatatggtgtatgctctttaaactatttggtattgtggaaagacaaaaaaactaagactcttacttctggcactaactagctttgtgcctgacaccagttattatatttattgctcctgggcctcaattttgttatatttaacatggggtattgcgtagacaatctctcagattcttgacaactctactttgccatactcttatgagtataagccaaagtaaaatcagacactggaatgacagaattacacaggtggtatgtgtatcctgtatgtgtattttttcctaaacaaatctttctaaattggtgcttgtactggggatgcctgtcaggtttagtttattatgctaaatagtgccctcttggtgaagctaatttagcttccaaagtcatggattagcaacttccacaatgagaacatctgatcggatcacatttgcactctaaagcttcatttgagttagcagacatttcatgagttccaactggtatatcaagcactgtgctaaattctgagattcaaaaattaataggacgtactccctgtccttgagttgctaacaaggataattgatggacaaatacagaggcagtaagcaggatgattgcctataatggaaaaataattttattctttactggtattatcccactctaggtatttctgaggatgctagtcacttgaataggaaatattatttaattgaaatatccagataattgccatgctttctgcattagtcaggatacactacattatgctttagtaacaacactcccccaaaatgtcagttgcttaaaacaacagaggtttatttcttgctcatgtaacatacccatctcagggcagcaaaggaactctgctaattttattcactccagccctccagtctccaccatatcaaacattcctccttgccgtactcgagggaagtgagcactctggagaatctcacactgcctgttaaatacactaatgtatgtgactggttcattggccagacctagaaacatggctccatccaaccacaaggaagataagaagcaccatgtgctatagggaaagagaattttatttgactaatcatacacatgactgtcatgcattcctgagtaggcacaatttgagaatataataaaaacaaacatttcaatggctttttaataagggttaggtactgtcttaatcattttatgtgtaaaatatctaatcctcacaacgacatttttattattctcattttaaagataagaaatagaggcacaaaagattaactaactcatccaaaatcccatcacagcctgggatttaatcctaggcagtctggctgcagagtccatgctcttaaccactaaactgtattgttatatctgtatcagtcataaataatgtgatttccttgagacatgattaattaatggcacattttctaggaaaattctgagtgtacaggcatatcagaggtgtgaaatataattgttgctagtattttgtaagcctacagaaatagaagtggcccaatcctgaggacatttattatagcaggcatttttctattttggtatgctttggaatttcaatgcatgactggtatccctatggcaagctctaatttagactgatttgtttaggagaaataaatgatagcttatttatagaaatcaaaatgcaatctgactttaaaacatatttgcccaaaaattaatgaaggtagcatgtagggctgttaacttttaatgatgagaaataatgaggatgcaaaaccaagctgagagaatctcgctgtggtgtagaggggtcccctgaacaattctgcaagcctcatgcatcaagtcaaggtgatgggggacaagcagcaggatctgaccctggttgtcttaagcagcaaatggatttattaaatggaacctgagtagccggcagggctgctggggatgctggaaaatgagccccaaaaagaggcagaaccaagtggtgctgggatcctagaaacacagccaatatcatgagcacccatctggcgaagcgccgctgcaccagcgctgaaagatggacgctgcagcttgtcccgctggcaaggatgctgccactgcacctggaagctccataccgctgctgctatcagtgccgctagaatagattctcttctctccctgcttctttgtgccctggatccacattcaaagtcgtgagtggcttcagctgtttggccaggcctaaggcaggtgcccatgctctagttaccaaagagcttaggaaagtgagtcagcctcctttttaagttttacagtgggaggtagactcttacttcttcacatatggagaattatccaaatctagaaagggcattcagattctgaacagccaaaataatttttttaggaagacaaatgttcactgtaactggttagatgtgtctttctgcagtgtcattttgtgtgattagtcgggaaaccatatccttgtttccttgtctattgtgttgctttctttcatattaactgtagcttttaaagaggacatgtgcctgagctccatccttagggattctgattatggaactggtgcttggaaacagttggactcactgccaatttcagcaataaccatttctaatatttaaacaactaactacttcctaaaagaacacctggaatgattttgtgttaggagagatcaggaatgactttcagaatcatattttcccaccgtaaattaactaaatcctgctacggtttggcttggcttctaaattttgtaagaacctacctagttcctctcctcccctgtgtaaccctatcttaatcaactatttctcacaatctttcattgttcatttttcagcgtttctttttttggcagaaatgtggtcagtaggttttagtgtattggacatccttgggtaaatcctgtaacacctctgacaccttcacttcctttgaaccctcaggcatcattctctagagacaaataaaaccagatggaggtgaaagcatgagaaaactcacctgaagaaaaagcgttttaaaatgttacctttctcacctgagaaaaagggcactgaaagggaggaagggagggctggattgtttgagagtgctgacggctaaacctgtcctggagtagcctccctctggtattttctgtgcaaggcgattctgatgttctgcagtgttggtagaaccgtgagttctgcggctaagaagggcccatagcatggcatgttcaagggggacctaacttgacctctccaaataattcagaatacagcattgttattactggaggaatccatgtaggggctgccactacccatggtctttactctctagtagattgactaggacacacttggtacatctaaaataagtttcttaattaagttggcctgtctatttgacagcctttgggttctcaagaagataatcgtctgtgcagcctctttcttttccactaggctgtggtcccttgattgctgacagtgttcctctaaaatgcaatgcttctgcaagtttacagacttcgggacttcacagctttatcgaccatctgccactttcacacaattagttttggcctttctctctgattttaattgttccattttacaaagctctttactattcataaatcttttatcactcagttaatcaaccacccaatgcttaattaagttcctaacatgtgcctaacatagtgctgagtacctgtaggaatatgcaaagaccatggctttgttattccccacactggggctgcacttgcacaatacttggctccttttgctgtacctcttgtttcaccttctacctggttagtacattaaatttcctgtttagtgttaacttttgaacaacttgtgcttaaagagctacaataaatgaagataacattttaacaacctggaaaaagaaggtgaaatatttattttttaaatgaacctaatggagcagtgctattattttaaatgcttcctaccaccaaagtgttcctattgttgggaaatgtatttagtattttttctgaattgcttgaacttttcaaatgaattgtttgtatatgtttttgttatttgatgagttggggaatacagttggctcactaaattcttcacttttcatgttctttataagaagaaattatattgagatactgtaacgtaaatcctgttccttgcaatttgattgcagagaatgcattgtttgaaaaaaaaactcttgacattttgatatttcatctttcatcttcttaggtgtccaatcccaaagcaaacctcacaaaatcagacatcattttttggctgacttgtcatttcactattattagaactcttgctcttacaagggactttattattagaagttatgataatgtatcaggtatttaaaactactttagagaggccgaggcgggcagatcacttgaggtcaggagttcaagaccagcctggtcaacgtggtgaaacctggctctactaaaaatagaaaaattagccaggcgcagtggcacgtgcctgtagtcccaactacttgggaagctgaggctggagaattgcttgaacctgggaagtggaggttgcagtgagctgagatcatgccactgcactccagcctgggtgacagagcgagactccatctcaaaaaacaaaacaaacaaacaaacaaacaaaactaccttagagaaaactttaaaaacttggagaggaagctcaagggggtggggtgtgtaggcagatctttgttaatctattaacgtatagctttagactgagagtcatcggttctatatggttacaattatattatacagtcctctttagaaacaaaagcctctgcaggctgagcacaaattaattatccacaatctttaagcaatgaactgtattaaaatcctgtgttctgtgaggtagtcctaaatatttggaatgcatgattaattccagcggtggaaagaaagtgatacatactaatgccaaattcaaattctccggaggcataggggcatccagcaaagcaacaccctttctaaccacttgatggtgtcttttctgcttataccctgagcaacaaaccataggaaactaatggtgttttaaatggaaaacagcagttgattaggatgggttaataggttcttggcaaaatttcaacttaatgggtatgcaagtgtatctgtgtgtgctcagcaaggcctgtcccaggccatctaatggtgtcactcagtactataaatttactttgacagctagtaaacagataagtgcgtcctgggagcagggagtatggagctgctcgcaatttccaaaagacgcaaggcaaatagagccaggcacatattaacgtagcaaacatttaacttttctgcttctccaatctttaatagaacgatagtaaaatagcaaaatatgatgcgaaagcttcatttcttaaaatccttaaatcatagactctagttaggaatttaaggtcaaaataaaaatacattgataaaaatatatactttaggggaaataaccaagggccaagcaatagtttaaagatatcagctttcttgttctgtgttagatcaatatttctgttggctacagctgagttgatagaagattcatataacgagcagacaaccatctaatctaatttcaccagccataggaaactgcagtatgatatgtttatatttcattgtttgctgaggaagcttgaccttactaagcaggttgctaagcgttgtttcacggtgtatgtatgaaattgccatatgtgtgagaaattgctataggtattcattccgtagagagtactatagctttctgttctttttcaggcaaccaaaataacactgcctaccccagagaatgcttttcttccaatccttgcaacaaaggcatttgagagatgaatcaggatttaatgtcaataaatggaactagcttaagccttgggaattttgagagcagagaaaatggaagactttactattttattttttgtttgtttgtttcaaattagcacataaagacaacaggaagagaagaggtctggcttctgttaagtctgagtctctactattagcaccaacctaatagaaagcagctatgggtagtggaaagtgcaatagacctagagtcaaaatctaggcccaagttccagtttggccatttaaccattggtcctcctggaaagattcacataacccctctgggccagttttcttgacagcaaacggaacagataagggttccttcatgcaatcaaggttttttgcaactgccaagtattctaggagcttcttaacatgtaaaacttgctgcacattccaaatccctatttttgacattcccatttctattggtaatataaatatgtccctcagtcaaaacatctgtaatcgctactgttgtgtatggtatcagttggtgcaggataccgattatttacctaaactaaataaactaaagtttactttctaagtttttatctacacaaatattttgaggtgaaacaaaactagctcatcataaggcaattatgttttcatttatttgttgccaattattcactgcggacttgtaagtccaaaacactgtgctatgcactctgggaaactggataaggctatgaataagagtctcttccggcctcctatgatcttgcagcctagtgaaatgtccagatgtgtccataactagcctgatagaaatcatatctcttagaagaactattagatgactctaacctggaggcttcaatgctcattagtattcactccagaaagggcgtttgcttttccatgtgtgcctttttcaaagggcatttcatgtccaaattttacatcacatcagtctgggtgaaaaagcacagcctcttaagcacacgtgcacacacacacacaccagtggttttaacaagtatttcttgagttcagtaattttattgaatatctgagaggggtcacaagtatgaccattttatacaatcacagcccactcctcaaattcctctccttgtcacatgaatagcagtcccaggacaattcttgatatatggaccacacttcaaacacttcaccaaagtactttttttttttttcaaaaaagtaacagatttcttctaaagatttctggtgaataaaattttcaccttattccataagcttttatgaattgtaagtttgtattatataacaaaagcttttttccacctacatgtttctccttcctctattatgtgtttttccccttagcagtgcagcaatgagctagtgacatatataaaacgaacagccagcaattagctctttgagagctgtatgcaaaatggtgatcttaatgaaagaagaggaaagccttagcaaatttctcagactattagggcaccattgaggacaattctgaaacagtgtctctatgcattcagcaaaatgagccatagcacaccacagtgcagtgggtcattgacaatcccttcatgttgaaagaaaaaataaaataagaggattaactgggctgccatttattcatttttttgcacatatggcttatggcctacataaaaatctctaactagtcagtatctttctctgtatagaaaaagcaacaactccttttattcctcctcaagtttgcagtcttcaggcgaaatagggtgtctttaaaataatggtggctttttagcacctgcagggttcctagtcctagattggctgtagatgtcacattctatctatgttaattaaaataatataacatgattttaggtatatttttatacatactaacagtatgtataaaattgttcccatttttcaagctattttatggtaaataattgttgtgctttgaaagggcaaaatttgaagtggaccatattataatatatttgaaaacaatcctgtgagaaagacacaactatttccccctctgaaacagtagttatattatattccaaagagattatttcctaggtgtctaaatgcttgctattttcatttttgtgacatctgtgttctaatggctatttattctatagccattatcaagtatggaagtatcaggaaagaaacttctaaggccttggtattttgagagatactcttaactgtgggacataaacgttttcacttgacagagagtaatagatgaaagtaaagtaattttggcctttgatatgaaaattttttttataaaccagtctctacaattattgagttatcgtaattattaagaaaataatgtggtcaatgtatcaacaaaaaagtatttctcttattgagtgaagaaaactttacattccacaataatctgaaaacatataggctctactcaaagcactcaaaacctaagaaattgaggaatttatattgaatagtcagtcccagaatttgtgtttctatgaacagcagatagttgtttcttgctttttcaaaatttatgtaaatttacaagctctgccttttaattagtatttagacaatttacttttaatctaattatcagtggagttgggtttcaaacccagcatcttgctgttcattcattaatttgtcctatctgttctgcgttcctttgttcctcttttctttccttctttttgaatgagcattttttattattgtactttatctacaccaataatttaatagctatactttgttttattttttaccaattgtcttagtccacttgggctgctgttaacaaactaccatagactgggtagcttataaacaacagaaatttagttctcacagttctggaggctgagaagtctaagattaaggcaccaacagatttggtgtctggtgagggcctgtttcctcgtttatagataggtcttctcactgtgttttcatagggtagaagggatgagccatttctcctgggcctctcttagaaggacactaatctcattcatgaaggctctgcccccatgaactatcacctcccaaaggccttatctcctaattccatcatcttgggagttaagattttaacatatgaattttagcaggacacaaaattcacaccatagcaatggttgctctagggttcacagcagacacgtctttaacttaccagtttacattcaagtaatattataccactccatgtatagtataagaatctcctgtcctggatctaattattgttgcacatttaaattaaatgtgttataaacttcacaatacatttatattgtttttgctttaaatagcctattaggatttgaagagattaaaactgacaaaattgtatttatatttacctatgtatttatcatttctgatgctcttaattcctttgtgtagattcaactttctatctggtatgattctctttctgacagagaacttattttaacattaccatatagatctgataatgaattctctcactttttgctgttctgaaataagtctttatttcatcttcatttttgaaagtttttttttcctggtacagaatttcacacgaacagtcctttttttttttctctctctttagcactttaaagatgtcattcattgtcttagttttctgatgagcagtctaccgtcattcattcttatctttctttctctgtatatatgtctttctctggctacttttaagattttactttctgttttgctgtttttcatcaatttgattatattgttccttggtgtggttgacttcatgtttatcctgcctggggtttgatgaaattcttggctttgtgtgtttatcattttattccaatttaaaaaaaaattatccattattttttcaaatatttttctgcccttctcctgctttggggattcttattgtatgtatttgatcacttaatagcattagattcttgatattttgcccacaaattttaggcttctacctgttcaaactctgatctctgtctcctcaacttgctgaaatcattgcactctattttggttcccttctctgagccttggcctggacactacttccaggcaataatctgggactactagaaggtgaacctagcttgctccccttcccttaggcattacagtcctttgccttgaaaactgttgtattttattttttttctggttttctagttatttatagcaggacagcaattaattcttcacagttagaagcagaagtttctcctgctttacttttaatcaattcaaaaatttaaaaaataactgatcttttcaaaatacaaataggaatatatgatcttgtgagcaaatctattgcatttaggataacatcccaaatccttttccaggcacagaggccctgcatgatctggtcctgcctttcctttgtaagtgcatcttttactactctttcctccattcaaaccctccagtaatactggctaaatccttttattcctcagacctaccatgcatgctcttgtctctgcctggaatgctttccccattttctcttagggacctattactcatcttttagacataggcttgaatgccacttactcagagtgattttttaccccctgaacacttcccatgtaaacaaaataggtttccctgttatattctgccatagcatcctgtagatttcatttacaaatactgaacctaattactagttacgttttctttgtaagcttatttctaattgttcatctgcctggtagatgataagctccaaaattgtatctattttgtacgttcttgtattcctaggctctggcagatagtagacattcaacaaatgtctgttgactaattgttgtgtaaactaggtaatggagcactgcattgttgcttggattccatgctctgcatcattacacagtgcagggcacagaacgcaagcaacaagaatcattataagaaaacatacaattataagaaaatatctaaatgtcacagcttctttatttctgtatttttagtgccacatgaagtttggtgtgaggggtaaaagcaaaaggcaatgtcatttcctgagtgtttttgtgcttgtgactattagttgctacaatcttttaaaacacatagcacagaagatgtttcattttcctattgctttttagttactacaaaacattctgattgctgattttgagaaatgcacaacagttttccacatgcctcttagtctcctttgttggttcataaccttcctcccatccttttcagtatggatttaagattttagccttggctctttggctctctgcccttcttgttagaactctttctttagccattcttacccttgcctgtagattgtctttcaaacgtatgtttttaatcctgatgattcctctggattccagacccatgtatccaacgtcaacatgacacaggacactttcatctggagatctcacctatgtccagaaataaattaatcatcagtcttccaaactcattccatgacttctgtttcttttgccagtggctggcacaaccatttgattagacatagttatttagtccataaacataaacatcatcatgaacttctctttcccctccccataaactgtggttaaattctgtattagtctgttttcacactgctgataaagacatatctgagactgggtaatttacaaaagaaagaagtttatttggacttacagttccatgtggctgtagaagcctcacgatcatggcagaaggcaaggaggaccaagtcacatcttacatggatggtggcaggcaaagagagcttgtgcagagagactctcatttttaaaaccatcagatctcgtgagtcccatttactattatgaaaacagcaggggaaaaacctgtccccatgattctattgtctcccaccaggttcctcccataacacatgggaattataggagctacaagatgagattagagtggggacacagagccaaatcatatcgttttggcccttcccaaatctcgtagcttcacatttcaaaaccaatcatgccctcccaacagttccccaaggtctcaactcgtttcaactcaaaagttccacagtccaaagtctcatcttggtgacaaggcaaatcccttctgcctatgagcctgtaaaatcaaaagcaagtaagttacttcctagatacaatgggggtacaggcattggataaatacagtcattccaaatgggagaaattggccaaaacaaaggggctacaggccccatgcaagtccaaaatccaacagggtagtcaaattttaaagctccaaaactatctcctttgactccatgtctcacatccaggtcatgctgatgcaagaggtgggttcccatggtcttaggcagctctgcccctgtggcttttcagggtacagccttcttcccggctgctttcatgggctggtgtcgagtgtctgcagctttttcaggcacacagtgcaagctgttggtggacctatcattctggggtctggaggatggtggcccacttctcacagctccgctaggtggtgccccagtagggattctgtgtggggactccaatcctacatttccctttcacactgctctagcagaggttctccatgagggccccacccatgcagcaaacttctgcctgggcatccaggcatttccatacatctttgaaatctaggcagagattcccaagccccagttcttgacttctgtgcactggcaggctcaacaccatttgtatgctcagaggtttggggcttgcatcctctgaagccacagtctgaactctacattggcccctttcagccatggtgaaagcagctgggacacagagcaacaagtccctaggctgcacacagtagggagaccctgggtgtagcccatgaaacaactttttcatcctaggcctctgggcctgtgataagaggggctgccatgaagacttctgacatgccctggtgacattttccccattgtcttggggattaacattcagctcctcattacttatgctaatttctgcagctggcttggattctactcagaaaatggaatgttcttttctattgcattgtcaggctgcacattttctgaacttttatgctctgcttcccttatgaaactgaatgcctttaacagcacccaagtcacctcttgaatactttcctgcttataaatttcttccaccaggtaccctaaatcatcactctcaagttcaaagttccataaatctctaggccagggacaaaatgccaccagtctctttgctaaaacatagcaagagtcacctttactctagttcccaacaagttcctcatttccatctgagaccacttcagcctggatgttattgttcatatcactatcagcatttttgtcagagccattcaacaaatctctaggaagttccaaactgtcccacattttcctgcttcctctgagccctctaaactgtttcaacctctgcctgttacccaattccaaagttgctttcacatttttgggtatcttttcagcagcgccccactctactgatatcaatttactgtattagtctgttttcacacttgtgataaagacatacctgagactgggcaatttacaaaacatggaggtttgattagacttagttccacatggctgaggaaggctcacaatcatagcagaagataaggaagagcaaatcacatcctacatggatggcagcaggcaaagagaaattgtgcagagaaactcccatttttaaacccatcagatctcgtcagtcccactcactatcatgagaacagcataggaaagacctgtccccatgattcagtcatctcccaccaggtccctcccacaacacgtgggaattatgggagctgcaaggtgagatttgggtggggacacacagccaaactatatcaaattatgtcacttttacccgtcaaatatcatttgtgtttatgtatttctccccatctcctttggcatttccttatccaagatataatcatctctcacctagaatactgttccactcccctgactggtctctttgcatcatccttatttccttctcatcattctccacactgcagccagaatagtctttgaaagaaatacaatttttttcatgcttagaactcttcaatggcttcccactgatgtcacagtaaagataaaaattctagcctacaaggccccacataaagtcttcttactattgtctctgccttttctcttccactgtcattttggttctttttcttcttttcaattatgctagacttttattagatcctttaatatgcatgctttctccttcctcataggcttcacatgtgctgttccctttgccttgagcactcatccttctaaccttttgcctatttaactcctgcctgtctttccacacttactgcaagccttccttgactcacaaagtcaagtttacttgctttacacatttatagcacttaaagcctcttttttaatgacacctaaacacaactttaattcaacaatttactgtataaatagttggttatgtccttctcttaagctccatgagagcagagcctatgtctctcttatttcttactaactctggtgcctagcatagtgtttttaagaatgtagatactctgtaaatatttttggattaaaagaatctttgaaaggtttgctggtgcatctctctcttcacaagaggaaaagatatatgtgtgtgtgtgtgtgtgtgtgtgtgtgtgtgtatgtggatatgtatgtatgtatgtatgtatgtatgtatgtatatatgtgtatatataaagcccaaggtgttataacaattcaaatttgatcttgaccaagtcagtggtcgggaagaatatgatttaggaaggagtagtggagatcaaggacaattaggtaaaacatggacattttgagcacaggatgtttttggcaactctgtgaatttaggttaaatgcaagcagggtgagagagtaatgactcaagatctagctctggaagaaaaaaaactgatagaaaaatggtgaaaaaattacggttcccttttgattgctgggctccattgtccgtatgcaaaatggatagtattagggattgaacataaggaatacagtaagacaacagccaagggaagaaaagcaagactggccacatgtggtggaaagctagggagaatatagctttcacttcatgtggactgcctgggactgtatttatccctagccatatggctttttggcatagaggaacagagtattctcagaattatcagtgatttcttaaaactgtgccattggacctaggtaacattagcccaaagacttggctagagtgaaatttgtggataacagatctattgtgggctattctgtggagttcaggacatgcagagagtgtctatggtagagagaaaggaagttgtacaacctgaaaattttataatcctgttagcaaatatttattgagcacctcacattgtgaagtactagtgattcagtaaaattctagacagtcataaataaatatatgagatcccagataatagaaaaactggtatcaaatcttataaataatataatactacaaattcacaaattaattttatttataacaaggatactagcaaaagtttcttatgttggtcctgtggttggctcaagaattatagatgtaaatggtgacttgtaagagaggaagaagaagacagaatagcaaactctaaaatatgcttgtttatggatatgttaagtatttgaattatgaatatacaagggtcatttatctttgagggatatattccaagaccccaagtggatgcctgaaatcatagcaagtaccaaaacctatatatactctattttttctatatacacctatgataaagtttaattcataaattaggcacagtaagagattaaaaatagctaataaataggacaattgtaataacatagcataataaaagttatgtgaatatggcctctcttcctcaaaataccatattgtactatactcacccttcttcttgtgatggtgtgagataataaaatggctatacgattacataaaatgaggcaaaggatgttggtattgtgatgtagcattaggctactattgaccttctgatggtatgtcagagggaagatcatctgctttgggtgatcctggatcattgagccatggcagtatcaatggctggatgtcaggagcagatgatgatgatgactaatgagtgggttgcatagatagcatggagatgctggacaaagggatgattcaccttctgggcaagaaggaacagggcagcgtgaggttttatcacactactcagaacagtatacaatttaaaacggatgacttgtttatttctgaaactttctgtttaatattttttaaactcagctgatgacaggtaactgaaattacagaaagcaaaactgtggatgagagaggactgttgtatgcatgttgataccagagaagaaattttggaaatacacctcctgttcgtggtctgcctgatggagacctctattgtagttataggaaagaaattttactccaaatgcaaattttatttaataaagtgtaacttcctggtctgctgtattgagaaggattctgaggttcgatctaagctcaatgcatagagtgatatgattaaaatggttgaaatgggcccaggatgtagttatagaagcacttggtcacaaattgttcctccttgttctatgttgtgatggaacttatctcccgccaccaaatcactgaaatccatgcttttatttattcaacaacaaaatttttgaatacttagatgtgcctggcactgtgttatacgctggagatacaaagattaaaaaagatatagtccttgcatttaaagatgattagaaataacaatgttattatatttaagaaaataatactatgtctctgcatgaacagtattgtgaagtgctatattttcttcctgttttttcctcatcaaattctactgaataaaatctgcttggtttaattagatactaaaagtaggctgaaaactgtcattctcaactcatttggagttcaagatgaaaggtcttacaaaatttataaatcatagcgaattgtcattcaacagagaacattgttatctatggatatgggctacactgaactaacagtggtattttggcacattttctaaacctccatgacaaaacaacaacaacaaaatatcattgtgctgtgacagctgttaaggataaagatgaaaaaatgattccagaaaagagaagtcctattaaaagtgtatctgtgcatatagaacaatctgtccctatatatattttcctctccttctctctattaccattatccccaatccctgatccaggcatactagagtttatttttcattgaggatcatggttttgttctctctgtacgtggtgatttggctctgttatgggttgacaattgtgaaataaagaatccctctatttccccttttgtggctgtttattcctttccctatctccaatatatcaaatagttggtacttcatgctctttcaacttgcacactattttttctctttatatactatctgggctgaagtattgatattgttttgcttctgacctttagagggggaaacgtaattatgcattctccaaaggcaggtgaaaatatgtgaagattacataaccttcagatatctcttgaagtttggagaattgactagtacattgacactagacaaatttgcatagcctacttcatggggcatatttagcttttcctgcctcattggacttgagacccctttcttccttctcaactctctaaatgtgcttaaattgatacattgaaatgagtagggaatgatgaatactgttttttatctaatctgctctctagtcccaaggacctagataaaactcggacatcgactatgtttctagcattgaaaaataagtacatcattatgccagtagtccagtttgaatccccaaagctggtaacttccacactatactttgatcatcacgttttaatttttccccatgtcttactatgattacaccccatgcactatcactacctcaagagatatgacaaaattctcattctcactggactgcaaactattcaagggcagagacagggtctcactatttctttgtggccttagtgtcacaccgttagcacagagcagctgctcaagaaattttgggtgaatgaatgaaaacaatacaaatctattttcatttaaaatgtaaataagtgtaataagcacgatttctacaaactccctcccccaaaacaaagcaaaaaatcagttataccagtttgtcaccaactgttgagaaccgttttgaagcttgtgactttgtatgtggccattagattctatcttccacccaatttctacctttccttttctcagctcccctgccacacaccattatggcatattataaaggctgataaggaaagaggctggacctttctttattcaaaagacagttctaattctagacaaaagatatgatctcctagaaacatgggtttatttaagatgacttcacttgagttgataccacatgggtcttcttcattcaatgaacccttaatcttttgttgggcatagagattggcttctattttttttttatcacaaatgaaaagatgcgatagtatatgttggaacccatgacttgccttataaataggcatggcaggtaattaattgcatgaataattcagaaatggcataattatggccaagtctatccttttctttacctcctttgcctgccacccgtcatctgatgccacaatttctgcaagaaatttgtgcgttatatttctctgctttgggacatcttttaaaatgtagttaatacaaatatgggcaatttcactctgaaatgtgtaacatatataacatatactctctataattcacactatagtattaaagacacctggtaagaggatttaaaagtaagacacattatatctgaattattggaataagaataggttaattttgagagcattgagaggtaggaacaggtgaaaaatgtgagctgaggaatcctggaaaatgtatgcttgtgtgtattgcaagtatatatgtatgtatgtatgtcatgtaggatgttaactgaagtggcaaaagctactagacaatcaagagaataagttctgaaacaaccttgggctgaagctgccttgggcatgattcttaaagaggcattgggagactcctgccctacataattatcaatgaccatctgtagtagcattgtgttttgggaagtgataccattgggtatattttgaggtgcaaatgtttgcttcatagttcaggctatttcctgaaatatcaataattttaaaaataattattctaaattattttaaataataaacaattaaatatatttgtattattttcatttattcaaccaaaactctctaaatattattctctttgctatctggactgaagtattgtagggccattttctggccctttctctgttgcctttctctctttttgaacactcactctgttctaacagggtagcactagaaacaacaagaccctgtctcttctgaatcaatcacctttcttttttaaaaaaaattagattcaaggagtacacgtgcaggtttgttacatggatatattgactaattctgggctttaggcctctattgaactcattacccaatacattctgtaggtgtactcacccagaaaacacatacccagttatatattcagggtactaaacaataggctatgtgagaaggactcatggacttcctgtagtgagcacaggacccaacaggttatttatcaaaccttgcccccatcttttagagtctccagtgtctattgttcccatctttatgtccatgtggactcattgttaagcgtccatttataagcgaagatgtggtattttgtgcgtttattcacttaggataatggcctccagctgcatccatgttgctgcaaaggatgtgatttcattctttcttatggatgcatagttggatcaatcaccttttattttcatccccctattttattttcatatagcaccatctttcagaacttctttggtctgtaaggaaaggcattaacattcaacaagtacctattaagtgacagtacctgtgtagtgaatattattattattatactttaagttctgggatacatgtgcaaaacgtgcaggtttgttacataggtatacatgtgccatggtggtttgctgcacccatcaacccatcatctacattaggtatttctcctaatgctatccctcccctagccccccagcccccgacaggccccagtgtgtgatgttcccctccctgtgtccatgtgttctcactgttcaactcccacttatgagtgagaacatgtggtgtttggttttctgttcctgtgttagtttgctgagaatgatggtttccagcttcatccatgtccctgcaaaagacatgaactcattcttttttatggctgcattccatggtatatatgtgccacattttctttatctagtctatcattgatgggcatttgggttggttccaagtctttgctgttgtgaatagtgctgcaataaacatatgtgtgcatgtgtctttatagtagaatgagttgtaatcctttgggtatatacccagtaataggattgctgggtcaaattggtatttctgattctagattcttgaggaatcaccacactgtcttccacaatggttgaactaatttacactcccaccaacagtgtaaaaacattcttatttctccacatcctctctagcatctgtgtttcctgactttttaatgatcaccattctatccagtgtgaaatggtatctcattgtggttttaatttgcatttctctaatgaccagcgacaatgagctttttttcatatgtttgtaggccacataaatgtctttttctgagaagtgtctgttcatatccttcacccactttttgatggggttatttgttgtttttcttctaaatttgtgtaagtttcttgtagattctggatattagccctttgtcagatggatagattgcaaaaattttctcccattctgtaggttgtgtgttcacgctgatgatagtttcttttgctgtgcagaaactctttagtttgattagatctcatttgtcaattttggcttttgttggcattgcttttggtgttttagtcatgaagcctttgcccatgcctatgtcctgaatggtattgcctaggttttcttctaggatttttatggtcttaggtattacatttaagactttaatccatcttgagttaattttcgtataaggtataaagaaggggtcaaatttcacttttctgcatatggctagccagttttctcaacatcatttattaaatagggaatcctttccccattgcttgtttttgtcaggtttgtcaaagatcagatggttgtagatgtgtggcattatttctgagacctctgttctgttccattggtccatatatctgttctggtaccagtaccatgctgttttggttactgtagccttgtagtatagtttgaagtcaggtagcgtgatgcctccagctttgttctttttgtttaggattgtcttggctatatgggctcttttttggttccatatgaaatttgagttagtttttttctaattctgtgaagaaagtcaatggtagcttgatggggatggcattgaatctataaattactttgggcagtatggccattttcatgatattgattcttcctatccatgagcatggaatgttcttccatttgtttgtgtcctctcttgtttccttgagcagtggtttgtagttctctttgaagaggtccttcacatcctttgtaagttggattcctaggtattttattctcttagcagcaattgtgaattggagttcactcacgattgggctctctgtttgtctgttattggtgtataggcatgcttgttatttttgcacattgattttgtatcctgagactttcctgaagttgcttatcagcttaaggagattttgggctgaggcgatagggttttctaaatatacaatcatgtcatctacaagcagagacaatttgacttcttctcttcctatttgaataccctttatttctttctcttgcctgattgccctggccagaacttctaatactatgttgaataggagtggtaagagagggcatccttgtcttgtgctggttttcaaagggaatgcttccagcttttgcccattcagtatgatattgcctgtgggtttgtcgtaaatagctcttattttgagatacgttccatcaatacctagtttattgagagtttttagcatgaagggctgttgaattttgttgaaggccttttctgcatctattaagataatcgtgtgctttttgtcattggttccatttatgtgatggtttatgtttattgatttgcatatgttgaaccagccttacatcccagggataaagccgacttgattgttgtggataagctttttgatgtgctgccggatttggtttgccagtattttattgaggattttcacatcgatgttcatcaggatactggcctgaaattttctttttctgttgtgtcactgccaggttttggtattaggatgatgctggtctcataaaatgagttacagaggattccctctatttccatagtttggaagaatttcagaaggaatggtaccagctcttctttgtacctctggtagaatttggctgtgaatctatctggtcttgggctttttttggttggtaggctattaattattgcctcaacttccgaacttgttattggtctattaagggacttaacttcttcttggtttagtcttgggaggttgtatgtgtccaggaatttatccatttcttctggattttctagtttatttgtgtagaggtgtttacagtattctctaacaatagtttgtatttctgtggaatcggtggtgatatcccctctatcattttttattgcatctatttaattcttctttctttttttctttattagtcttgctagcggtctatctattttgttgatcttttcaaaaaccagctcctggattcattgattttttaaagggttttttttttttttatctctatcgccttcagttctgctctgatcttagttatttcttgtcttctgctagcttttgaatttgtttgctcttgcttctctagttcgtttaattgtgatgttagggtgctgattttagatctttccttctttctcctgtgggcacttggtgctatgaatttccctctaaacactgctttagctgtgtcccacagatttgggtacattttctctttgttctcattggtttcaaagaacttcattatttctgccttaattttgctgtttacccagtagtcattcaggagcaggttgttcagttttcatgtagttgtatggttttgagtgagtttcttaatcctgagttctattttgattgcactgtggtctgagagatggtttgttatgatttccattcttttgcatttgctgaggagtgatttacttccaattatgtggtcaattttagaataagtgcaacgtagtgctgtgaagaatgtatattctgttgatttggggtggagagttctacagatgtattttaggtccacttggtccagagctgagttcaagtcctgaatatcattgttaattttctgtctcattgatctgtttaatattgacagtggggtgttagagtctcccaagattattgtgtgggggtctaagtctctttgtaggtctctaagaacttgctttatgaatcttatgaatctgggtgctcctgtattgggtgcatatatatttaggatagtgagctcttcttgttgcattgatccctttaccagtatgtaatgcccttctttgtctcttctattctctgtttgttgaaagtctgttttatcagagagtaggattgcaacccttgcttctttttgctttccatttgcttcataaatcttcctccattcctttattttgagcctgtgtgtgcctttgcacgtgagatgggtctcctgaatatagcacactaatgggtcttgactctttatccaatttgccagtctgtgtctttaaattggggcatttaactcatttacattgaaggttaatattgttatgtgtgaatttgatcctgtcattttgatgctagctagttattttgcccattagttgatgtagtgtcttcataatgtcaatggtctttacaattggtatgtttttgcagtagctggtactggtttttcctttccatatttagtgcttccttcaggaactcttgtaaggcagtcctggtggtgacaaaacttctcagcatttgcttgtctgtaaagggttttatttctccttttcttatgaagctaagtttggctggatattaaattctgggttgaaaattcttttctttaagaatgttgaatatttgctcccactctcttctggctgtagggtttctgcagagagatccactgttagtctgatgggcttacctttgtgggtaacctgaccttttgctctggctgcccctaacattttttccttcattttaaccttgttgaatctgatgattatgtgtctttgggttgctctcctcgaggagtatctttgtggtgttctctgtatttcctgaatttgcatgttggcctttcttgctaggttggggacttctcctggataatagcctgaaaagtgttttccaacgtggttccattctcctggtcactttcagatacaccaatcaaacgtaggttggtcttttcacatagtcccatatttcttggaggctttgttcattcctcttcattcttttgtctctaatcttgtcttcatgcttcattacattaagttgatcttcagtctctgatatcctttcttctgcttgatcagttcagctattgatacttgtgtatgcttcacaaagttcttgtgctgtgttttgcagctccatcatgtcatttatattcttccctaaagcggttattctagttagcaattcctctaacttttttgcaaggttcttagttcccttgcattgggttagaacatgctgctttagctcggaggagtttgttattacccaccttctgaagcctacttctgtcaatttgtcaaactcattctctgtccagttttgttcccttgctggtgaggagttgtgatcctgtggaggagaagaggcattgtggtatttgtaattttcagccgttttgtgctggtttttcctcatctttgtggatttatgtatctttggtctttgatgttggcgaccttcagatgggtttttgtgtgggcatcctttttgttgatgttaatgctattcttttctgtttgttagttttccttctaacagtgaagctcctctgctgcaggtctgctggagtttgctggaggtccactccagaccctgttttcctgggtatcaccagaggaggctgcagaatagcaaagattgctgcctgtttcttcctctggaagcttcgtcccagaggggcaccagccagatgccagccagagctctcttctattaggtgtctgtcgacccctgctgggaggtatctcccagtcaggaggcacaggggtcaggggcccacttgaggaggcagtctgtcccttagcagagatcgagccctgtgctgggagatttgctgctctcttcagagccagcaggcaggaacatttaagtctgctgaagctgcgcccgcagctgcctcttctcccaggtgctctgtcccagggagatgggcattttatctataagcccctgactggggctgctgcctttctttcagagatgccctgcccagagagttggaatctagagaggcagtctggctacagtgtctttgcagtgctgtggtgggctccacccagttcgaacttctcaacagctttgtttacactgtgaggggaaaaccttcttctgagccctcagtaatggtggacgtccctccccccatcaacctcaagtgtcccaggttgacttcagactgctgtgctgtcagcgagaatttcgagctagtggatcttagcttgctggtcttaatgtgtgtgggatccactgagctagaccacttggctccctggcttcagcaccctttccaggggagtaaatggttctgtctcactggcattccaggcaccactggggtatgaaaaaaactcctgcagctgagctgagtgtctgcccaaacagcgcctagttttctgcttggaacccagggccctggtggtgtggtggtgtaggcacctgagggaacctcctaatctgtgggttgtgaagaccatgggaaaagtgtagtatctgggccagaatgcaccgttcctcttgggacagtccctcatggcttctctcagctaggggagggagttccctaaccccttgtgcttcacaggtgaggtgatgcctcaccctacttcagctcatcctctgtgggctacacccattgtctaaccagtccctatgagatgagcagggtacctcagttcaaaatgcagaaatcacctgccttctgcgttgatcttgctggaagccacagaccagagctgtttctatttggccatcttgccagccacctcttgtagtgaacatttcaaatgtcatctgtttcttaaaaaaccccgtgaaaaagctccatcccattttacagagaaggagacaaactcaggatccttctttaccccaaagccatagtgagtgagaggcagtactgggccaggcctcttggactcccctgtgactatacagaaaacagaacattatctcatttgtccaaaatgtgtttttttcaggctatgagttttcaaatcttatacatttcaaaacacacacatactatttctaactatcaaaatgttgtgttcaactttctctcccctgtaaccattctatagctttatgattttgtagactttggtcatcttaactatcaactttcttcactcttggtgaggtgcttcatgtgtggatcacattttttagccctttctctgttgcctttctctgggccgtctctaactccactacatttttcttgaaattttgtctgctagaattgcaaaacaggatactgatgcacaggataatgagttttgttttgtttccagtgcccaaccatgatgcccagaatactgttactttttggactcagcagcaaattttttttgagaacacagaaggttacaggtgatactcagcagcctcaggtccatctcaaacctccgtgctgcagtatatatgtttacaagggcatctagatggggagcagctggggccttctatatgacagtcaaatgtgttcattctccttcccatcccacttctctagccccagctcacaccacccagcccctcgcccagtgtcctccagctacatgttggccttgtttcagttcctcatagatgccaagctccttcccatcataggatctctggccatgcttgccttttgctgaggctgccaaccatcatacaaactcttactcatcctttaaattccagattaaatgctgtcttcacaccttgtatttattcttcacagcatctatcatgtcacatttgcaagcaaataatgattggtatgctgatttgcttaagatctatcatcctgatgcattataaaaaactccatgaggacagagattctcttgttcacctatgtagttccagtgcccagcatagaatttgatatccagttagagttcagtaaatgtttgttaaatgagtgaataaattaaaggaaggaaataataagcctctggacatggttgtcctcttaccctggttccatttcttgccctaagtagtgagtttataaccagcctctttctcaaatgatgcagacttggcatcagctctgtcttgggcttccggacttcagggctctatagcaaaagccagtgagtagaatgagggtggaagccaggacagagtaggaaatgaagccagcttcagaggctcaccttacaagagcagttgccttgtctattgcagtataataggcatgccaagatcaggcatagtttggacagacaacagcaatcaaaaagaatccaatttggcaagcagggcacagcagtggcagtccttgccatgagaagatgctggaaattcagataaatggcagcatcatggcactgagccttctctctactcacagacatagtcaagtcagagatttggagctctaagagtgggattcagtcttcagggttggcagaagcaaggtaggacctcaggccaaagccaagcaggtgggctcaggaaaggggaatggagccctgggcaaagcaactaaggcagaagcccagactttcacattgatgagcccaacacagggggtgagggaaagctgctgacagtgacaagaatgctagagcaactcaaatgttaaatgagtgcagggactcatccctggcacctgaagcccaaagagtgaatagaagtaaaggtcgtacttaaaaatgcgtaacctttgggtttgattcctgaagattctacctactagttatgtattctgagtactaaaaaataggctctgtgagaaggacccatgcacttccatttcaaagtaactatttttaattaaaataatttttattactgtaagagcaggttttatacaattacagattcagggatacatgtgcaggtttgttatgtgagtatattgcataatgctggggtttggacttttatggaacccatcacccaaatatagtgaacatagtacctaatatgttgtttgtcaacccttgtatccccatcctttcctctcctttcttagagtcatgaatgtctattgttttcatctttatgtctacatattcccttggtttagctcccacttgtaagtgagaaaatgtggtgcttgattttcggtttctgtgctgattcactttggataatggcctccagcttcacccacgttgctgctatggacatgatttcattctttttaacagcggcttagtattccatggttgtgtatgtaccacattttctttatctaacctactgttggtgaacacttaggttgattcaataactttggtatttcgaacagttctgcaataaacatatgagtgcaggtatttttttgtaaaaagatctgtagattgcttataaaagcagttttacatgcattacagaaagtcaaagaaaacatcaaagtaaaatttaactaaataaagcaacatattttaatcaccactgataaaaccgttcttatatttccttccagatatacaatttttttacaataatgagattttgcttttacatgctttttgctacctgctttttttctgttaagattttccatctttccattacaacaaatgttaaatttagctaatattcattctaattcagattgccccaattgtcccccaacactgtatttaccacattctgtccaaatcagggtctaatccagggccagaccttgcatctggtagctatgtccctgaagtctcttctgattagcacactccccttttcctctgacactgacctattgccctcgagaatatctcactttctggatttgtttagttcctttccagtgatttcatttagtttatttatcttctttatttcttatgtgtaggttagattaaatataaatcattggtggtggctcctgttgggtattttcagccagaatacatactagctaggtatgccgtataaactctattgccttacatcaggagaaacaacatccggttgacccatcattagtgatgctgtgcttgattatgggtctagggtcttgcttctttttaataaggtctcaggatgacacaataggagcaggactcacatcaatgcgttccactcattgctaccccctcctccacctccatctcctaccagttctcatccccctgaacagaccttccaagcaagaaagacaaaagggaatgaagtgtggtaaaaggcccagcaataaaactggaaagtatgactcttttggctcctagtctgaaacttcattctaaatttactatactagatataagcaggcagggtgaatgtccaagaacttctctcacactagattccagtcttcccagttgttgtcaaggtcaaaatagtatggctttggtatcttacgcagacaccagaaggcagcctacataagatacgaatgttctcctaaacaagttttgaaaaagacataagctgttacagaaagcaggctcaaccatcttgtaaactgatcatgccaaaatatgaactttgctttttttgattcattatgcaaaattgagaaagaggagtcaaaactatactgtatggaatttagcctgggagatggagaccacctagatcctgctttctttgtttgctttgtttgttccttaaccaatgacaaggtacaacgttggtcaaatattttcaccagcctagtttcagtattctcaagtgtaaaatggggtatatgatacagtgtatggttgttaagaggatttaacttcatctgtgaaacacctacattatagtaactaccagttcccttctcctctcattggcagggtctgagattactgacatgcttcctgctatacccggcactgattccaaatgggactgggtctgcaggtgaaatttactagtttatatagctgagggagctggagaaaattggagtagagggctggaggcagaggctgaccactgttattatataagctaaaatgtgattagaagtgcatgatacaaaaagctatgacatgtaaccttttaagataaccatgaacctcgaattttgttgttttttaaaaatgtattcggaacattaaaggcaaactcagtcatttagggcccaggaacaggaaaaaggtagtccgtattgtatcttgacattttattcattttattctacctctcaggtgccaatccttgcacgtacatactattttaagaaaatcagcaagggatggccattttatattttgggcacttcatttagctttttaaatggtaagtgtgaaacctgtatgtccctaataatgcttaccatcctaatgaatgtgggtcagcattgctagttttaaaggtgtgtgtgtggtggtggggaatatcctgaaaatgttatgagtaatctttatttttctcatacatttgacattactggaggctagtagttatattgattacaaatggactctggagcacacagacctaagtttgaattccaggttccccacttactagcagtgtgactttaaacaaagattagacccaaaagttcacgttgcctctgggaaccttggattctcatttttagaagtgaaccgattattgtaactactgcaaggcttgttgtgaatattaaatgagataacataaatgaaacatggcacctggtgcatagtaagtgttcaaaagttggttactattttaattatcgttattattatttttcccaaaggaacacaatttacaaatgttcgctttccctggaatctttaccccaactctgactctcaatgatttgctactgttagtccgattgatgaaaaatcaatggggaaaccaagcattgtaatctctgcccatgaggtctatagacggaattcttttcaatagctctaattaatgagttggcaagtctgataaagcaccagagaatggggtgttcatagaaagcattagtgtttttgtttaacatatgtgacacttgaagcattaggatgctgttattgttcattatggcacgtgccacctccccattccccaaaattaccataatttgtaccttccaaattgaatagagtcattcatagttatcacatgggagtttctgttaaagctaaaggccacacgtagtgtgattaaggtgggactgctgaattcaaaatatatctcttttccctaggctacactggctattctgcatgtaataaaaggtatttaatgcatattaagtttttcatgactaatgtgtcttctgaagtttaaagcaggaacagaaaatgaaagtaaacaaaatgcctcatttcttagtaatgaatttttcaagtctctacatatcacctacattatacaagtcatagatgcaaatggaagaattaacagctttatttcatcatccccaaacctcttacctccagcaccttcatgaattatttttttggtaacttcttaagaataaatgctcattattggcagctttgtgtataaagaattacttcaaccagtccaactgccttatgttattttgtgtgttagtctaaagactaagattttttaggataaggagagatgtgtatagaacctcagagtcatcagcccctacaaatattttttttgccttttgtgctttttcctagaaaaaccagcagatactccctctgaggaagaggactttggtaagtcatagtctgagtattaagtgctaagaatctttcatgacagtctatccattgagaaatatgtgattcttttaaaatctaggaatagcgaaatatttgtttggtaaagaataattgctgactgaagctttttttggattcttctttcaactgtctgtttctccttcctgaaagggttccctctttttggagttgtaaatgaatttcccaggaaaaacatcatgcagctactgatgctttatcaccccagctcacctgacacatcttgtcttctttccttcctttcagctcagtttgtgactttgacacatgagtcttgttcaaatctctctctccaataaacaccttcactctccagctttcatgacactatgtgtgtattattcagtcttctttttccgacagccggctctctccttagtcagccccatagagttgattcttgctactcaaagtgtggtctgtagaccagcagcatgagtaggacctgggagttggaaattcagcatctcaagtcccatcccagacttattgaatcagaatctgcaccttcagaagattctcaggtgattcatgtgcaaacaaaaatttcagcagcactggcttcaagaatttctcttcctttgtgcaatctcattgcccctgaggtatataaataagtacttttactcggtgacttccaacattacttggatccccaatcttcaaataaaagattattatatatgtggtgagaatgttaaaagtccattctattagcaattttaaaatatgcaatacattattattaacggtgatcaccatagcaaggtgatggatatgttaattagcttaacttaatctttctacaatgtatatatacatagagcaaaacatcacattgcaacccataaatatacacaattattgtttgtcgattaaataaatgtataagaaaatatgatcatacatgtactttcctgcctcttttctcaaaacccatttattgactctcatgtactttaattttacctacttagatgctgctgtttgttctcacacttagatagcattttacagtttcaaaattccttcatatagattttgttacttaatcatatatgatcatataaggtagaaaggtaggtaatagaaacttttgtagaggctattttgtaaatttccatttgtaattttttaatctcaggggttgaaataaaaaggtaaaaaatgtatcagcagatggttttttcctaccttaaaacaaagtagaggtcaagtcttttttgtgccatcagaagtctgaatcattctgcctcaaaatgtatcatgggtcaaaataatgttttttgctcagtatgatctgagttatgtttttattcatataccttgtcttctcacttggaataaagtaattaggcctaaaataaagccctcatctttctcacaaggtttatgagataaataagctaatgaggaaaaacactccacttctgatataaagtagcccaaggagagaagtaccactgagtgctgcttctgcttgaatggacagaagtaaaagaaagaggaaaggttcaatataggatattgtactatgccatttccattctcccagacaaggtattactgggataactctgctgagtcatggcccaggaggaactgttggttttgcatccactaaaagtgcatctcagcagagggaaacactcccagatcctaagatctggggtgcactcagtattcaggggtgagtggataaacaggccttggatttcaattgggtggatgatggcatttttgtcttttctttttggttcattcactccacatttacacttctttttaagagcctgatattaaagaaagcttaactgtgctaacaatgggggtaagcttgggagaactggagtgttattggtgttaacccataggacacattcttcaacagccttgtgttccaaagaagctgaggcccaccaaagccagtggctcgtttcacttcctcttctgttacagggaagggttgacctcatcctttccaaggctcatagtacctctatcagcattgcctcttcaaagactttgctcttgcaattatcccctctctctcttgcctacatgtaaatatgccttaatacagccgcctgaaatttatttaaaaaaaatgatcaattaaccctttcatcacgctaaaactcaaaagaattgtttataggcattgactccacttttctcctattctctcattaacccactccaactggagttgtatctgcattacttcatgaaacagttttttatcatttccacagacttgtatcttgctcttccattacagaattcttttcctcaccttactctctctcagcagcatttagcatgctcagccactctacttttttaaactttcctcttctgcttccaagataccacactctcctgggtttcctcctgactctctgatctctccttctctggccagtcgctcacacttaaagtctgggtgttggagagcccccaggatgcattttctctgacttttctaggtaattgtatctgatcccatagttttaaataccatgaatgtgctgttaagtcctagatttacatctctagccctgattgctctttcttgccctggacttatttatttgactttataccccaccaaatctgctcttgtgtctaccttcctttctctaataagggcatcaccactcaccatctccactaaattgcttcattcaaacaactgttatttctcagttagatacctaccattacctcctaactcatttttatctgcagctattaccctactctggtctattctccacaaaataatcagacaaatctgtttataattacagttcctattttcaaaatcaagttgtgaagtgagcaaataaataaccaactgctatttaaaatgctcaaagcacaattctaatgagtcaatattacttttttcatttatcacattttatctaatttatagtacataattatcaaaccacaaaagcaaatatattagcctaaagtacagtatgccattttggatattggctactttgcccctaccaatttgattctgacatgtcaaaatctttatttataacctaacataaacatatattactttaaagtatacaggataaagaagagtttttaaccctttgtaataacataaaacatgattacattgtcatatgtatacatatgtatgggcatatgtgtatgtatacagagagtctttttaaatgaggtatcaatacttgtttcataataatccttcaaataacacttccttagccaaatcaaagaaagttgagatggctttccagcttttttaggcaaagatctgcatgacatgcgagacaatgaaaacagtgtttagatatttttctatcttattctttgaatttcaaattttattttagattcagagggcacatgtgcaggcttgttacaagagtatattgcatgacgtgagggtttgggatagaactattgaggtagaatctgtcacccaaatagtgagcagagtacccaataggttgattttcaacccttgtccccatcctcactcccatcttatagtccctagtgtctattgttcccatgtttatgtctgtatgtacccaatgtttagctcccacttatacgggaaaatatgcagtgtttggctttctatttctgcatcaattaacttaggatgatggcctccacctacatccatgttgcttcaaaggacataatttctctctttttgtggctgcatagtattccctggtgtatatgtaccacagtttctttatccattccactgttgatgggcacctagtttgattccatatctttgctattgtgaatcctggtgcaataaacatacaagtgcaggtgtctttttggtagaacaatttcttttcctttggatatataccaagcaatgggattgctaggttgagcagtagttctatttttgcttctttgagaaatctccaaactgctttccacagtgactgaactcatttacattcctaccaacagcataaagagttcctttttctctgtgtactcaccaacatctgttattttttaacttttttataattaccactctcactggtgtgagatggtattgctttgtggttttgatttgcatttctctgatgatgcatgatgtgaagcatttttttcgtttgtttcttggccacttgtatatcttctttttgaagtatcttgtccaccttttaatggaattgttttttacttgtttggttaagttccttatagattctggatattagacctttgttgggtgcatagtttgctattaatattttatcccattatgtcagttgtctctttacctgttgatagtttctcttgctgtgcagaagctcttcagtttaattaggtcccacttgtcaatttttttttttgagacaggttcccattctgtccctcaggctgaagtacagtggcgtgatcatggctcactgcagcatagaccttcctaggctccagtaatccttccatcttggccttctgagtagttgggactatgtgccacgatgcctggctaatttctatgctttttgtagagatgggggtctcactatgttgcccaggctggtctcaaacttccagactcaagcaatccacccatcttggcctcccaaagtgctgggattacaggtgtgagccactgtgcctggcttaatttttttgtcgttgttgttaaaattgcttttgtggacttagttctaaattctttgccaagaccaatgtctagaaggttatttcctaggtggtgttctagtattcttatagtttgaggtcttacatttaaatattcaatccatcacgagttaagttttgtatatggtgataggtaggaggtctagtttctttcttttgcatatggatagccagctaccacaacaccatttattaaacagggagtcctttccttattgcttattattgttggctttgttgaaagtcagttggttgtaggagtgcagctttatttctgagttctctattctattccatgggtctatacgtctgtttttatgtcagtaccatgctgttttgattactgtagccttatagtatagtttgaaattaggtaatgtgatgtctgaagttgggtaatgtgatgccaactttgttctttttgtttaggatgctttggctatttgggctcttttttggttttatataaattttagattagttttttctaattctgcaaaaaatggtgttggtggtttgataggcataatgttgaatctgtatattgctttgggcagtatggccatttaaacaatattgattcttccaatctatgtgcaaggaatattttttcattttttcatttgattgtgtcatctatgatttctttcagcagtgtttggtagttctccttgtagttctctattttacaccattggttaaatgtattcctaggtattttattttatttttggctattgtaaatgggattgtatttttgatttggctatcagcttgaatgttactgctgtacagaaatgctactagatttttacattgattttgtatcctaaaactttactgaagtcatttattatgtttaggagtctttcaagagagtctttagagttttctttgtatcgagttctatcttcagtggagatggacaattttacatattcttttcctatttagatccgttttgttttgttctctcacctgattgcactagctaggacttccagtactatactgaataggagtggtgagagtgaggatccttgtcttgttctagttcctcaagggaaatgcttccagtttttgctcttttagtatgatgttggctacaggtttttcataaattgctcattattttgaggtatgcttctttaatgcttagttttgttagacatttgaagatttttaaaaaactgagagtttttattatgaagggatattggattttatcaaaagctttctttgcatctattgagatgatcatatggtctttgtttttaattctgttgatgtgatgagtcacatttattgattcatgtatgttgaaccaaccttgcatcccaggaataaatcttaattgataggatgaattagcttattgatgtgctgctggatttgatttgctcattttttttttttttttgttaaggatttttgtgtctaagttcatcaagggtattggcctggagttttctttgtttcttgtgtctttgccagattttggtatcagaatgatgctggttttgtagaatgaattagggaggagtctcctctccttgattttttggaatagtttcagtaagattggtaccagctcttctttatacacctggtagaatttggctctgagtttgtctgctacagggctttttttggttggtacattttttgttactggctctatttcagaattcattattggcctgttcagtgtttcagtttcttcctgattaaatcttgggagactatgaatttacccatttcctctagattttttagtttgtttagatagatgtattcatagttgtctctgaggatcttttgtatttctatgggattggttgtaatgtcaccattgtcgttggcattgtgctcatttgaattgtctctctttttttcttttttaatctagctagtagtctattggcgttatttgtttctcctttcaaagaaccaattttttgttttgttgatcctttttaatgaattttggcatctcaatgtcaattagttctcttctgattttagtaatttattttcttctgccagctttgggattagtttgttcttgtttttctagttcctctaagtgtgatattagattgttaatttgagatttttctaacttctcaatataggtatgtagtgctataaactttcctcttaacactgcttttgctgcatcccagagattttgctatgttgtgtctctcttttcatttatttcaaagaatttttttatttcattaattttgttggttacccaaaagtcattcaggagcttacttttcatgtagttgtgtggttttgagaaatcctcttggcgttgatatatatttttattccactgtggtctgagaatatgtctagtgtgatttcagttttttaaaatttattgagacttgttttatggccaagaatgtggttgatcttagactatattccatatgcacatgagaagaatgtatattctgtggttgttgggtagtatcttgtagatgtcttttaggtccggttggtcaagaattgaatttagtccagaatttctttgttagttttctgccttgatgatctaacactcttagttagggtattgaggttctccattattattggatgtttaagtctttccataggtgtagaagtacctgttttatgaatctgagtgctccagtgttgagtgcgtatatatttagggcaaatatgtcttttttgtttaaatgaacgctttatcattatgtaataccctttttttgtctttttttctgttgtgagtttaaatcctgttttatctcatacaagaatagccactcctgctctttttcatttcctgtttatttgatagacctttttctatcccaaaagtcattcaggagcaatgagcctataggtgttgttacacatgatatgtgtctcttgaagacagagaaaggttgggtcttttttttaaaagaaaaatccaatttgccactctatgccttttagtggggtgtttaggccacttatattcaaggttaatattgatatgtgagtttttgtttgttttttttttttttagacggagtctcgctctgttgcccaggctggagtgcagtggagcgatctcggctcactgcaagctctgcctcccgggttcatgccattctcctgcctcagcctcccaagttgctgggaccacaggcgcccgccaccacgcctggctaatttttgtattattagtagagacagggtttcaccacgttagccaggatggtcttgatctcctgacctcgtgatccacccgcctcggcctcccaaagtgctggaattacaggcatgagccactgcacatggacgatatgtgaggttttgatcctgttgtgatgttgttagctggatactttgtagtctcaattgtgtagttgttagctggatactttgtagtctcaattgtgtagttattttttataggttctgtggactatgtacttatgtgtttttgtggtagcaagtattattcttttatttccacatttagaactcctttaagtgtctcttataaaactggtctagtggtaatgaattttctttttttttttttaatactgtttttttttggatttatttatttatttatttatttattacactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtcaccagagtgtgatattccccttcctgtgtccaggtgatctcattgttcaattcccacctatgagtgagaatatgtggtgtttggttttttgttcttgcgatagtttactgagaatgatgatttccaatttcatccatgtccctacaaaggacatgaattcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccccgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcgcagaagcactttagtttaattagatcccatttgtcaattttggcttttgttgccgttgcttttggtattttagacatgaagtccttgcacaagcctatgtcctgaatggtaatgcctaggttttcttctaggatttttatggttttaggtctaacttgtaagtctttaatccatcttgaattgatttttgtataaggtgtaaggaagggatccagtttcagctttctacatatggctagccagttttcccagcaccatttattaaatagggaatcctttccccattgcttgtttttttcaggtttgtcaaagatcagatagttgtagatatgcggcgttatttctgagggttctgttctgttccattgatctatatctctgttttggtaccagtaccatgctgttttgcttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatagggatggcattgaatctgtaaattaccttggacagtatggccattttcacgatattgacttttcctacccatgagcatggaatgttcttccatttgtttgtattctcttttatttccttgagcagcggtttgtagttctccttgaagacgtccttcacatcccttgtaagttggattcctaggtattttattctctttgaagcaattgtgaatgggatttcactcatgatttggctctctgtttgtctgttgttggtgtataggaatgcttgtgatttttgcacattgattttgtatcctgagactttgctgaagttgcttatcagcttaaggagattttcggctgagacaatggggttttctagatatacaatcatgtcatctgcaaacagggacaatttgacttcctcttttcctaattgaataccctttatttccttctcctgcctaattgccctggccaaaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatgcctaatttattgagagtttttagcatgaggggttgttgaattttgtcaaaggctttttctgcatctattgagataatcatgtggtttttgtctttggttctgtttatatgctggattacatttattgatttgcgtatattgaaccagccttgcatcccagggatgaagccgatttgatcatggtggataagcttttggatgtgctgctggattcgttttgccagtattttattgaggatttttgcatcaatgttcatcaaggatattggtctaaaattctcttttttggtggtgtctctgcccggctttggtatcagaatgatgctggcttcataaaatgagttagggaggagtccctctttttctattgattggaataatttcagaaggaatggtagcagctcatccttatacctctggtagaatttggctgtgaatccatctggtcctggattctttttggtcggtaagctattgattattgccacaatttcagagcctgttattggtctattcagagattcaacttcttcctggtttagtcttgggagagtgtatgtgtcgaggaatttatccatttcttctagattttctagtttatttgcgtagagatatttgtagtattctctgatggtagtttgtatttctgtgggattggtggcgatatcccctttatcattttttattgtgtctatttgattcttctctctttttttctttattagtcttgctagcggtctatcaattttgttgatcctttcaaaaaaccagctcctggattcattaattttttgaagggttttttgtgtctctgtttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctatgtatttccctctacacgctgctttgaatgtgtcccagagattctggtatgttgtgtctttgttctcattggtttcaaagaacatctttatttctgccttcatttcattatgtacccagtagtcattcaggagcaggttgttcagtttccatgtagttgagtggttttgagtgagattcttaatcctgagttctagtttgattgcactgtggtatgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtctttccattggagcatttagtccatttacatgtaaagttaatattgttatgtgtgaattagatcctgtcattatgatgttagctggttattttgctcgttagttcatgcagtttcttcctagtctagatggtctttacattttggcatgattttgcagcggctggtaccggtagttcctttccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgacaattcttttctttaagaatgttgaatattggcccccactctctcctggcttgtagggtttctgctgagagatctgctgttagtctgatgggcttccctttgagggtaacccgacctttctctctggctgcccttaacattttttccttcatttcaactttggtgaatctgacaattatgtgtcttggagttgctgttctcgaggagtatctctgtggcgttctccgtatttcctgaatctgaatgttggcctgccttgctagattggggaagttctcctggataatatcctgcagagtattttccaacttggttccattctccccgtcactttcaggtacaccaatcagacgtagatttggtcttttcacatagtcccatatttcttggaggctttgctcatttctttttattcttttttctctaaacttcccttctcgcttcatttcattcatttcatcttccattgtaggggtgggttgcccctacacacctgtgggtgtttctcgtaaggtgggacgagagatttggaaaagaaaaagacacagagacaaagtatagagaaagaaataaggggaaccggggaaccagcgttcagcatatggaggatcccgccagcctctgagttcccttagtatttattcatcatttgtgggtgtttctcgaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcagtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggatggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccatttaactctgagttgacacagcacacgtttcagagagcacggggttgggggtaaggttatagattaacagaatctcaaggcagaagaatttttcttagtacataacaaaatggagtctcctatgtctacttctttctacacagacacagtaacaatctgatctctcttgcttttccccacatttcccccttttcttttcgacaaaaccgccatcgtcatcatggcccgttctcgatggtcgctgtctcttcggagctgttgggtacacctgcagactaacaacagacaaaacaggcacacaaggattaatatgagatttataattgtagtacttccaatggtcttaacccaagtgacagggttaagatttgcgaggccatcagcaactcctgcaattgcctcagttcctggcaccaaatttaaatgggcttttgatgcttcgaaaatttgttcttttaatttggaaatgtctaaagtgagattatcttctcttccctgtagatggcgtctaaccatgtcccagtgatgctcagactcattataaatttggggtgtaatacaaaaatctgacgtattccagtcacattgtaactggaaacgatgttctaagctcatgagtctgtctcccatccaaatgacagtttgtctaagatcattaatttgatttgccaatttttgatcaatactagattgtgaattccacaatcttgtagaattattttgccaatcattaacaaagtttactgactgaacagaagaatgcaatgcaactcctgctacagcagccgtagctgtgactgcaattaatcccataatcactgcaattaaagtaaaaatgaatcttttggatctatttaaaacaccttttaatacttcagtcaaaatatggacggatggtgaggcctcccacggtcggtccatggacacagggatccacacgccctctcttgctctcaccagcagaatacggtgttgccaattaaaagttgaatcaatgcaagtaagcaatctacaattttcacaggttatagtctgggagtctggtttaataactatatttcctacaactagcatataagggggctttacgcaactttgtaaaggaactgttagactggaatttaggtcgacagtataaaatggcttacgatctcttgtttctaaagtttgatttccagaccaaattctaatgtggtgtgaggccacagtaagcctccataattctggatgttcaggaccagaaacaggacttactatttttggtcttggggtagagattcctttttctccccattcccaagggtagaaagactgcaattttttatgcttatgtttgtctaaactttctgttaagtcgctatcaacagctggactcacttgtgcacttggacacgactgagtttgtcctgagcaattgtggtagaattgacctcgaggtgcccaatctataatagttccgaattcattgttttgtaatatcaccgcactattggccacacattcttcccaaactaaaacttctgtattttttgattctttgggaatttccttggggcaaggtttccctttaggtctaaattttaatgatctttgataaggaaagtcttgtaaataatttacccgtggcctgagtgacatcccgcttaccatgtgataagtgaatctactgatgggactgacagtaggtacttccaccaaccaattttggactgcagccattaaacatcctggtgctctccctaggcaaataggaggataacgatacccaatggaaatatttatcatcatcccttcttcctcaggtttggcagggcagcgatcatctgtggggccaggtacccattcactatcattaacatatacttctataggattatccatccatgtgactggtgttaccatctccgtggaggcccttttctttgcatctccgatgggttcattgtagaacttcaaatgtctagtgggtatccaaacaggaagctgattttctcctggtgaaacacaagcaaaacctctcccccacgttatcaccttacctatttcccatgtcttatttttattatctttccaccaaattagttttccttgaataatggccttacacacaggtctgttctctgagacctgacttgcccaatatgcagcctttcctgttggatcagtgcttacaagccctcctattctttttatttcactatttccatccttaatatatggcaggagtaataattgagcaatcctgtctcctggactggcactccaaggaattgaagagctaataaccaattgaatttcacctttatagtctgaatcaaccacactagtatgaatttgaactccttttagatttagacttgatcttcccaagattagtcctacagtcccctcaggcagggggccatatacccctgtggggattttttgtgggggctcccctggaagcagagagactgcttgtatagtacataaatctactgctgcactgccgcttgtggcgggggacaattgttgtattgtggtaactggcttattccctgaaacacttgggacagtgggggttgttgtccctgaaaaccctgaggaacaaatggctgaattgggaatgccccagtttgttgtggggcctgaggctggcccctttgctcatttcccgacaatggttgcccatttttatcaaatttagaacgacattgactagcccaatgttttccttttttacatcttggacataagtcaggtggctctctacctgttgtagttggttgaatagttatattctgtttatttaagactgggcaattcttttttaagtgaccaatttgaccacaattataacattttcttccaaatgttctaacttgccctcctaaaacaactcctgttattgcttgagccataagcatagctttatgcatagctcctccgattccatcacaggcttttacatattctgagattacatctgatcctgcaggaacctttccttttaatggcttaatggctgattgacactcaggattggcgttttcatatgccatcaactccactatgaccttacgggctttttcatcggcaattgacttttgagcaacatcttggagccttgccacaaaatcaggatagggctcttttgaaccttgtcttactgtattaaatgaggggcaggtacttcctgggtcttggattttttcccaggctctaaggcagatagctctaacttgttcaatggcctcattttgcattaatgcttgttgactaatagtactccaattttgacctattcctaatagttgatctgcatctatgttaactggaggattggcagccctatttcttcggacctgttcttgtaccccatcaatccaccaagtcttaaattgtaaaaattgagagggtgagagagacgattttgccagaatctcccaatcataaggaatgagtctatgtccatgagcaatggaatctaataatgtcctcatataaggagagttgggtccatactgttttactccctctttcatatcttttagcatttttatcgaaaaagacttgtatctggcctcaactgtgggaggctctccctcttgggctccttctccaggtggcattggttctaacgttactgggaattgccatgcctcagtatctccttcctttcttgatttatcaataatttcatgtaattcactaccctgtctactaggtggtgccataggattaagtctcctagtgggcagctgagggtatggcgccctgccctgtggtgctgggggcattcctggatatccatactgactttctgggggtggccgatactgaagttcagccggcggccagtattgataagctactggcggttgggtcttattttctttaacctgcgtttgaggttgtaatcttacgggcacctgacctgctggaagaggacttgtgcctcgtggtttagactctgatggccccattaattctggaccttttccttctaattttaacgtttcaggatatatcacctcctgtaattgattatagtcaacattttgcgttgactgagccattaccggctctgctacatatttgcaatgtaaactttccgtttctttctgggattttttccttgtcttttcattacaatctattaaacagcttccaggggcatcagaaactgaaatgctatcttcttctgtttgaaatggttctaaagctgctttaataatggcccaatcattccatactgtaagtggaatgatattacccttcctacctgcttgttttagttccttaccaattcttttccaatcttttagatctaaagttccttgttctggaaaccatgggcaaaattgttctattatttgaaatagcttgattagattttttgtagatactttaactccccctctttttaaaagaattttaataaagctgagataagaggcatatttacttttaattttacttttagtttgccctattatcaccctagcttcttccgagcgcacaagcttactgtaaggctgactgtagacgtacttgggatctctcgtcgacttgtcctcaatgaccacgctcgagcgtaccttcaccctagagaaaagcctccacgttgggcaccagatgtaggggtgggttgcccctacacacctgtgggtgtttctcgtaaggtgggacgagagatttggaaaagaaaaagacacagagacaaagtatagagaaagaaataaggggaaccggggaaccagcgttcagcatatggaggatcccgccagcctctgagttcccttagtatttattcatcatttgtgggtgtttctcgaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcagtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggatggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccatttaactctgagttgacacagcacacgtttcagagagcacggggttgggggtaaggttatagattaacagaatctcaaggcagaagaatttttcttagtacataacaaaatggagtctcctatgtctacttctttctacacagacacagtaacaatctgatctctcttgcttttccccacattccattgctgataccctttcttccagttgatagcatcgactcctgaggcttcttcattcttcacgtagttctcgagccttggttttcagctccatcagctcctttaagcacttctctgtattggttattctagttttacattcttctaaatttttttcaaagttttcaacttctttgcctttggtttgaatgtcctcccgtagctcagagtaatttgatcgtctgaagccttctgctctcagcttgtcaaagtcattctccatccagctttgttccattgctggtgaggaactgcgttcctttggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccgtgtgaggtgtcagtgtgcccctgctggggggtgcctcccagttaggctgctcggggtttagggaccctcttgaggaggcagtctgcccgttctcagatctccagctgcgtgctgggagaaccactgctctcttcaaagctgtcagacagggacatttaagtctgcagaggttactgctgtctttttgtttgtctgtgccctgcccccaggggtggagcctacagaggcaggcaggcctccttgagctgtggtgggctccacccagttggagcttcctggctgctttgtttacctaggcaagcctgggcaatggcgggcgcccctcccccagcctcgctgccgccttgcagtttgatctcagactgctgtgctagcaatcagcgagactccatgggcgtaggaccctctgagccaggtgtgggatataatctcgtcgtgcgccgttttttaagccggtcggaaaagcgcagtatttgggtgggagtgacccaattttccaggtgcgtccgtcacccctttctttgacttggaaagggaactccctgaccccttgcacttcccaagtgaggcaatgcctcgccctgcttcggctcgcacacggtgcacacacccactgacctgcgcccactgcctggcactcccaagtgagatgaacccggtacctcagatggaaatgcagaaatcacccatcttctgtgtcactcacgctgggagctgtagacaggagctgttcctattcggccatcttggctcctccacgattcagtggtaatgaattttcttagtgattgcttgttcgggaaaaattgtctttctccttctgttatgaaaattagtttggtgagatacaaaatacttggttggtatttctttacttcaagaatgctaaaaataggcctccaggtctattctggcttgtaaggtttctgctgagaagtccactgttcacctgatggggttccctttgtgaacagtgatagaaaagtgatatgacccttttctacagttgcctttaagatttcttttcttgttgactttgaaaattctgatgattatgtgtcttgaggaaggtcaccttgtataatgtctcacaaagattctctgaatttcttgaacttacatgtcaacttctttcgcaaaattggggaaattgttgtggattgtatcctcagatatgttttccaagttgcttactctctcttctctctcagacatgccagtgagtcacacgtatagtctctagagggtttgtctatttttaaattattcttttttatttgtttttgtctgactgagttgatttggaagactgatcttcaagctctgaaattctttcctcagcttggtctaatctgttattaagactttcagctgtattttgaaatttctatagtgaaattttcaattccagaagttgagtttggttcttacttaaaatggctctgttgtctttcgatacttggatcattttttgagttttcttggattgggttttaattttctcttgaatctcgttgagctttcttggccatccatattctgaattctatgtcagttgtttcagacatttcaatctggttaggatccattgctggagagatagtgcaatcctttagaggtaaggaaacactctgactttttaaattgctagagttcttgcactgattgcttctcatatgagggggccagtatttctttttgaaattgccgtcatttggatgggactttttgtttttataataatttttgtgtttgactgtggtgtatgttgtgtatagtactggcttcatttctatgtgcttttagagggccaaggctgtgtagagttcctcagttgtggatcctttcctgcatgggtctccaggcattgagcgctgaagggatgtatttttgcttcccggtgtgattcaggttgcaatccagtagatagtgcttaagagtcagggctggcagataggctcttagccacatgcctcttgtgtgtttcagtgcatgtgcagcggtgccctggggaggggaatggggggcaaaagatgacttcctcaccaagtttgtctacaggccttagtggagtaccctgcagttactggcatcacgcctgcatttccttagcatcaagtggggctttggtgggctaccttctccacaccttcttaggtgtggtctgtgccaagtgttaggtcaccaggagacccacaattccctggagacctactggtcctctaagcctggcagagtccaaggaggttgtgaggtatgtctgcaggtagtctggtgattcagtgggtcaagagtggaggatcctgagggagagtggtggtaccacaggtattcagcttgtgtgttgactgtggccagggattttagcccagaggatgattgtgggacctgctcagcttgcaccccttctactgggtctccctctgatgcctgcgtaagaacaggcccaaccagctagacttgtcccaagccttctgcattcaggtcacttgctgttccaaaatgttctaggctgcagggctccttggggcagaagctgcagctaacaggctacaccctttctggactggtctggtggagggagggatgaccagctcccatgccaccacatgagcacaggccacactccctcagtgttctgagagtgggggctcctccccaacctgagctcaggccacagatctcagcttgatgcccctgggtagtgtgcttgaatcctggggggtagggactcggccagtagttttgtcctctgaaccctcagggttgagtgccagctgtgctgggggagtttaactcctcccagacagctggcaaaacactcaggtggggcagtagaggctgtgctgtgggcaacctcctgcaggagtagccaggcaggttgtcttaggagggactggtggacaaggcagcgtgtggatcagatgtgccctgctcctgcaggaaaggcagccttgctctctcctggccgaacagtcagcaggagctacagtcactcagagcaagatagagagccttctgggataaatgcctgaagtcacgtttagttgctgctgcaccacgtgccaccttgaaaccttcagggttctatgcaggttcaatctctgcctctgtctggtctctaagaagttcctcctgccaattcaaatgtctgtgggggtaatgggatctcttgtctctaggatcccagagggttgtatttggggtgtggtgccttggagttcctttactcaccccttccttaggacctgttgagggccaggagctggtcttggtgctcggtgactccatgcaggcttcccagtttcctccctctttagccacaatgtctgtcacctccctatcgatttttggtgttttctctcaaaatattttttcaaagtataatggtttactctacattttggtttctgttagtgagggaggcctttcccagctgcatctagtcagccatcttctagatctttttcttgattctgacactttgacctaatttaaatgttgacctgaggatattttgactctgcttctaaataccaatattcagatttatacgatcatcaatgaattcaggtcaataaggagttcttacattttttgaagtaaaatctatgagtttgattccttaattttttgtatagcagtgttaaactatggttttattcttttttattctactaaacttcattggactgaatgtcaatttaaaaacaaagatttgatttagtgattatgttttatctacattgtttgaacaaccaaagctatttcattaaatatttctgtggtcattatttctccctaatacaattttccaatgtcaaattttaaaggaagatataattcttttatcaatttttggtcagtaaacattaccatgaaaagtttagctaatgtcaattctattttctgttaataacttctctgaaggtttcatttcttccaaggtcaatttttgcagttttctggtttactaacaatatgtgattctttaacccattttgaccattgttcaactaacttttacaaagaaaaaattcacttcactatatgtacatgtctttagaattgctagttttattttgtcatgatgatttcctcctaatcttgttttgcttgggtaaagttgtattttatgttgaatatcctcagtgtcagaatgccaggattaaaatattctcctgtaatcttaattactctttattttttcctctcaatctgcatgtaagtgttagccagagttaggcatctggggaaaagtaagtgtaaatttaaggaaaaagggcaaattttttatttaggtaaaacattttacatgcatttgatctctgactcactgggaaaaagctctttccttaccctgaaggttttttttttttttttttttgagacagagtctcactctgtcacccagtttagagtgctgtggcatgatcttggctcactgcagcttctgcctcccaggttcaagcaattctcctgtgtcagcttcccaagtagctggaattacaggcatgtgccaacatgcccggctaatgtttgtatttttagtagggacggggtttcaccaaattgaccaggctggtcttgaactcctgcccttaagtgatctgcccgcctcggcctcccaaagtgctgggattacgggcttgagccactgcgcccagctaccttggagcttttatataccttgtcaatccaacctggctttttctttctggcaggatgaactacctcttagcacaaagtattgcaatcaactgttcctcacctgtgtgaaaaacagcctttagaaggttgaactaaataaaaaaatatataatctcacacttttaaataggtgggccttcattttagcttttcgtaggttagtctaaagtaatacaaatgaatatatcttttattgattagctggaaataatttagactctctgtctctttcaaattattaaaaacagataaagtggctactctgggatggatctgattttatttctccactgtttttcattttttgattttttaatttttcattttcttaattttcttgataatcaggaaaggctgaatattatgctctgtagaaagctacttgggtctttggatatgttgatgtgactacaaaaataacaataaaaatagtttacagcacttactgtgagttggacactattcttactgctttacatatgctaactcaatgtatctaaaacccctttgaggatggttctatttctcctattttatagatgaggaaactgaggcatagagaagttaagtaacttgtgcagataaacacagtaacaattgaacacaaactgcatgaagttttctattttaaaaatactttatatcttgtttttaattaaaaataaattttgattccctgccttcgcaaatggggtgaatgtataatttcccattgacacatccttgctgcacgtaaagagatggagagatggagcatgaagtttgaagtatgtgataaaactggagtccagcccctttatttgctttgtacctaccaaacccaacaggaaaactgaggagttttctctgtatgagatgagagcattgtcccaatccttctcctcactcctctttcttaatatgcctcttagtttagatcttccctgtagcacatgtacgttgtttcatgcaaccagtaaaactgatcatattattaaagagtttgtagggacaaactgcaataagtagaaatttactaaatgctcagttttacaactacttacagcaggaaattacatttttctcctgttgctgattttctccatctctctgacacccctgactcttctcattagcctaccatatacccactctgatcccgtatcaaagttaccctctttggtgatactcagtttcctgtttgattctgcaggacatcatacacttgtgagtttttgtggaatgttttgagtacaaccagtatataatatctgctaggaatgctctggtttatgctccaggaattttgttacttccatcttctctctacagcctttgagattgactttgtagttcactgagcggtccaaaatacttatcctatgtaaattgcctggaagaggtcacctccaggtatttgtatacacacactactgggcgtctttgcaataagaaactgtggttggaaatattctgatcactatgctacccaaggctgagtctgtctcagtagttaaggagatgaaagaagttataaagcagtttgaagtggaaaaaattattttaactggaaaaatttcaataaacaaattattaaattgatattcttctttctaaaatagttatttttctatgtaataggtataagtttatgttacagcatatgggaacaaaaaacccagaaattatttatttcctcctagaaccaaagtctagaatattagctttagatgcttgacattctttgccaggttccaggcctggcttaaagccagaggatggaggatgaggaacataattttcctattcattgaataaagttcttagttcagtcagaactactcttagtgtaaaagcctaacctattcaaataattttattttcaaacataaatgaatggtatcttgatggcgtagaaccttctgagaaaactggattgcatacatggtaatccatgattggtgctagagaagatgagctgtaagcagtaagtttcaaggccaagcaatgggaaaacttccagctggaaacctggtaattgattgaactgtttcatctttgttttttattcttttggtgaagttttactttttctttccttataaacttaactaacatcttcagttattaaaaaagtttttatttttatattgaagaaatgaaagaaccacatttaatagaaaatgtaaaaatagatttaataaattatgattttttattttaaataaacacttaactgtgtgccaaaagtattgctatgaaaataagaatcaacctctatttggagacatttacatttttccccaaattaaataataatactctatcaaaatgaaatttctatcatgacatttttatggaatgtatgtatctctcatgaatcacggctatcatctcaattttgtcattgcactgaaaagaacatgcattctttcttctcctcacctcaggaactcgtaaaagtactaatcatccttaaaaataaaaatgcagtagatagcattatttttaaatttctctgatactatatggagtagattatttattttgtatgaaagtatgtaaatagtaagaagaagccaggagcagtggctcacacctgtaatcccagcactttgtgaggctgaggaaggaggatagcttgaggccacaatttcgagaccaccctgggcaacaaaacaaaaccctgtctcttcaaaaaattaaaaaaaaaaatagccaagtgtagtggtgtgcaccagtagtcatagctactcaggaggctgaggcaggaagattccctgagcccaggaattggaggctgcagtgagttatggattatggcactatatttcagcctgagtgacagagtgagaacctgtctttaaaaaaaaaaaaatgtgagaaagagagaacgaatcactttttgctttctttggatgtcttccacaaaaccagaaaaataagagagatgtatacctgctaggaaaatttttgttggactttaatgatgttgatacattttaatatgtatttaattggttagtacacttaatgttttatacataaacttccttcttgaatagatcatgacagaagtgaaaacagtaaacatgcagaacattctcatagttgcgtatgcatcatgaaggagttccccttgacaataatagacatttcttaggatatatttcagaacaccaagatttgatttggagcattcagaataccaatttgagtgtggtgtgtgtgtgtgtgtgtgtgtgtgtgtgcatgcacattttaaagagacagagagagcaaaatcaattttattgttatgatctgaaggtacctattaaagtagactttataaacatatcttctagaaatattgagttaatgccacctaagtcaaagccaaagtgtattaggtaagtatttacttaacaaatacagtcaacctttggtgtttacgggttctgcacctgcagatttagccaactgtggatcaaaaatacagtatttgtgggatgcagaacccacagatatagagggcagactttttgtattcatgcgttttgcagagtcaactgcagacttaagcgtctgtggattttgttataagggaaaggttctagaaacaatcccctgtggacatcaaggaacaactgtaattactcaattctgtgattatgataagaactttgtactgattgatcagatcatcttgtaaaatgtgatatttatgagtgtttttttaattggttgctttgttagataactctgattaaagcaaatttctcagtaatattgatattctcttctaatacctggcctagtgatgtgaggccagcctcaataaatattgacaaaaaatcattagctatttgttaaatgtttagaaactgttaagtgctcttttccaaaaacaatcaatgtattccttaaccatagagaatgtggtataaaaatgcaacacaggggtgacgtcagcgatttggtggcatgggaggtctcctttcatattctcccaactccaacaataatttctcagccatttatgggaaaaaaatgcctttgtgggagctatgggatccaagtaagtgattgtaagctctggtagaccctaagactgatgacagctgttttgagaaggcaggcctgtgcccaggtggcaggctcactgatggtgaccttggctacaaacctggaaacagctccatccccctatggactctgctacagccccatttggccttagtcttgccaccagcaccatccaccaagggacgcacgaggaaccacatctgtccctgcttcaggtaacaggcctgctgacactggtcctgactgtggactctgaagcagtatgtgacccaactccaggtcctctgagccatgatccaggagcagtcctgtctgatgaataatgcaacaggaatgacccagcaggagccacacctgtccacaaacctgttaataggcccaccttctgcagatccaactgtggatcctgaagcatatgatccttgtctcgatgacaactttactgaccaaggtatcagagacagtctcatctgcttagggaccccataggagatatgcctacctaagccccctgacaacagacttaccaatcacagatcccactgtggacccagcaagaactatgtgacccagcttcaacctcactgaactgaaattccagaggcaatcccattatcctggggacctaacaggagaaggtatttacttgctgaaagtggttgtaaagactgaaagaggtctttatctcttccagtgctcagctaccaatgcaaggctacctggattacaaacaattaagcaaacatgacactgcctaaggaaactagcaaagctctagtaactgacatcaaagaaatgatgatctacaaattatctgacaaagaattcaaaataatcatcttaaaatggctcaatgggatgtaagataacatagatagataattatttaaaaataacaaaaacagagcattaacacaatgagaagtttaataagaaacagaaactataaaaataaccaaacagaaatctaggagctaaaaaatacaatgacagaactgaaaaatttaatagagagcataaacagcagactcagtcatgcagaagaatcagcaaactcaaatatagctcatttgaaattacctggttagaggaacaaaaagaaaaaagaatgaaaaagagtgaaaaaagcatacagcgcctatggtacatcataaaacaaacaaataaattcattataagaatttcataacaagaaatgagagaaaagggaaggaagcttgtttaaataaataatggctgaaaacgtcccaaatcttgacagcaatatgggactacaaattcataaagcttaaaggtccccaagaaaggtcaactaaaataatttctgaatattcttgaatattctaatcaaattgtcaaaagtcagacaaaaggagtactgtgaaagcagcaagagaaaaatgactcatcacacacaagagaactttaatgaggctgccaatgggtttcttaacagaaatcttgcaggctaggagagtatgggattatatattcaaaaggctgaaaaaaaggctccaaaaatgctacacctagagaagttttccttcagaaagggagagatgaagacattctcaaacaaacaaaagctgagggacttcatcaccactaggtctgccttacaagaaacattaaaaggagttcttcaagttaaaatgaaatgatattaagtaaaaatatgaaaacacatgaaagtataaaactaactggtaaaggcaaattcagaatattctaatactttaatggtggtgtgtaaatcacttttgactctagtataaaagaaaaaagactaaggtattagaaataactatagccataatatttgtgaaagaatagttatatcttttatattgtatattcattcacagaaaatataaagtgtgatatcaatagcatacaggtgagagtagtgaagtagaagtatagagatttatatgtaattgaagttgctatcagcttaaaatagactgttataactataagatatacatttaacccccctggtaacaacagaggaaaaaaacctctagcagataaataaaatagaatgagaacagaacaaagtatactgctagaaaatattaacaaactacaaataaaaagaacaagaactcattttttatggctgcatagtattccatggagtatatgtaccatattttctttatccagtctatcattgatgggcatttaggttgattccatgtctttgttattgtgaatagtgctgcgatgaacataaatatacgtgtgtctttataatagaatgatttatattcctttgggtatatacccagtaatgggatttctgggttgagtggcatttctgtctctagatccttgaggaaacatggatggagctggaggccatcatccttagcaaactaatgcaggaacagaaaaccaaataccatgtgttcttatttataagttggagctaaatgataagaacacttagacacatagaggagaacaatatacactggggcctaccagagggcagagggttggaggaaggagaatatcaggaaaaataactaatggatactaggcttaacacctggccgatgaaataatctgtacagccaacccccttgacacacatttgcctatgtaacaaacctgcacatcctgcacatgtacccctgaacttaaaatacaagttaaaaaataaaaataaaagaaatcctgtgttattcaaatgtaaaaaaaatgatagcaagagaagaaggaaacaaaggacaacggaaccacataaccttcataaaacaatgaacaaaatggcaactttttgaaagtcctaacttgtcaactttaaatgtaaatagattaaattatccaatcaaaagccacaattcatgaacaaaataagtttgacaaaaatagaaataattataaataagaaaaatcctagaaataaaaatacaataagtgaacaaaaatatttagtagaaaacttcagtagcaggcttcctaaatcataataaagaatcagtgagctccatgacaggatattggaaattatccagtcaaaggaacaaaaagagaaaagaataaaaaagaatgaagaaggcctgtgggagttacgggaaaccatcaagagaactaaactttgcgtagtaggtgtttagaaggagaagagagagaaaaggccaacaaagcatttttaaggaactattgagtgaaaatttctcaaatcttgggaaaacaccaccatccaggtataggaagctgatatggttgggatctgtgttcccaccaaaatctcatgttttaattataatttccaatgttggaggtggggcctggtgggagatgattggatcatggggcatatctcgtgaatggtttagcatcatccctcttgttactgtcctcatgatagtgagtgatttctcatgagatcttgtcatttaaaagtgtgtagcaacaagcccttactctctcttgctcttgctctggccatgtgatgttcctgttgcaccttcaccttccaccatggttttaagtttcctgaggcctccccagaagctgagcagatgccagcagcatgattcctgtacagcctgcaataatggtaaattcttttctttataaattacccagtctcaggtatttctttatagcaatgcaagaatggtctaatacaaaagcttagatctctgcaatcaaatacaaaccaaagagaaactcaccaagacacatcataataaaatcttcaaaaatcaatgacagtaattctgaaagcagcaaaatacaaaagatatgccacatacaagtaagtcccaatacatctgtcagcagatttcttagcaaaagcgctgcagacaaggagaagtaggatgaatattcaaagtactggggggaaataactgccaagtaaggatgctttatctggtaaagctgtccttcaggaatgaggaacacaaaacctttcccaggcaaacaaaaactaagaaaattaatcaccactaagccttcttaataggaatttctagggaaagttctttaagctaatatgaaagactgctaattaacaacataaaacacatgaaagtacaaaagtcaatcaaataagtaatacataattatattccaaatattctgatattgtaagggtgatgtggaaagcaattttatctctaatatgagaggtaaaacacaaaactattaacaacaactacaggtacaataaattgttgagaaatacaaatcacaaaaaggtgtacattttgaagtcaatatcataaaatataaggaggtgagtataaatatagaatttttgtatgcaattagaattaagatgtcagattaaaacagcctaaatataaaatattttatataagtttcatggtaaccacaaattaaaaacctaaagtagtttcacaaaacagaaagaaaagattcaaagcataccaccacagaaaaccaccaaaccacaaaaaagacaagaaagaaacaaagaatctacaaaacaaccaaaaataactttaaaatggcaataatacatccttacctattaataattccttgaatgtaaatagattaaattatccaatcaaaagacagaatgactggttgggttaaaaaaataagacccaactctatactgcctacaagagacttactttactagtaaagagatacatagagtgaaaagtgaaaagatagaaaaagatatccatgcaaatggaaaccaaatgagagcaggggtagctatgtttatatcaggcaaaatagacttaaagttacaaactttaaaaagagacaaagatatgattaaaaggccaatttatcgagaggatatgcaaattgtaaatatatatgcacccaacctaaatatataaagcaattaaatgaactgagggaaatatagactgcaatacaataatattatgggacttcaatatgccactttcaacaatggacaaatcatctagatagaacatcaaaaagaaaacactggacttgtacttatactcgcgtggacttatactcaccccccttacactttagatcaaatggacctaacatgtctaaagaacatgcagtccaacaggattaggatacatactcttctcaagggcatattaaacattctccaagataggtcatattttaggtcacaaaacaggtcttacatttaagaggagtgaaatcataagtatcttttctgttcacagtggtacaaaactagaaatcataaaagaatgaatttcagaaaatataaaatatgtggaaattaaacaacatgctcatgaataaccaatgggtaattgattatcaatagtcaagaagaaataaaaaaggaagtcaagaaatgccttgatacaaacgaaaatgaaaacaatgtatagaaacttatgggatgccccagaaacagttctaaaagggaaattcatagcaataaatgcctatatccaaaaagaagagagttcaaataaacaatctaacatctgacttcacaaaagtaggaaaagaagaacaaaataagcctcaagttagtagaaggaagaaaataatgaagatcacagcataaataaatgcgagactagaaaaacaatagaaaaaaaatcaatgaaacgaacatttttttaaaaaaacaagtcaacaaaaccttagctagattaaaaaagagagaagcctcaaataaataaaatcaaacatgaaaagagaacattataactgataaccacagaaacacaaaggatcataagaaactgctatgaataattatatgtcaacaaattggataacctaaaagaaataaattcctagacacatacaatctaccaagactgaatcaagaataaataaaaaatctgaatagatcgataataagtaaggagatttaatcagtaacaaaatgtcttcctctaagatcagggataaaataagaaaaactaatactgattcttcacaaactgtttcaaaaaattgaagtgaatggaatacctccaaactcattttacaaggccagcattaacctgataaaaagccagacaaggacacctcagaaaaagaaaattacaggccattatctctgataaacataaatgcaaaaattctcaacaaaatactagcaaattgaattcaacaatacatcaaaacaattatgcatcatgatcaagtgggatttatctttgggatacaaggatgattcaacatatgcaaataaaaaattgtgataccctacattagcagaatgaagcacaaaaactaaatgattatctcaatagatgcacaaaagcgtttgacaaaatttaacaccctattatgataaaaactctcaacagattaggtatagaggaaatgtgcctcaacacaataaaggctgtatatcataagcccacagctaacatactgtgaaagtttcaatagtgaaactaacatactgtgaagttttcaacagtgaaaacttgaaagcttttcctctaagatcagggataaaataagaatgctcactcttatgacttcttttcaacataactctagaagtcctagaccaagcaattaagcaacagaaagaaataaaaggcatcctaataggaaaagaagacgtgaaattgtctgcttgctaatgacatgatcttatatacataagataggaatctgtaaagattccaccaaaaaactgttaaactggtaaatgaattcagaaaagttgtaggatacaaactcaacacgaaaaatcattagcacctctatacacaaataacaaactatttcaaaaggaaatgaagaaaaaaatctcatttatactagcaacaaaaaataagatacttaggtgtaaatttaatcatgtaggggaaatatttgtataccaaaaactgtaaacactgatgccaaaaattaaagaaaacacaaataaatggaaagatatcttgtgttcatggaatggaagaattaatattgttaaaatgttcatactatgcaaagtgctctacacattcagtgcaatccctatcaaaatttcaatggcatttttcacaaatagagataaacaattgttaaattttatggaaccacataaaccctgaagagccaaaacagtcttgagcaaaaggaacaaagccaaagacattgcaccccctgatttcataatatattataaagtagttgtaatcaaaatagcatgacactggcattaaaaacagacacgtttaacaatggcacgggacagagaacctacaaataaaactcacacatttacattcaagtgattttcaacaaaggtgctaagaacactcaatgggaaaaaaagatagtttctttgataagtagtgttgggaaaactggatatccaaatgtagaagaattaaattgaattattatctcacatcatatacaaaaaacaactggccaggtgcagtggctcacacctctaatcccagcactttgagaggccaaggtgggaggatcacttgaagccaggagttcaaaaccagcctggacaacaaagtgagacccccgtctatgaaataaaataaatattcagcttaaaatggacaaaagaattaaatatatacctgaaactataaaactactagaacaaaacagaagaaaatttccatgacacttgtctggtcatggatttttttgatatgaacccaaaaatatagccaacaaaagcaaaaatggacaaatgagattgcatcaaataaaaagcttttgaacagtaaaggaagtaattaacaaagtgaaaaggcagacaatttgcgagtgggaaaacttattttcaaaccatacatctgataagaaatttatgtccaaaatacataagaggctcaaacaactcagtagcaaggaaacaagtaactcaattaaaacatagggaaaggacctgaacagacatttctcaaaaaaagatatataaatgactgacaggatgtgaataaatgctcaatattactaatcactagggaaatgcaaaattaaaatcacagtgaggtatcactttatacctgttggctattattgaaaatatgaaagataacaagtgttggtgaggatgtagagaaaagcaaaccctgtgcaccgttggtgagaatgtaaattggtgcagtcattatgggaaaatggtatggaagttccccaaaaaaccaaaaatagaattaccacatgatccagcaatcctatttctgagtatatatccaaaggaattgaaatcaatatgttatagagttatcaacagtcccatatttcactgcagtagtattcataacagccatgataaggaatcagcctaagtgtccatcaacagattaatggataaagaaaatgtggtatagctgggcatggtggctcaggcctgtaatcccagcactttgggagaccaaggtgggtggattgcttgagcccaggagttccagatcagcctgggcaatatggtgaaactctgtctcttaaaaaaaaaaaaaatacaaaaattagccagcgtggtggcatgcccctgtagttccagctacttgggagactgaggaggaaggatggcttgagatcaggaggtggaggctgcagtgaactgacatcacgccaccgtactccagcctgagtgacagagtgagaccctgtctcaagaaaaaaaaaaaaaaaaaaagaaaagaaaatggcatatatacataatagcatactattccaccttaaaaaaaaaaagaaaagaaaattctgtcatttgcaaaaacatggagccgcctggagggcattataagtgaaatatgcctaggcacaaaaagacaaatactgcaagatctcacttacatgggcaatctcaaaatgtcaaactcataaaagagagagtagaatggtagttaccagaggttgcagggggaggggagggaagggagggaatgggaaattgttggtcagtggttataaagtttcacttaggaagaataggattttgagatctatagcacagcagggtgactaagtcaataatacattgtatatctcaaaataggttaaatttcaaatgtcttaccacaaagtatgataacaagcataagggatatgtttatcagcttgattgaatcattctacattgtatacatgtattgaaccatcacatcatatcccattcacgaatgtacaccattatgatttgttggttaaaaataatgttaataaaaaattattcaattacaaaaaataaattttgggggtataaagtactgcatggtgactacagttaataatactatactatatatttgaaatttgctaaaggaatataccttaagtgttctcaccacacacacaaaatggtaactatgtgagatgctagatttaattagtatgattgtagtagttatttcacaatgtatatcaaatcatcacattatataccttaaatatatgtaatttttattttccagttatacattgataaagctagaaaaaagttttaaaaaataatgcaatgcaaaactttgactaacataccaaattgagtcttaaatatataaagtatagcactagcacaacaatagctaaaggttaaatataccaaatatggcatgcacacttatcaaacatctttaattcataacagttttcccctgtgccccatgtattcactgtatgttgatttacattatttcaagtattttttcctgaggtatctactggaaaaacctgactgttcaaacttaccaattttctgttctgttcttctctttatatttttatttagtacttaaacaatgaatcagatacggtttctggcaggaaataaagtagctaatgtagtaaaaatctttcctaagcaatagtatgcaggactatgttgtgtgtattgtatgtgtgtgtgtgtgtgtgtgtgtgtaagtgacattgaagaagcacagaactagaaacagactagtgcaaaaaccatgttaaattttaaaggcaagttgttttctaacatttctaaagttctggaacgggttttctggaagtgatgtgtgacatataactctttgacgcatgcttatctttttgtaatgagatttgagagcaaggttaaagttaaattagtaagaaagaaaactagctgatttgagtaagtgtttaatttaaactatgaccataattatccatttctctcctcatggttcactatttccttgacacacaggattttctatcccaagttttccttcctccacccactgggcccattttcttaaccctctttcaaagtccagcttgcagaccacctccttacatgaggcttttcttggtttcacagctaaatatgagctgtctttccctcacattttccagggcctttgtgtttcctctttaagcactctttgacttcttgtgttacagtctttgtacatttgtgtatttctgcttcacaagaggagttgtttcttatccatctttgtgtctctgatagggccttacagagaaagcactcagtgaaatttcaattctactcagtgctcagagaaaccttttcagaggttgaaatgaacttagatggaagtttttggtcaggacacgttcacattttaagggctctctatcaatgaatagtatcacaggctgcctgagcctccaagttcaagagcttttagtgacgatatacaggaagtgctcttggttcttttagaggttggaaagacaccagcaactaaggccaagaaaaggcataacgttaattcttttctttctctaaattcctgcaagtaagataactgaagatggattggatggcatggatgtgggaattaaaattgatttcagttcttaggagaagagttgagaaaaaagataggaaatgcaacgatgtgccacttaaggatgggaatatgttctgagaaatgcattgttaggcaattttgttgttgtgcaaacatcatagcatgtacgtagacaaatctagatggtatagcctactacacacctaggccatatggtataatctactgctcataggctacaaatctgtacagcatgttattgtactgaatactgtaggcaattgtaacacaatggcaagtatttctgtacctaaacatatctaaatatagaaaaggtacagtaaaactgcagtataaaagatttaaaatggcacacctgtaaatacggcacttacaattaattttcaagacttcctggaagttgctttgagtgagtcagtgagtgaatggtaagtgaggtgaaggcctaggacattactgtatattaggatactactgtatattactgtgtatttagtttacactaaatttattaaaaatgtataatatataataaattaaccttaactttctgtaacttttttactttaaaatttaaatcatttaagctttttgagtcttgtaataataggttaaaacataaatagctgtacaaaaaaattttctttctttatatccttattctatgaactttttcctatttttatattttttaatttttaaactttttgttaaaaacagagacacaaacatacatgttagcctaggcctacacagggtcaggattaccaatatcactgtcttccacctccacatcttatcccactgggaggtcttcagaagcaataacatgcacggagctgtcatctcctatgctaacaaggccttcttctagaatatctctttttttttttttttttttttttgaggcagtcttgctttgtcaccaggctggagtgcagtagcactatctcagctcactgcaacctgtgcctcctgagttcaagcaattctcatgcctcagcctcctgagtagctggggttacaggtgcccgccaccatgtccagctaatttctgtatttttttgtagagatggggtttcaccatgttgatgaggctggtctgaaactcctgacctcagatgatctgcccacctccgcttcccaaagtgctgggattacagacatgagccactgacttcaagaggcccagaatacctcttgaaggacctgcctgagactgttttacaatttactgggtttttttaaaaaataaatacagtatagtaaatacataaacaagtaacatagtcatttattatcatcaagtatcgtggctgtaaataattgtatgtgtgatacttttatacaactgacagcatagtattgtttacaccaacatcacaatcatgagtaatgctttgtgctatgaagttacaatggctattaagtcactaggtaataggaaattttcagctccattattttcttggaggactaccttcatgtatgtgattcatcattgactgaagcatcattatgtgatgcataactctaatttttattgaggacctctttgtcagacatttcacatgtcacttaatatgtaacagtaataatcacagtactttctcacattaatggaaatatcgtaaataatttcacatcatgatctcatttgacttttccagttgtgatataggtagtgtatggattatattcttcctttaacagaaactgagacataagaaagcaaaatgattttttcaaggttacatattgagtcaaaaacatagtgttagaatataaactttttgtatcttgattagctctttctactatatcttttgttcctagcacaaaatacagtttataatttttatacagtattttttaaattagttaagagctctttatgtcttcatgtgcatcaaccttggttttatttctttgtaaaattttctttaataagaatgtgtatgggaaatttttgttggttaaacacagagaattccatactttaaaagttttgactaaatgtatattactaaataaataagcacatcttaccaacctctcatttatgacggtaactgataacacacagtggtgggaaagtggacatcgagaaacagatatacattatgacataatgaagtaatatttctcaattttaatgttgacctaagtagaagaaggtagtggaccctccttggattggtgtcagaatcccatgtgtcagaatccactgtggcacagaaaagaagcccggagctcctttcttcttgagaacatagggctacctaaaagatctgagtcaaaaatagatacctcagaaattctggaaaattcctgggagaaaaagaagacctaggaggttttacttaagagctcgaaagttgattgggccactggatgatactttgatttttgtaagcttttctgtgtcggagtgatcagacccaacaccaggtcgtgggggtgacgaagtccggcggagtcaaaggaatgagaaaaagacagtttgagagagaaattgggaccagggggccatcgtgagtgtggaggctgcaaaggccccaagctctgggagcccacgctttttattggtgctcaaacaaagaaacaggtagtgaggatgtgggggttgaaaggaaacagtgtatcaagtgaatgagaaacatatggctgcttgagataatgggagtgctagaagctgggagccagcaagtctatgggatatgtaagccctgcctcagcttctctcccaacacagcttttctcccaatacttccagatattttaattcaagtattccaccaatcaagaagtttggggaatgattggaaatgaaataacctgaattatctgcagaatgcctagaacacccacctgcacacagctttaaagggttcagcctcagtcctctaagagactttcctgtggcactaggatgatcaagggaatttatggttagagaaacagacatctatagtgattccacacatataacctgtatatgttctttagaaatagaaactttgttctaaaatccctctgctaacttatatttggattctaaaacatttcattcatttaaaaaatcagtagtgagtgaaaggtcatgtgttaatttgcaggccttcaagtgaatacaatgtggaagaagaatccttggaaagtgttgagaataggttctaccttaccccatattactgtttttgaaccgaaagctggaggtgccacccctccttagctgccttagcaggagggaatgactactggcagaaatataactgaagcaaccaagtgactagaaattgcttagaagtgtacatattaatcctgccttgtgactttgtcatcattatctctctgcagaaagtaagttggaaatccggctggctgtttagacttttaaaatgtgaaagcagaacacttcttaagtcagttttatgatgcattctagccaatggttgcatgagcagcattatgaaaagcctaactggcatcagcctgtgtggagagtgaataaaaagtagcagaacaaataattttttaaaaagacagctctaagataaatttcattatttgttcatagcaaatatttaatcagcatctactatgatccagaaccactgttctgagtggtggggcatacagtaatgaacaaaacagacaaagttcctgccctcttaaagttgactctcttaaattcgagtagggatggctgacaataaacaaaacctgtgtgaggactaatagatagtcaaaaaattattatatcttgagttagagaagtgacttgctaaagttacacagatttccagctgtaatcaaaatgatagcagatgctcagttggctcactgaatggactgtctcagtctctgaacttggattacttgagtctttgaagtaatattgctaacatgttttggatttcttgtttggaaaaatgtaacctttcattttcttctgttttgtgagtgagtgtgtgggtatgtcttagaaagagtgagagagaacatacatatggccatatgaatctaacaaacataaggataagagcaaaaagcacgtatcatctgattccatctatataaagccaaaaatagacaaattatattatttaggaatgtataagaaatagtaaactacaagaaaagcaaataaatgatgatcatgaaattctagacagtgattactttagcaaagaagtaactgtttagtatcctattgtacgactatgtcattatttgtcttctctacttttcaaaaacgttagattgttttaaatttttggctattacaaatgctgctgccatgaaccgtattatccatgtatcttaatgcacatacacgtagtatggggtatatatttaggactgaaattgttcttttatagggtcagatcatgccaaactttttgaaaacacttctaccaatttttattctcactagcagtgtataagactccatatctttgtcaagacatcatattatcaagcttttcaatttttatgcatctttggggggtatataataatttctctgtggttttaatgtatatcttcctaattgctaatgagattgaatatgatttcattatttattgaccatttggattttcttctctgaagttcctatccaagtctcttgctcatgtttttataaagttttgtctttaaaaaaaaaacaaaaaacagaagttctccaatgagaacacatggacacatcggggggaacaacacacacttgggcctgttgggggactggcggtgggggagaatgtcaggagaaatagctaagggatgctggacttaatacccgggtgatgggttgatctgtgcagcaaaccaccacggcacactttgacctatgtaacaaacctacacatcctgcacatataccttgaaacttaagataaaagttgaagaaaaaaaagagacaaagaagacaacataaagcacagaaagtatcttaaaacacagaatttatctttgttttttccttccttaggtagataacttatggggtataagaaccttcttagtcttttatcagtactccaaagaaatcctgtttttcaaaaatagtagaacagattccagttttgcttcaaggttcttttgatttaaagtgcttaaaaaagggggattttttacatattctagatattagtaattcaatgttatccctctctttattgagcctttccatgactaaaatttcttttctttttcttttcctttctctctctctctctttttttttttttttttttttttggtaaagtgtgttattcattatgatgagtgcttttgggggatggtttgggggggtggggcgacagttagaatctcaaagactggaatggaagactcttaaagtggccaggatttctaaaccactctcagtacaaccactctagttccatcctcaagaacatctttgtagagtcgggtacatcaaagcacattatcttgccaagtgtggcaatgctttcccttacattagaactcatttactgataccagtgtaatagaaggaagaaagcctgatgcttccaataacgtaaaaataccttatatctgtctctctacaaatagactcactttataactagttctttttgtgcactgcttaataaatcctctctctgaggtcataatgactttataattttaccctttcacttcaggcttttctatctgagattgatttttgtgcctgatataaggtaatgtccaagtttattattttttttctttatagatatccatcgtcctaccaccatttattgaacagagtgtacacttactgatgatttttgtctctttgatcaaaatattggataaattactgagaaaatgtgttacaatctttaccatgattatgtctctttctccttgtggttctaaacattcacattttgaattttgttatgaagtgcatgtaactaaaattgttacatcttcctagttaactgaacctttattattatgaaatgaccctctttattgctataggttggtgcaaaagtaattgcgagttttgctgtactttcaatggcaaaaccacaattacttttgcaccaacctaatagtaatatattttactataatttcgatttctagagatcaacttcaactcattcctttcggttaaaattcacatgctttatcttcttccatccttttgtttcaacctttttctttctgtcttttttttttttttttttgagatggagtctcaccctgtcacgcaggctgaagtgcaatggcacaatcttggttcactgcaaccttcacctcctgggttaaagcgattctcctttctcagcctcccaagtagctgggattacaggtgcatgctaccatgcctggctcattttttgtgtctttagtaaagacagggtttcaccatgttggccaggctggtcttgaactcctgaccttgtgatcctcccgccttggcctccgaaagtgttgggattacaggcgtgagccaccaggcccagtctgtttcaacctttttctatccttgttttttgtatatacatatagcatatagttggattttgttttttatctagtgtgacacttttatcttttacaggcatattttgtccctttctgttgaatgtaattgtaaataaacttgagcttgtatatttcttagcctactcaggctgctataacataatactgtatagactgggtggctcaaacagtacacatttatttctcacagttctggagatgaaaagttgaagatcagggtgtgggctgatttgattctggttgagtgccctcttcctgatttgtgattctggttgagtgccctcttcctgatttatagatggctggtagacagacatccccttgctgtgtcctcacacggcaaagggagaccactggtctcctttcctcttcttataagaactctaatctaatcatgggaacccctctctcatgattctatctaaacctaccaccctcaaaggcccttacttccaaataacatcatagttgggctggagttggggggggcgcggtaggacttcaacatataaactttgggagggcataaacattcagtccataacagtatatatcatcttatgttgtgctttcttatttcccagactggtctatgtttattttccttttctttcttacctgattatagatggaccaaatttcttattctattttccttcctctactagtctggaagtaatgtatgctgattctactcttttaaaattgcagcctgcatacttataaaagtttaaaatgcattcatattttaccctttttttaaataataccaaagtccataatatttcaatttttggattgtattatattattgccataattttctcattttatttaaccccacaagactttattaattattgctttaaataataagtgatcattctcctttctccatagttcttcactctgcatttcttctttcatcaaaagtctttgatctggcttactttttcttctctcattacacaatatattttagtgagggcctgctggggcaaactctcatttgttttgcctgaaagtgtctttatttcaccctttcttttgaacatattttcaccagatatagaattctatgttggtggctattttgtttcattgcctgtctccatcatctctatatctctattccctatttctggaaatctgatttgatatctgttagaacatcgcattccatcctcacattccatcctcagtgtaacaactactttttttttgtttgtttttgagatggagtctcgctctgtttcccaggctggagtgcagtggcacaatctcagcttactgcaacctctgcatcctgggctcaagcaatcctcctgcctcggcctcccaagccgctgggactacaggtgtgcactgccacactggctaattttttatatattttaagtagagatgaggtttcaccatgtctagaactcctgacctctggtgatccacacgccttggcctcccaaagtgctgggattacaggtgtgagccaccacagctggcccagcaattattttttaatatttttcatctctttatttctctatgctacattctaaataatttatgttgacttactttctagtttgctaattgtctcttcagctgtgtctaatctgatgtcaaatttatctaccgagttttacatttcatttgctgtgactttcgtttcttgattcaatttgcttcattttcaaatctactaggtaactttatagttcttcacatttatctacaagtttgtcttttatttctaaaaaacagtaaacatagttgttttataaactaggactaataatttaaatatctgaagacttcatatatctatttctgtttgctaatgatctagttctttcttggtgtcttgtttcctgatgtagctttttttgtgtgagctgcctattttctttggaaaactattatgagaacacatagaataaaagtacattccaacagaggtcttttgttgttattaatctgtcagttttctaggagcacctacaggtggaatagagtttgattacttcacatacactgcaaattcaaatgaggtgtttttcctcatcttttcgcttagtgccaccattcttaaggctatggtggatttaatctgagggatagctctctaaagttccaactgtatggagggacagtctatttgagccctcatcttgaacagcctctaggttatgtcttctggcccccttgctcatggaatttgctaagttgataaatatctttgaggctataatagctttagtactgtctttctttctctggattctcccttttcctgtattttggcctgatatttttccactattttgtcaattttatagtgcttttaagatattctttaagctttatatctcaaatttttagttgctttgacagagagagagagagagaaagagagagagaggagagagagagagagagaagggagcctacaatacttttggaattgaagctagcaggtatagtttttccttgcagatttatcctcacagttttctactactggcatcatggaagaatatgaggcaaatccattttcttaaatgctaggttttccttctctagtctttcactctctcttccaaatctatgcagaatataacagaaataatcccaaggttttcttttgacaattagttcacaatatgttcagtctctttacaaaaaatccattttgtgagaaaaaaatttcatcgacatttctgcctcacatatggtccacagaatttacaagtatataaaatccaggctattgtatctttgactttagccaaggagatacaactccaaaagagggtgagatcagctctaggcatctatttcttatgattatcttaatctgtaacacacacacacacacacacacactcaccaccactcccttagccctgggaaagaagatctctcctctctctctgtctctttctctctctctcaataacagcttataatggataatacaataggttgtatgtatctctgttgtctgctgtttctcctgtttatagttctaagtgactggcctgacccattggtgagagatcgtagtttaccaccatttttgctcaattaccctgtaaatagaagcatccatgtgatacagattctaatagaatactccacctgtagtttttatttgttagatcatgatgtattgtgggtagaaattgtgcactaaaacatgttttctttcctacactttaggcccaggaatagggatgttttcccagtgattattaacgtctatcttcttgagttgtggcaaaagtcagagttgataagcagtttaattttattctcatcaataacctgtgggtgatatgaggaagcaggagagatgttatcactagctaccaaactgctttaggcacttgtgataaactgacaaactcttgctgtttttctttagtggtatttattcttaagtttaatagaaagtcttttacttggctataactttaaagacaattttccccttcttacagaagaacttaattcttatatttatttaatgatgaaaattatcattttccccaatctttattcatttactgtgccgctgcctgaactccgcactcagaaaagcaagatgaagtcacttgttttatatttagggcgaatgcgtatgctgttcgttttccatctttaattgtgaagttgttattttttttagaaggtaggggaaaagggcctggcatgataatgaattgcataacctttgaaactagaggaaaataaggaattgtttcaatgtaattagagtatttcataggtctttttttttgagtgattcatgttgagcaataaaatacaaatatagctagaaagaaatgttagaaaacccaagttgataaccttcaagctcaattcatgttcttgtttgcttccagactttctttttaaatcactattgattcagaatttatttattctgagatgatgtgtgattatccaataattcatggctgttctatagcacaaattcactgctttgtcacactaatcaagaaaaatcagtttttcaaaagtgcatttcaaatgccccctaaacgtccattcttcagcactgcctataaaatcagtctgttaagaggcagcctgagtgctttatatattttttcttttgaggtgcttcttttagttgttacttctaaggttataactgaattgtttatgatttgtgttcatatagagcaaattatttcaaatgatgatgcaaactacttaaaaaacatcctagtgatttggaaaatgtttcttaaaacaggagatttgacattcttggtagaatataaggtgattcatcatctcttatttaggaagttactcagactgggaggaaaaacaaccatcataggtcatgataccactgtattgtttggtttgaaatcagtgctgaaggaatctcatttgcatttccattaatcatgccatgtccaatgtggggtcatgtttctgcctgagatgagttttgggaatgctcatcattttctgcatgaggcgttgtcatcattaggtgatgatgtagggtaccatgccctttctttcacccccaacaaatgtattcctctgtaatgcttcctgaattacctcatcctctctcacagctacagcctcagccaggcatctaccatcttatgtctgaaatacaacagccatttcctcattgattcatctgccttaactttcttatttcctctgcatcaaatatataaacacataacaattatgttgcttatttagaagactttgggggtggtgtaagtccttctccaactcctggtaatgtgcttaattcctctaactgctgtcatgtcttgttccctaggcatagctctttgttacagctaagtatgtgctgttgtctagctttcacacatgacacattctttcctctaagtatggttaaaatttctctccttctaaaagttattccataaccatcacacccagcttagtcactgaaatccttctagaattattggtattatttgtagccaacgtgtcaattcaacaagttggtttgtactgattctacactgatcgctttagttatgtgggtaatttacattttactgtttcccatattagttggtcccctctgaaggtagaaattgtttcccaactttttttccctccattatctatcattttatggatgaaaaaatggaaggttagaggggcaaaaagtaattctcccaagatcatactgcttatagatggtagaaataacattttataccagttaatttgatacccagtttttattcaccaatatgggatactttctcccttacttcctttgtcagcttctacttgccttgacattacaatcagatactgaattagtgttggtgataaggggagtaatttttcacatcggtgcacttctaggagtctattaacttcctttaatctaagttgaaatttatctaaagtgatttgctggtgactgccaagattgatcctttagttgtattttcataatctaaattaaatatataagatatcaaaattacattgacattcttttaaaacttatcttgtaaatatttactgaatgcctgctatgtgtacaacaggcactaatgtaggtaacaggaacagagaaataaccaagatctcatttctgccctagagaaactatgtagtaatccagtaggataaatagccatgtgtattagcttcctattgctgtggtaatgaattaccacacaattctaagtgtggcttagaaaaacacaaatttattatcttacgattctagatgttagaagtccaaaatacatctcaatgagctaaaatcaagggattagcaggatgtccaggggagatccattttcttactttttccaggttctagaagcttctgtattccttggctaatgactctcttacatctttaaagccagaaatagccagttgagtttttctaacattgcatctttccaaccttgtttctgttgtcacatttccttctttgactcatctgcctcccttttccctatagaagtacccttgtgatcacattgggctcacccagataaaccaggctaatctcaccatttcatggtccttaatttattcacatctgcaaaatccctttccttatattaggtaacatttacagggtccagggattaggatgtgaacatctttgggaggccattattctgtctaccacaacatgaaaacagataacctgtattatagtgtcctaagctcaacaatgcaaatggaagtactgtgtctcagagattaatggaattagctgctttggaatggaattctttgaaagttctcaggattcttctcctgtcaaagtgggtggaattcactttggcccactttggcacagtggccagtagaatgtctttgttcttgtccttcttgagaatcagtaggaagtttgtgaggggaagtgtaggcctcctttagccatcaccaagggaataaggaggagaaagtcacattgctcagagggaacagaatatgaatatgaaaaggggggaaccatacatagtacagaattgcataagatcaagttaaaagaggggcattataagaaataagactggtgagatgagccatatcgtaaaaagccatgtgtgttgggctaagaagtgggaacatcatcctgtaagaaatggctaagaacatgattccttattatttggtgggacttagaggaaaacagaaccctttctttgaatgaaatgacaggccctcttttatagacatactataaagcatgttttaaaaataaaacaaaacacgtacttaagtattcacatttctctgctggctattgttgtatattaaagtcttaattttgtactgctccatttttccatgttcactggaaagtaatctgacctgcttactcacagtaggtctcttttaagttctagaacatgtattcatcccacctgagttccttttttgctctctgaattaatattaggttctcagaaggagaatattcctgcaggaataaaatcaaatgttttggatttttactttttatagcttatcaatggtagttatattgtcattttctttgagaaacagattacttttaaagaaaagagtctttctaagcatcactggctgctttatcttgccatttgctttcaatggagccatgtgaaatctgcccctatgaattgaattagttacctgaactattttccttaatcttcatgaattatttctggtttggaaattgcattgtatggctgcaataccaactgttaaccaccacaacaaatgtgtagctgtcttttataaatgtttttcaatgattctaaatttactgttgcaagacaataaacttggtgatcagaaagtcaaatgacttaagaagcttataaaatattatataattttagggttttttgtctttaagtgagaaatatgaattgcattcaaggagctaagccacatgacagcgaaccactgtggcttttttcatttagctggcccttcagtctatttattccagagacgcaattagagtacgtgagggcccctataaaagcactgccctctattgatttgcaggatataaaaaatttgcatgacaatacaaattctgacagcacatgggggcagggtgaagtaatcactttccagctgtcattactatacagaatcagctcaatcttatcatctgactggttttggtgtattttcaactgaaaaataaagcagccagtatttacaatcagaaaatgtcagcttttcaggcagattcgacaatggcatttcatttacactgcaatccactttctcacttggtgaggtacaaatcacaggaagattggaagccagcctaaatacttttaagctggttttgcctacctttaatgtaaacagcaaataattacaaaatcaatagaagttgttaacccctttaaacctgtcttctccttactcatctgtgggattactttaaaatgaccagtgagtaacttactgctaaatggttcaacacaggctttgtttggagttggacagtctgccttccaatgccacctccgcctcttgttagctgagtgagctagggaaaattatctcacctttctgtaccccaacttcctcatttgtaaaatagaataataataatggcatattttattacattgaaatggcatgaatttttagaaacattaaatgacataataaatacactagggctattgcattgcagtgctcagagaagtacaattcacattgcgttctatgtggaattgtgcaagatggcagacctacatgtaaagaacttacggtagtccctggtacaaataagaataaattttatagagtttatgatctttcctttttcttgaaattatttgactttcttgaatgtctgtgtctcttcctaaaactctttcactggctcctcacatctaatggtagtgtctcccaaaactcatacacatcatgatgacctgcttttctcctcattttctccattaggttggtctgttaagtagaactagacataatgacagtgtgtaaactgggatgtacttattaaattgagactaaaatcaaatagattaatggttcccaaatctgtctgtgcatcagagtcagttagtgggtcatctaaaaatacagattctcaggcccattcctcagatctatggaattagaatatttgatatgggggattgttggaatcttgtacccctaaaagtttttgagctatttcagctattcagacagattagggaactgaaatctagaaccaggaatgatgcaaatattactgttcaacatcagagtgaaagattcaagtcaaagagcacagggtcagagcatgagcagaaaatgaagccagagctgagtgttaggagcctgtgaagcctgttcattcgtgacccgccctgtgccccacagcattctctatcacagctcttaccacacagtgttgaaatgatgtttccagcttatgttttctttccttccttttttccttccttccttccttcttctctctcgttccttctttctttttctttcttttctcttcctttccttcctttctctttcttttctttctctcatctgtcttgctctctcgcccaagctggagtacagtgccacaatctcagctcactgcaacgtccgcctcctgggttcaagggattctcatgcctcagcctttggaatagctaggactacaggtgtgcaccatcacgcccagctaatctgaggttttgccaggttacccaggctgctctggaactcctggcctcaagcagtccaccagccttggcttttcaaagtgctaggattataggtgtgagccacccatgtccggccctctcgagcttatatttcttattcaagtatgagattcataaaggcagacttagtctgaaaaattcctcttcatatcctcacaccagtgttcatggcaaggatccaaaaaatgttgttaaaataaatagttaaaatgtaagccaagagagaacgaattattaataggactctttggctcttttgttacatataaccaatttgaactagttaaaagtgagaaaagggaatgcagtttaagactataaggtatctcatgaaactcaacgctgggcttcaggtaggaactagaccacaagataaatgccattaggaccattgtctctgtttctctttgaacatttacttcaataacttctttctgaaagccagatttctctgcttctcttgtttgcgaggtttatattttgcagttccagtcttctactgagaataactcgttgtccattctaattctaaattcctgggattgagaatctgactggcccagcttggatccaatatctgaaccagatccagttggccatggccagaaaacaggcacaaagaagaaatgtcactactaaagacctactcctgtggattgggggacagagggatggtcagttctcagataaagtagacttaaacacttttaatattatctgttgcagtgaggcagattcagataagctgtccaaaaaagagaagcagacagtgtgctagagaacttggcactgaagtacaaatcaactgtctcaaacaggaaaattttatcttttattcaggaccagacctttttatagggacaaatccctagaggaacaggtgggagtgcttaggttgtaggggaagagtcaagaagtcggggattgcaaaatgcacacccttggccagcaatgactttacataatttgttactgggtctgcccacacagtacatgtagggagaaaaaagccattccatatgtactttcactgtttaaagaaaagggtaatatatcacaatcataatgcagtaaagtgacaagggcaccttcccagatggcatgaagtctgccagtagattgaaaaaactgcaataaaaatgtttttataatagaacattaatttttatgtaccatacagccaacatgatagagaccaacagtacctagtatttgaacttctcgaaggaaactctaatctactgagaggaatgggagagctgggataaggaggcatctcatattgaaatgtgcacctcacaagtcctcagcaacacttggtgatggaagatggtaaaattgttttgcagaccataaagtcttcaagttttgctaccctggatacaatctttaatgttggtactcagtatggtgggaggatacattcactgggtatatggaatatgttccttaaccactcttcccagtcctccttctaagctggagataggagaaagaattgacaactgtaaccaagacatacttatgtttcatcaaaccaaagtatgaattcatcactgcactgagcagtggactaaccaatatgtagatatttcttcattaatattttatattaatttatttgctggcttatatgcttaaaatgtctttgttttaaatgcaggtgatccaaggacatatgacccagatttcaaggggcctgttgccaacaggtaagcaattattttttggggaatatgcttttttaaacatacacagaaagctttgggggatgggggaggtactgttttccagtcagtggagaattgtgtctactgtgaggggaaaatgatatatttctgcctaaatgtcaccttatttacacagggaaagtacagagaataaatctttccatgagtcatgaatatcttctcccattagcaaatgaactgccttacattattaaactaagtgtttgtacttttcaaaaagagaagtgaaaaaaaatgctttatgagatttaaccactttgtagagaagcaaactcattcaagtagttgttttatgcacctgtttactctgggactcaccattgcaaatgcagagttgccatgccaacttcttccaagccaagtatttgtgctgctcagcttccaagatcagagtgctttctcagaggcagtcattcaccaatgcatcgtgtgcactttaagatagtttaaaatgctctagggaaatatgtactcatctcagctggtgcttcctgccctctccaaggttctgtgccattttaaaattagccagtaattcatagtcctcttattatttattttagcctctatttgcaagctttttgctaataacaaaggggattgtgaggtaaaatgtctacatatggagggaagactgtgcagttggtggctgttttttgcttaactttgatttctgtcagttgtatgtcataatgaaccgtgatgtgaactagcgatcagcatgctcatttgcacgtgccaaccatcagtatgtacgttagcatttactgttatgtccctgtaatagcccagctttaaagagacgtatattcagtttgttctaattttgtaaaaaaacaagtcatttgtttcaggttactcatttaaaggtatacttagaataaaggcaccttctttaaaatgagtccaaaacctctccattctctccatggtaacaccatgaatacattttgttgtctagtatacaaacagcctcattcagtgtagtggctacttttactatgattacatccattttacaataacttatttgtaagcattgaatgtagcctgttggcttcaagggaactttaggtataaatcagattcaacagtaataataattataataaataggctgacacatttagaaagaggaaatacagattacaggtgtgtctttctaggccatagataagagagcagaattatgcctggctggttttaggtgtagtaaaagaggtgagatctcctgtcttccattatgtagaatttaatgacggaaccgtgtagttcaggtaaagtctaaacgactgtgataatcactgtgaggaaagtaatttatttttacctggggccttttgtgatgcctccggcaccacaaagaccttcaaaggtgagctggtcattctgtgggcagaccttcctctgccttcaatccaagaatggaggaaagcattgtaaaaccagggaggcataaatacaggaagacatagttggcctatttgtaactttttcagacagcagggttctatactgtccttaccgggaaaataactggggtgtttaaggagcaaataagaagcccccaattctccacattgcctttagcagcaggactggctttaataacaccttgtgcttacatcatgaagctctcctgaaaaatcccaaatgttattggatattcagacagactcttacagcattctctgcttgtcagtccactatgttctgctttcttctctcagttcacaagggcagcattttgtgcctagtcaccacccaactgaatttgttttgagaaaaggcgaagggatgatggtcatgcataggagaggtgaactcagtgtctcatttgttcccatctaccaagaactgggtgtatgagagctattgtccaataaccaagagaagatgattttgatagtttaaggtgtttccccaggcccttttcacaaaatagatcttcaggccccaagatttctccctgatattcaacagaatcaaaaaatgattgattagtgaaaaagatattcagcattatccttggcattagacattggaattgaatacacatagaaaactaagaaatgaaagctctccgataagatgctacatgagaaattcatctcataatgtagacctaactaaattttatttgatggagaattggtatgctttcttctgttaggtaagaaccatgtaatccactgtttctcttcctgtactgccttgtaggaagcctactgataagcccacttatttttgaggaagagaacatctcatctttgtattattaccaactagcataattcttctgatagagtaaggggtactatacacatttatttaaggagtgaaggaaagaaaacaagaatgggaaggaagcagtgtgacatagaatccagggataaatacaaggatgaacttcaaaaggggctgagtaacggccatagcattattacacttgagacaaaacagtcagcatatgtaagtgaagcttcacttatgggtttaaacttcaggacttctaagtctatatttaaagttcttgctaagatgctatctgaaccctcaaccattttcagatgccaatggtgtgatattgggtttatattcctaaataagatactctgctaacaggaaagtagtagcagagttctctgcgctatttgcattactaggtctcatggaatacacctcatactatttttcaagtcaattagtttttataacatgtctacagggggcatgacactgcatatggtgtggatccaagtatgctgtgtcaagggaggtcaaagatttacaggtcctcatacaaaaagttcagcctattctgtttatctctctctttttatattaggtcaaagtcattaaaatgttgtatgaccatttgcttgacctgtgatccaagtctaggaaaataaagtccaaattgctacagttggcatcctgtaataaaggccacatattatcatctcgggttttagagatggagtttgtttccttttgttttaaatacgtaaactatcctgaaaaaaggatgcaattttaaataatgctgacattgtcaagcatagctgtgaaagaaataatcatattctggccgggcacggtggatcatgcctgtaatcccagaactttgggaggctgaggccggcagatcagttgaggccagaagttggaaaccagcctggccaacatggtgaaaccccgtctccactaaaaatatcaaaagtagccgggtgtggtggtgcgtgcctttaatctcacattcaggaggctgaggcaggagaatcgcttgaacccaggaggcagaggttgcagtgagttgagatcatgccactgcactccagcctgggtgacagagaaagactctgtctcaaaaaataataataataataaccatacattttacaaacagaacgctgtccaaggaataggtgctataaccagtggtatactaagaaaaaaatgaaaatctagacctcatcattaattactcacacaaatattgaatgcacacctctgtcctccaagggaaattacacaccagatgacaagaccccacaagcatatgaaaagctaaagagcaagcacaagtaacatgggctgtgcaccaaatgtgtggtccacagcaaaggctgctgcaggatttcagggaaggacgggcactctgaggctggtgtcagaggtgctgattcctgggcagggccacagagcaaagaagactactaatttatgggaggcacttttccaaacttaggaatttggaaaatagcactgttttctaagagttaaactagaaattaacacataattaaagcacagatgtagatagtcaccataatgagacctgtaaggcttctagtccagcaaggcttgatgatacatttattcaatctattaacatatctaaagagaagtacaaatgatgatcaaacaactctgtccatccaagaactctccagattagggcaccaagtcaaattgatgagaggatcctatgtaaggatcctgctctcttgaccacaggctagcagagatggatgccatcagatattctattcatgcaattccccttgttctgactccacactcatcaagcaaccttttgataattaggtttttcatgtagtttgcctacagggaggaatgaactggtcagggcaacatgaacatcagttcggctcagcagttaaatttctcaatgtaaattatttcattggcattctgattttagacatcagtctcttgtgagctttgtcagtgccagtcatcatccctgagttggagtaattctagggcatgacagaatcaatattcagaccctgcagaaatgtacataactggtttggctcagcagagagtttattcaagcatttagagaacgcagagtgagattgtttaggcagatatgttaggacaaaattatgtagggctttgaataccatgctaaagcatttggagctgattcttaggcagtgggaactcattggagaaattagtaccggtggactggtgtgacatgatcaaaactgttactcacaggtctgcaatgtacagctgtatgtagtggagctcatggcttaactgaagagtcagccaagcaagcaactaactacaacgtggtattataagtgcacagactactcttggagcaccaaggaagagtgcctgcaattcactccaggggtgatcagaggatatttttcagaagagagaattttccactagactttaatgttctttcaaaatgtcccctttatataggtgttttagttaaaagaaatatatcagtatttcaaaaagcctcagaaatatatttatatttctgactttctacttgatagttctacctggatgtgccatgggcatcctaaactcaacattttagagcctaaactcatgagctcctttgccctttatacccttcttgctccttctcatggtgtttcctcccttggtgaatgtaactacaatcaaactagttgttaaacacaatagtgctagattcttgcttctaccctgaatatataatagtcctaaaaccttgcagattttgtcttctttttacctcttagaactctgctttcccaggacaactgcctgagttgaggctttaataatctcttagctgagttactgaaatcgtcttttaaatgctgtcttgctttccttctaaccaactctgtcctgccagaattctgtctttttcaggattgagtccatccttaattttgaggccaagatgatagtttatttatgcattcagcaaatatgcattatataccagagacttttctcagctcagaagacacactgatgaacaaaacagacaagcttctggcttctcatagacctgagattctagataggacatcaattatataaagcaaagaaatgaataaagctactttcaatagtgataaatactgtaacataaatacaatcaaatgatatggttgagagtgaatggggaactgggctgttgttaagggctcttgggcagatggcaggtaagagttggatgacaagagggagccagccatgcaaagatctagggtcaaagcattcaggcagaagataacaaatgcaaagtccctgagatggacacaagtttagaatgtttgaggaatggaaagaactcaagtgtgactacaatgaaaggataagtgttctcaggctctcatactttgatgtgtactattggctcttcttggaatgtcttcaagtatgagtgcaagggtcacctctgctttgaattttttctacattcttcttactcctatcagtactagacacactctcctttttccagagccctcatcaataactattaatttcactgatcacattaatctctttattatctgcctctcctactgaacttcaaactttgttggggagaaactttctttagtttgtctttgtgtttctagcacatagcacagtgcctggcacatagaaagcatagttaattaatactttttaaaaaatctcttgatttaaaggtgcctacagagtttttaggttatttgcgtaattatcaggaataacttgtagacggtgacattttaaagtgcaaaaaaaaaaaaaatagaaaaaagaacaagctcatatattgaggaataaaagaggccacaaatattaaagatgagtgttaacctatatctttctgtggaaaagagtcacgctaataaataattaatcacattaggccatttgctccattccgaatgaagaatgtaaatgccagatttagagcacatcttcaattcacatttgcattctgaagaattagccatttggggcaattatttacttttatttctcttcatttccttctacatttgagactttataaaaaagttttcaaaggaagtgctatggacataggttttttattccaaactattttacaaatcaaaatggtttgtaacctcttgcagacatttttacaacacaggacctactttttttttaaattttgtgttctttttttctataggttttcaatcataattttctatgataatgagccccaccttcgtatatttaagtctcctatacaattagaaaaagcataccaattaattcaacaagaagcaaatatgagaacggcatacatttagaagacagcacagtgttgtcacaatgatttgagatgtctacttgataacaacactttagaatttataagaatgtgtggtgtgtgtccacatagtgcattatatgctatcactaaggtctaaagctgaactttttattttgtgatttggcatcaagagttgaatcacagagtcagtgaatctcaggattggaaaggactttgaggtcacttaatccaacttctttatatgaatgaaccccttcttcaacatccctaataagtggctcttcattctttccttgaatcttttcatgatagtgaacttaccacccctccaatgcttcaggtaaactaaatgattttactaaatttcagacagattttccaccttctataataatagttattttcagtattgtgacacctaccaatttgtttagtatactcttttgtgtataaagaaaaaaaggacaactatagaacattcaagctttcatttctatttacttatatacctatatgcctctttctagaaaggatcttaagtgaaatgacttaaaacatctggatgcattagaattattaaaatgaaaatagaaattcaaagtccctaaagaaatttttgactcaagactaatacagtagctgatattgaaattaaatttatcagtgggcttcctacatgtcaatataaaaagaaaaacatagtggattatacagttctttttactggaagaaaatataccaattattcagtatataaggatttttcttagttttaaattacaagaggcatttttcatagagcatcttttatgtgcattcatgggcatctattacatgccccatgtcttctaggcactagagatactgtgatgagcaatatagataaggtggctgtcttcttggaagagggaagaaatagggcagaaaacatctgagaaatgaacataagtaagaggaagagagtaaaacagagtgatgtaacagggcctttgtaggggaggggaagtgttaatttagatttggtgatgaaggaagatctctttatggaggtgacaattgaaatgagacttgaatgataagaggagtaagtcaggcagagtctgaggatataacatgttagatagaggaggcaaaatgaagagtccctaaggcaggaatacacttagtgcagggagcagagaggcccgtgtgagtgcagcaaggtggatgggagcgggacttaggtagtgggtgggtaggagatgctctgcaagctaagcatgtttacagtgagtgcagtggaaaagtcatgtgagggttttagtaacagagtgagctaatctgtttttaaaactcatcctgactgctctgtggagaatttaagtgtccaaaatcagaagcaaggagattcacaggaagcttttgcagttgtataagtgaaggagtcagtcacttcgaagagggtagtgatagtggaaatagagagacttgtatagactcaagatatgctttggtggtagagggagcagcacttactgatgggattggatgtgaaaagcaagagaaaaaatgagtcaagagtaattgttagatttgtgacttgaactaccaggaggatgatgctcccctatagtacagatgaaaagattagagaggttaagacttctgttttgcctgtgttaaatttgagatactaaatagatatcagcctgtgaatgccatgcgtgagtctggagctcagtgaagaataaaatgagggctggtgatcaagaattgggagttgtctgcctacagataagacttaaagctgagcttctggatgagaacacttaggaggatggaggagaggcccaagaacaacactccagactcaaaagcatttggagatcaagcagaggtggaagaatcagtacaggacatggaagaacacccagtgagttggagaaaaggcaggagaatcagatgttgtagaagccaaaaaaaaaaaaaaaaagagagaaagttttacaagaagagtttgggtttttgttctgttgtggtttttaaagtggcccagtatgttgattaccttgagaggtcaaacaagataaaaattgagaaatgatcattggatttggcagtatgagtcattagtgacttcatcaagagcaagctcagcagcagtggccactaaagtgtgactaagaagagttcattagagattgtgaggtgaatctagtagagatggctaccagaggcaataaagacaacactttcagtaagttttcctggaggatgagaggaatctggggccaaagaagagctttctgaagatgggagacactagaacatggtggtgtgtggtgctagacattatctagaaggccactgatgacacaagataaagaagaaattatggagacaaagtcctaaagacagagtccagaacacaattggagagtcttgcctacaatggaagcagggactttgaaccatagttgcaagatagtaagcaaggaatatgttacagatgttggagtgtcaatagttttggtaatgaaaagaagaggtagtcttgctggttgcttttattttctcaataaattatgaggtaaggccatcacgggggtggtggcagtggtgatggtggggtggcagtggtggtggtggaaggcccagggctggagtgttgagtgttggagagggcagagaaaatatgcagcacacattttgggaatggggaagtgaagcctcatatattattaatctagaatatatatatatgcatatacgtatatatatgcatatatacgtatatatatgcatatacgtatatgcatgtgtgtgtgtgtgtgtgtgtgtgtgtgtgtgtgtatatatatatatttcatttgccacacagaatattattctagcgtaggaaagacttaagggaacataaaaattggtacttaaaagtgatgaagaacaatgatttgtgggcatatattagatacctaaattacatgaaccaggagatcttgaggtgactgaagctgggtgacagtaccctggaatgcttcacgtagtaggagaatcttcggcagtattttgaaggaaggatcatattggcaaaggaggtagatattatctcttgcaatggcttaaaaataggagtaggcatgtaccatacaaagtagatttgcttggctagaccaaaaactagagcctaaataaaacatatggctgaaaagtgaaggggcctcggcatatgtgtaaaatatcagagatgaaatattggcggaatttcatttcagtttttatggaaaaggaaaaaagaggttaaggaggattccagattgtgcattagtttattccttcattctagtggagtatgcagaattgaataagacacagactatgctcccaataaacttaaaatttcaaccactaatgttaatacatttaaaaatgaatgacttgctaaatagaagtataagcataactcggggaacagagtaaaatgaataattattattgactaaaaaaaaaaaatcaagaaatgtttcttggaggtatcattgagttagaccctggaggaggagaatgatttaacagatacacaagaatggaaaagagaattggattcatggaggtatgtgttgcagattgggttcttggggtcagatgctgagatgtagtctgcggtgcaggctcttttctagtgatcagcgtctgtgaaaagaagggaaaggaagcaagagggaggaagttttcaaactgctaggtccaacaaagcctcagctatccagcagggaggagtctagagtaactctgaaatgaccacatctttatttacttatttttaactcttcctttaggttcaagggtacatgcgaaggttgttatatagataaactgtgtgatacaggggtttgctgtacagattatttcatcgcccaggtaataagaatagtatccaataggtagttttttgatcctctttctcctcacaccctccattttcaagtggctctgaggctctggcagatattgtctggagacaggaggctgtctgcataccacactcctcactgctgggcagccagtctttccttaaaaggaaaccagggtggagctttttcatgcggatcacagcacgtgagcatagtatatcccattgtaccccagaggggctgaacagagactaggatggaagacactttggcaacgaagctgaatagatcatgtgggattgtagagaggtttgaaagccatgatgaggatttgagactattttttcccagggagctttgttagggaattaaggagggccatatgatcatctaataccctgctttcaggagataatgccagagagtgaacctgcagcaccagaagctcttagaagtcgtagttgccatagaacacagctgcctaatgaattggcagctgggggcataggggaggtagcccatacatggtgtccagtttctttttctatctcctattcttagataacagtatcttgatatttcattcaacccaaattcacctgacccttcacctttcctgtggttacaactaaaatgtttgtaactgacccatatctcctctttttagagaaactaatattatctgtcttaccgtattcctgtgtcagaccaacatacctgtgtcagaagaatatattagctatatttttcaaatattgttctgcccaggctgtcttgctgctaaatggatttgtttttatttgctctcaatcaatctatatatttaagtgtacattcttttggcaagagagtgggaaaatagattatttttctattaaaaaattaaaggcagtttgtgctcagatggacagaagaccagtgggtaggcttggttgggaagccagcagggatggaaagcagctggtagtttctgtggactggggccctggggcgtggcaccacctaccatgtaaccagcctggagatggtgaactaggaccctagggacgatcctagtagcagcatcgcattatgggatttctcagtccttcagaaactaacagtgtggagccaggttaccagatctaaatagtagtgcagagaacctgggcaaagaaagagcttatcaggaggcataaaggcaaagactggaagagtcctctttacgcactaacatgcctttcttaatgtaatgactatgcaggatttccataccaaggtcattttctagttagacctgtgaggaagaattaatggggaaatatattaaattttatctgggtattggtatttaatttagatctttttctactcacatattagttttgtaatgattattttgttgggttggttaaataagggattaggatataaatagtgtatgcacctgtcagctaagcgttacttgagatgcctctctattttggtaatcgaagccatcactccagcatgattctttacttggtatgagcttacccaaatttcctatatagtgtctagaagaaaaggaatagcttttcactgctagccttataaacccaaattgtaaaagtgaggacaaacctcacagctgcatattttttaagtctaaacatgataaaattagatttaaacttcccaacacatatcatattgtcatttagatttcagttgcttgttgaactgtattcaggatattgtgtttcatgatttaccagcatagacatcagtttacattctctggacttttgaattcagatcacactgtgagtttatttctgattgaagtctccttctatttatttactgaatgtcttcaggaaacaatttcttcatgttggcaaagttgtgttcctcataatcattactaatctcatgtttttggtaatttgttgtttattcatcataggatgcttactatcagacagtaaaaaaaaaaaaataaagcttagaaacaatggtgaaaactgaaggaaaatatcattaactcaaagtttaaagtaaaaaagttcataccatagttgatttacatgtaccttatttcttaatgttttcttcctgaaaatgctccattgtaatatgtattagcattttatagtttccttttctgtagataggcgagtttatcccttacaataggtggagaaaattctgttcttctacagttttgcatttgatatcacttgttttttaagattttggagctaaagttgcaaccatacaagccatcttctccatatggattatccataatttaattttctactgttcaataaaagaggaaatgaaactccatctctttctggaagaggtttgatttcctatcccactgccatcaacttcctccccaaaatgtttgtacataatacaatgcttgtacataatataagtgctgaatttatgaatttgttaaacactcttggttttcctaaactaggttattataatgttggtgtgctgtttattgattctaactccaggttagtagaccatgtctacttccttaaccttatataccacctatatcatttgcaatacaattggggggttaaaactagctcatacaaccttggagagctgttaattactaaactgtgattggaagagcaaaataggactttcagtcatagaagagacagcccagttatattttaaagataagatttaatgtaggagaaagctttagaactgagccttgaaaggtgggcaagatgagtattttgcaggaaaaggacaaagtattccaaatgagaaaaaaaaaaaaagcagtaagaatagaagcaaggtgtcttaattcagaatatggaatactttcctgagcagtgtttcatctctggcaggttttatgtatatatacatatatatgaaatacataatattttatatgtatataaaatattatacacacacacacacacacacacacacacacggagagagagagcacatcactatctgaaaatttaaaataaaaaatgcttcaaaatctgaaactttttgagcactgacatgacatcacaagtagaaaattgtactcctgacctcatgtgatggttacatttattatttaaaatatgtataaaattatcttcaggctatatgtataaggtgtatatgaaacataaatgaatttcatgtttggacttcggttgcacccccaaaatatctcattatgtacattgcaaatattcccaaatctgaaatttgaaacacttgtggtctcaagcattttggataagggatactctacacacacacacacacacacgcatgcatgcacacgaccctcagtggatgcttgaaacatatgctatgcattttcctatacatacatacctatgatgaagtttgatttataaattaagcacaagaagaggttaacaacagtaactaataataaaatacaacaattataacaatgtactgtaaaaaaagttactggaatctctctctctcattgtctctcaaaataccttattatactgtacttgccaattttctaactacagttgacccagagtaactgaaaccttggaaagcgaaactgtggataaggcaagactactgtatactgtatatatgtatatataaaaatctcccttttttcatataaataataacatgctataattgtgtttttttaacctaacaatatttctgggaaattaatccatcagtacctatagggcaacaataggtgtttaaagaaaggtcttgagaaaaataaatgtatcagattcttaaaattttattgttattcatacaagttgaaaaatggtgtcctcagtgccctcttctgtcttttactcacatgtgaaggtcaagtccacatgttccctcttcaactcagcctcagttactccatggcagaatcagttcccctcttgtctgtgctcttcgagtgctttatgcattatacactccatttattaccctggttgtgttgagaattttttgtttacttgtttgtgtatttttatccatgagtagattgtgagttccttaaagcttttgtttctagatcctcatcccctagtacaagacctggtatataataaatgctcactaaatatttgcttgattaaaaaatagtgagagcactttaactttcattgttcattgggtctatatttcttttccttgttgttgttattctttggtatttgacttgcgatatttatcttctcagtaaaaacatttttaaaaccatggagcagataaaaattatgggttaaaaataaaacaaatgtcacctggaaatattgacacaatgcactttttagaaaattttgtgagaaaaaatagatgatcctcttcattttatgctacaaattcctgaggaagggctgatgtggccacaataaacttgcagccttcagactggagcaattgcccataaatgtgtttgtacatacacttcttgaacctacctcatgatgtacgcatgcacttgtgtaatactcacaaaaatgcttcatgtcattacttcaaatatttttatgtttagcttagtcaagcacagattgctttaatagcatcatggattttgttgctatgatataagaccatagtgctatattttcatttctctatgctttgctcatttatatcatcctcctttgcttgcaatacttaatagaactttcagtttaaatgcaaatagttgaaagaattatttcttatttgttcctgttatggtggatctggcttaaccatccttacccagagcatgagcatttttcttcactttgctttgaagatcatttaagctcatctctaaactgcctcattatgtctttcagaaatacagttctcatataacaactaatcaggaaattcaaagtgtttgaagtatgttgggaaaaacagatgtttgctatttaaagtactgcagatgattgttatttctttttctagtcaaaagacgttcatatccactaaataaatgtattgtctttaagtgtgcatccttctgtgtcacagtggtgggaaatcttcacggctagagttagaaatgaaaatgttctgcttaactattcattgtgcacagtagggaagctggggttagaaaaacatcagtaaattttactcttcttagcctaacatgaaaagtaggtaatggaaatggcagttgttggttgctttgaaatactagtatgctgaatgagctcaatagccattttttaacccaaaataagcttagttgattctttaaaaagactttagagataaactttagagataaacatagatgttaacatgttaagcaactgagctgtaaagccaaaacctaaggtagcagaagtagaaataggaagaattagcgaaacatatttaattactcattacattcaaccatagaatttaaaagaattagtatcatttaatacttttgttgaaatagaattataataatgattcatttactttgcaaagaataggaacacttttacactgttggtgggactgtaaactagttcaaccattgtggaagccattgtggaagtcagtgtggcgattcctcagggatctagaactggtaataccatttgacccagccatcccattactgggtatatacccaaaggactataaatcatgctgctataaagacacatgcacacgtatgtttattgcggcattactcacaatagcaaagacttggaaccaacccaaatgtccaacaatgatagactggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggcgggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaagaacattagagtttatttggttcagtctcctattttcggatgagaaacagagtgctaaaaacatgaaaaagcttagtcacaattacctggtgacttggtggcaaagacaaggttggaatccaggtctaggttatgagtgtagagttctttctcctgtatttctccaaaatcattttcaagtacatctgtccgtgcagtgttttgtttgtttgtttgtttgtttgtttttgctgagtgaggaagcaagctgagagtgaaaggaaatccgtatctatcccatgggtggaggaaaaggataatggaagttgagactggttctaaatccaagatttgcctcaaaattatgtcaaatgtctaatgtcctctggttgctgagtacttctggagtcctaagaatgtctcctaaattactgagttttctctcaattcctttatctagaagagttaattaatatttgggggaagacacaccagcatataatgatcaccgtgctaatttgaaatcattacagaccatcagatgaaatgagattttttttttttaaaaagagggagcaaataataaggatgtattggttacttttggctgtagcaatattggatgtcattgtaaaccatgctctttttttgagatggagtctcgctctgttgcccagactgcagtacaggggcacaatctcagctcactgcaacctccaccttctgggttcaagccattctcctgcctcaacctccagagtagctgggactacaggcatgtgccaccacaccaggctaatttttatatttttttgtagagatggagttttgccattttggccaggctggtctcaaactcctgacctcaagtaatcctgcctcagcctcccgaagtgctggaattccagacgtgagccaccacacctggcctgtaaacaatccttttaaagatcaatttttaaagcaatgcaagaagtagttacattgtggagataacaaatgggaagtttggaattgaatttcccatggaagttcatcaatggattcaaaaaagtttgcatctcagacaatttagaattgaaactgacatactctgaacaattggactaagaaacctagtaatgacaaagacatgggtgttaaagatgaatcaaatattttttggtgaaatttaaaaggaaaaagtcgctaatactaaattatcatttatataaagcatgatttttaaaatacatgtggaaataaacttataaatcaggcactatgaatggattgttgaatattttatctgcttcattatattttgatgaatctctgctataaactgaatgtttgtgtcccccaaaatatacgtgttgaaaccccaatcctcagtgtgatggtgcttggaggtaaaggcctttgggatgtgattaaatcacaagggtggtgacctcaggaatgggattagtgcccttgtaagaagagacaatagggatgatctctctctctctctctctctctctctctctgccatataacaatacagcaagaaggcattcatctagaaatcaggaagagggccctcataaggaaccagattggctggcaccttgatctttgatttccaagcctccagcactgtgataaataaatttctgttgtttaagccattcagtctgtggtgtttgttaatagcagcctgagctaagagaaataaattggtactgagaagtggattgctgctataataaatacctaaaaatgtggaagcagctttggaactgacaaaatgccaataaatataggcaagtaacctttctctcataaaattagagacctgtagttatatatagacaaagatttctgagcaacaaatgctttctctaatgtcataaagttataaataaacatcttaatattatgatactaaagtgtaatttgcattttctcctacatatttataataaatatattcatattgctcgggaattttttttgccttactgtagcaattcaacaatgataaataagcacacttgcttagagtcctggcatgattttctgaaacacggtcatgtatcagtagcttatttgtgctgcttcaaccttttaccagaaggctcttaagggctttatgaattaaatctttcagtgcatttgaaaagcttgcttggtaattggacaggaagggaacctcaggtacaaagttatctaaccaaaactatgatttaggtcacgtacctctttaatgttaagcagttaggaggacatacatataattaaatgatccttattatttgacaaatatatgtcattcaaaataatcctcccattaaggaaaggtagcaaccattaatattcaaccctttggactataacttaatgacaaacttatatccttaggcatatagaatgaacttgacctcccttaacttacaaggcacaatatgtatatatctttggttttttcttttcgttatgctaagccttttagagtacaatacataggcatttggtttttttgcaaataaatggtgtgttgtatttaaacatctatcacatagctctaatatttgctacagggcaaattaattataaaatccccctttcaaaatattttttatttctaggatttctatgatcaacttccttatcttttgttgttcatttttcctttcataaatttctttgattgcttttatggattttcttttttgcctagtcagatatagtttgataccattctctattattttttcaaagatctggttttctttgaggcagctggtaggtagcttttactaaatttaaatgtacgcttctgtgtaaaccatattacactataagcttagacgtcctacattcttgacttcccagaatatttgaattatgtataataaacacatttttatgtttttgagtaattatctcttctttaggctaggaaggtctgtaagatttgaaaaggatcagagtgaagatggtgcagagtaggagactggggaagtagagaacagattttccaattcacgtacaaaagccaagcatttaacaaacttaggaaaatgaaataagaatatttcacagcattttcaacagttaggtattttatcctctgtttcctttacttaagtctatttttttcctcttctaggatacatttttattttatctgttatattttgaaagccttctgctgagctactcatgatatatgatcattatacattctattccctgtgatccatgctaagacaatccaaactataacccttcattatagttaaacacacatatttttgtctgttctcctcgccagaatgatgatagtagaaaggcagaaatgccgtcatagtcttgcctcttgtggggtttacagaatatagttcaggagaaaaaaaggcagaacttgggtcttggacttaagatctttttctttcactgtctttagaacaactgataatgatataaatatatctataataaaaacattttaataaagttaagaattgttcacctttcagtatcacttctgggaataaacagattgagagctatctattattgaggtccatgctgcaaataaaatcaaacttcaaaagttttataacaaattcaacctattatcctgggattatgtttataaatttttctaccatctgaattgatatggcatctacaacaaatgctatttcctgtaagctagtcatatattcagagagaatgtttttgcccagggattgggggtagggaaaggaaggaaagattgtacttttcttttgtacaaatattaatgtatcgcaaagcacacaaaagtctttacagaatcatatggagctaaataaaaatcaacataatgtactgtttaccagcttgtcatctaaatgtcagcatagctagatttttattggggccttattatttaatagtcttgatgtgctttggagaactaagcacatatctctgaagatttacatatttgcagatccagaaaggccttgaaaatatgagctggggagatgtgcgttggcagggggggttgggagtgatatttgaactgcatatttgaaatgaagaatgctagattaactttaaatactggtgttgaaggacaggaagcagggctttgcccttcattttattctggtgctcagttctccatagaagacagctgccaaaagtaccaaagagaccacagaacaaggcagccacaaagagttgtgctggcaaaaatgaagcttagagtagattattcaagagctatccaagggtaatgcttccacattgaaagccagaggacaatgtaagttaacctggcttatgtgtcattcttttgcctcttctgagattttgtttatcccaagattcaaggacatgaatcctcaagttcctatatgaacttgtcatagaactgcatttttatctgacttactgatctgtgcttttgcataaaataaagcagatcatctggcttaaaattaaaaatatactaacaaaagtaaaatacttaatatttcacttttatctatacatctatacagcagatttctttctttctttctttctttctttctttctttctttctttctttctttctttctttctttcaagagatgggattttgcccaggctggagtgcaatggcacaatcatcactcactgtagcctcgaacgcttcaactcaagcaatcctcccacctcagcctcccaagtagctaggactacaggtgtgcgtgaccctgtgtgactaatgtttttatttgtgtagagacgaaggtctcactgtgttgcccagactgattttgaaactatggcctcaagtgatcctcccaccttggcctcccaagttgctggaattacaggcatgagccactgagctcagccctatagagcagatttaaatgaccaacttcaactgtatcttttaaaagaggtttactgtatgcaagagggatggcacacccaaatgagagtaggttctattctgactacactaggagaaatgctacttacctggtgtaatggactgaaggtttgtgtcccccagaatttgtatgttggagccttaatccccaaggtgatcgtatttggaggtggggcctttggaggtacttaggtttagagaaggccataagggtgggtcctactgatgggattagtgaccttataagaagaaaccagagagctagtgctctttctctgtgatgtgaggatggagcaagaaggaagcagctgtaaatcagaaaagaagcccctcaccagaacctgaccatgcaggcacactgatctcagacttcacagcccccagaactgtcagaaacaaatggctgttatttaaaccaactagcctatggtattttgttatagcagcctgagttggttaagacatctaggatgttcactctgcccacccaccagaatagtgcttttaaattgtgtatctttcttaagaacctgtctttaattgtgtgtgaaagggatttcatgaaaccacaaaaacattgagaataagcgactgaacccaactaaggaatttgctacatttaattttctaactaatttttatctattccagcaaccagtaatatgtaggaatcagaacactatgtctctggcattaaaaattcctattcccttctcactcatgtgtggggaaactggctgaggcagagcctcggtcctggtttaagtccttcttaagtctaagtccggctgtggccctgatgctgcgtctttcactgacctgctgtgatcttgcacctcttgtctgcacctagatcagtccatgttaaatgacactttcctggtatcagagatgattgaaagattggaacatacatagtctcttggtttaaaatcgtacttttaaaatatgcaatatcctaagtgctcacttgaagttttctacaaacttcatctcttctatttctattgttcttgggattttccttttgaaaagaattttggttcaaatgttatcaaaaacaatctgatattgcctagaaatgatttgccctctgattgctgcctaatcttgtttgctgccttctgggattttgctggctcaaccttacacatttgcattcatgtgggttatatatgcacatcaagacttactgtggccatgtgccctggtagtgaataagcatttctttcatagccatattaaatccatctggtaagaacaaatacattacccagtaagaagcaaagggagaaggtgatataaaatgagaaaagaagcattgtaaaatatgttaaatcagaatactaaccctccttctacttttaaccaaaaattttaccagctcctttgtataacaaattcgaaagaagtccattcatttatctaacaaatatttattaactactgattatagaagtaaagatatagagttaattaagttccaagttctaccctgaagtttcccgtattcaaatgatagagacaagtaggtacaaataattagaacacagtgttatgccagaggtaagggagcatcaaagagggaactgctctttaacctagtgtggcaaatgattgcttcacagaggtggtaacatttaagctggcttcacagaggtggtaacatttaagctgggtgttgatgatgttttaacaagttttaagggtgagagagctttcaaggcagatagccattattagttgagccatatgaaattgccatttttaaatgtcaaaaacaggtaaaatacatcaaatgcatatggttcatcaagataaaaagccactaagattttgggaatgcaaaggttgtatgtgagagtggacggaagataaaaagtaattttgagcagcttagcaagggccagactaagaaatctggattttattttgtaagcaattgaaagtctcaaaatgttttgactagtggatttatatgtcaagttatgtattgtataaaatgtggattaggggccaaaaagggcaagacgctgtctggaggctgtgctatcactccagatataagagatgatgaggcttcaacctagaaagtagcaatgagattggagggaaagaaacagaacattgtaggatggagaatcagcagggcttgtcagacaactaaatgtggaggataagagagaagagtcaagaatggcagaatttttagcttggatgaaagagtgagcggcgggcagagatagttaaggagaagagagaaaatctgggacctcacagagaagtagtaagttcgatttggaacatttgaaaatttaaaagtaagctggcactcaggagaaaggttagggttattatcatggctaaagtcttggaaactatggtatagatgagattactttagattaacagatagaattagaagatcatgagaaagccctgaggtttaggcaaacattaagacacaggtagagacagaacagtccacaaggaagattgaggaggagcagaagagatgaaagacagtgcatgtgagagggtttttctagaagaccagacgggatgattacaaggatggagtgctaataattatgatttcctgggaaattcatgtttgggggcatactaaaattataccatatattgtggtgttctgcctagtaaaattaaccaatattaaatattattgggataatttagaccttagaggttagaaaaccaaagactttatagactggtgcaaacttatttgtgccctaaagctttttatttttaagcttttgtatatagatgtataaataatgatggtaataatttataatccaatccatgtcaaagtttcagttttctgtttccctttcttctttttaaaacacacataaatggacatatactcctaactcaactttttctatgaggagttctacgtgctttacaaatactgcataaataatcctgcagctctgttgtggatagaaacaattgctttgtggtggtaagtggggagttgagagacttgccaggtgttaattgtagatagaatctaaattcccagattgtgattctcaaggcaaatctttgccttaaggctcaagcccagataagagactgtattctagtatattcttcctttctctttgcagcatgatgagacagaatgactaaaatctgcagttcaactacctaaaattaatactttattcttctaggaaaactcttagtgaacactaactaaaacaaagcaatcatattaatttgctgcccaaatttaaaatcaaatttgatagatctaaattctgaaaagcattgagctcaataaaagtgatgatcaagaatcagggatggttcagagttatttgatgctgatctcctgagaatagagcctaggagtcccagttaccattctaaatacttgcattacttaaggtaaattgaaattctttatgtgctgggcatatttcactatggccttcttaagtctttaagttgtatctcacctattgttattgccactactgcaaccctagcatcaatgaaagtctaaagatagactgcttctccacacactttggcacatttttccagtaactgaaagatgaagcaaatgtgaaagtctgcaagtcttggagcttttaataataaaacatagatttcacatgctttttacatcaaaatatgaaagatgatgctggcgtgttttttattgtccatgcaagatagcattggattacaggtcgttctgttaccgtaccgggaccaggctgcacagacactgagttgaggtaaattctctaagtctagtaaagggggagacaaagagatgcatgagtctgttaagtggctttttggtagctgacaaacagttgttgtattagaaaggaataaactgtaaatgtttaaaggaggagaacaataaagaccaacgtctttaaacttttctctagtgtatctgactgttaggattatttaaactataaagtaaaaatagagaaattaaatacatttaagggaaattaatatcatcattcaccttattatctgctttctcatgcacataagctactacttttacactaggatatgtatctgcttttatattttctccagattcaaacagatgttagcaagcttccttcactgtacaacttttattttcctttccatataaccacaaatagttttctgcatttttcttgatcttgtttttctgatttattctcttttgcctttttctttctcaatctttaataacttcggattttcatcaggagccctactgcttcctctcattttctttcttctttaaatcccttttcagcttatttctatcttggttttgtcttgcttctagatgtcacttttatcctctttccctccttgcttttactctgtctttgctcccttaaatacagttgacaagacctagaaacaacacagttcagtaagttgtcatgtgtattgttcataatggacagtccacatccaggagcagtcaaggccagctcttttttgatcctcagggactaaagccaacaatacagcaacaaccccttatgtccattacagaaaagacagatgccagctaactacattcacagcagaaaactgaaaaatatgatctttgatctccaagaacttagagaaaatatgcttttatcaagttgatgtaataaaaaagtgaaatagtttactttgaaaactgtcagagagacaaatataggatctggtgctgaaatgatccataaccatcgtttcttccctctgtgttaaaaaccgttagagagaaatccattcatatccatttcaacccatgaggcatctttttggagctgaaaactctcccatgctctgacatttattttcacagtattcctggtacccgggaaaacagacatgtgtgggaggctgatgatgaagatgaaacagaactggccctggtttcattctcttctgtgttgctaccacaccgcattcaccacacacttcatcccaattcattctgcatcctggtcaagataaatctaactgagatagaacttttgttttattactccccctattcaagaacttccaatagaaaatgaactgaaattgtaatcaggagtgacttaatttgtaaagtgatgtattaataacagctctcatatcaactttacaacttgtaatcatccaaatgagatagtatatttcaaggtgagtcatgaactgtcaagtcctttaacatatgaaatgttgcgagtgaactcccctgacagaaaagtccacgctcctccacactgagggctattcagtcacttaattgtaccaaccacctgttgtgctgttgccctagcatgttttgtgctgctatatatataataatgaatagattatacatattattatatattaatatataatagaatagaaatttgtttggcacatagttctggagtgtgggaagtccaagatcgaggggctacatcaaaacatgacagaaggcatcacatatgccacagaagaaggacaggaaagaaccaaactcgcttctgtaacaccccccatccccgccccagatatagaactcactcctgagactccattcatcagggcagaaactaatcacctctcaaagatctcacctctcagaactgttgcattggagattaagtttccaacacatgaaccttgggggacacattcaaactatagcagctgctctatccctttctcccctgttgcatccacactggctgtattagtctgttctcatgctattaataaagacatacccgagactggggaattatgaaggaaagaggtttaattgactccgttccacatagctggggaggcttcacaatcatggtggaaggcaaggaggagtaagtcacatcttacatggtggcagggaagaaagagaatgagagccaagtgaaaggggtttccccttataaaaccatcagatctcatgagacttactcattaccatgaggacagtatgggggaaactgcccccatgattcaactatctcccaccagcccccctcatcaacatgtgggaattgtgggaactacaattcaagatgaagtttgggttggggacacagccaaaccatatcactggctatctgtcagctcccaggacataccctggtctcacctgccctcagggcctttgcatttgctgtttcttctgcctgaaatacaagtcctacaaccacttcagagaccccttccttatgaaccctctatatgcaggccatccttaatattttccctcatagaatcatgtttttttccctagcagttacacaatctgtcatcattttattgattgatcgttacttatttattatctgttccccagactaaactgggaactccgtgagagaaagcatctcatctgtgtggttcaccaacgtttcatagcatctgccacagtatccggcacaaaataggtacctcattaatcatgaaattagagtctttgaaggccatatttcagaatggcagaaaagaggatattagtaggagctggtacctgttatgtaagttgaattgtagtgctttgttgtaagagaactgagaccactctggacaaaattaagtatagattgcctaatgactcattcccaacattaagatgctattttgagggctggatgcggtggctcacgcctgtaatcccagcactttgggaggccaagcccagcagatcacctgaagtcaggagttcgagaccagcgtggccaacatggtgaaaccccgtctctactaaaaatacaaaaattagccaggtgtggtggtgagtgcctgtaatcccagctactcgggaggctgaggcaggagaatcgcttgaacctgggaaacggaggttgcagtgagccgagatcgtgccaatgcactccaacttgggtgacagagagagactccatctcaaaaagaaaaaaaaaaaagatgctattttgaatatcttatgttaaaatgaaagagactagtacagtttgtgatacattttatgtctaatgatttaaatatatatgcatatatattaactttaaaaatttatattttaatactcaatgtaatgacaactgtaaatgtatatatttactatggctaaatttaaatttaaaattccatttcactgaatatgaatgtcaagaattatataaacaattgaatataagatataaaattattcagagttaaaatctaactacttgctattttgctgttactgatatcagctctagaacatggttttgctgggaaacaaatctcagtttaacttacttgaattctgtgaaaatatataatattcagttttatatttctatttagtatttaataatagttgcaaaaagcccatattatttgcacaatccatttgggttgacttgaaattattagaatgggaaaatcttattttttgtaattgtttaaaataaatctcagtagtagctgtgatatattctgtaatttgtctcactcaacatgcattccaaatcatattttctcttgtgtccgctagtagagaagctgaaaagcaaaacacttttttaaagcaccttccaggtagggatggtcatgagacacaggaatagccaatgagctaaagagaaagactgccaggagggactttcttccctaaataaaaaaacaaagactctttgaagagattcaggtgtcttgagtgcagcagtcaacttgtgacatgaggcataaacatgaagacaaatgtctacaagctaagaatgagaggggtggaaggatgaaatgagtcaagtccctaatggcatccctggatgatgcaccaccccagctcaggactgccaactgcagcacttcctgttgtatttaacaaataaattccttgaaatttaaaccacatttctggctttaagtttcctggtattttcagccaagcaaattcttaacagatacatcacctaggtacaaatttaaactttattacatggagattataatttcaaataaacatttagggaatatttagttttatcttaaaacctctacaaagtttgtcttttacttttgctaataataatgaccctattgttactagtaatgctgtgttatagtataaccagcctgtagataaaataggttggcaaatattcacaaaaaagaattttcgtactactttgggctctaaccaaatgattcaaatttccattacaatggttggagtttcccattttgctgaacactttgagaacaggagagatacagcattttatgtgttttttaaaatgtctacaaaatattgtctaatgttcagataatattttcattgatccattcaataggtatgtaccgaatgcctatgcttctttgctatggacaacccagggcaataactattccttattatactatttcacagatttgttaattttctttccaaaatctgtgcaaacctcccattcatactaaagtttaccaatagcatacttgtataatgtttgctgttatttatgtcaaatatggcatgttgtatttactgcttttctttgaggactgaaataattgccaaaaccaataagtaaaatatgcttataatagagaaatcttgttttcctttttattatttttaaaaattatttgaaaaattttttttagaggcaatggtctcgctctgtttcctaggatggagtgcagtggcacattcatagctcactccaacagtgaactcgtgagctcaagttcccaagaagctgagactataggcacatgccaccacatgcagctgatttttaaaatgttttatggagaccaggtctcactgtgttgcccaggctggtttcaaactcctagctttaagtaatccccccaacttagcttcccaaagtgttggaattacaggcatgagccgctatgccagcctaaaacattttttcatataattaaatattgttctaaaagttgttttcaacttttctttattataaacagtgcagtgttttcaatctttataaataaatttttactacatctataattatgcccatggtataaattactaaaaagaaaattactgggtcaaagggcttgcaattttctaagtcccctatcatcatcaggcaatattttttatttacttattaaaatttgaggtgacaaatagtaatctcctcactttaatgtgtatgcttttaattactaaaaaagattatcatatgattattaggagacatgcagttttctattttaatagctgaatgagaatttccggaagttcattcattgttttaacaaacattttttagcactactctgtgtctacatagattctaacttattccaaaaagattaaaaagtgttccaaacagatatgaattcccttcaacctttgttgatgactttggactaatgtcccaaagctatctagagctaggtctctttgcaccctgctgtgtagtgcctttggtctacaatgccccacctgtaatataagcagtaactgtgatctcgctttcactttattagcatttgcagagtggtttccacctactgacagattactgaatattatacaagttttacacacatgataattacatcgtaaaaccaattttgtcttatcttgccccctttcaaacaaaagacacttttatacaggcatcacttaaactcctctttgtaaaaaaaaaaaaatcaggtttcaattctctttacaaatgaaaatataaatcacagccagttaaagctattctctcaaggcaatggaaacccaaatgcaagcagtttagaatagaagactaatcagaagatagagaagcttttaagatctaattactcagaagaactaactaaagcagctacaatacttaaatgttatcttatataacctaatacatttgaaagatattatcaatattatactgttttttcatagggtattgagtcatttggtacattttgtttttaaacaacagtttaaaatgtgttaaaaataataatcctacaaaaccaacacttctttctcaatggttggatgccaggattatcttcaaaggtaaatgtaaatttaaagtcatctttaaaattttttagggcgcttaaaaaacttgtattaatatcaaacacctgaaaatacaggttcatgtaattaaaagctcatttgtgcctttctatgaggtttctgatttcagtaacagagcgaaattcttcaagataatctttaacctcttatagaaacagccagtgtaacttgccttctaataaaatctcagctctcacatacacaaagaatggtgtgcggcataacctcaagctgtggattggggaacagaacaacaaagaactgtcagacaatgtatgtgggaagaagagaaactggaaccaagggggtggatacaattaatgctttcaaacgcaagctcttagaggatgtccctctcaaaaatcaccagattctctattattcgtgagaagtaggggaaaaaagggaaaatatttttaacttacatggatctctactcctaaatacttcaaaatagagtccagctgacactgactagtagcaactcagatgatctaattcacagcatggtctgcagtttgccaaacgtatctcagtgaagcttgaaagatggccccaaagtgcattatcctctaataaagcctgtgggaagtgaagcattcattctgcttcctgggacagacttttgtggtaagaatcagagcagtaacagatgactgaatggcatcattcaggtgccaacagaaccacagaggaccaatgcttctagactttgggttataaatgcagccatgttgtagacagatgtacccaggtgacaccaacaattttcaaatgagaggtgagcatccgactggaatcacaggcagtggacagtccctaaactgattcattaggcacaaacggatgatctgtcagagaataatgacttttaggacttctgttctcactctaatgcttgatattaatgacctttcaggatggttgatatcattggaatttcatctgccacaaagaaaggaaaccggccgggcgcggtggctcacgcttgtaatcccagcactttgggaggccgaggcgggtggatcacgaggtcaggagatcgagaccatcctggctaacacggtgaaaccccgtctctactaaaaaaatacaaaaaaaattagccgggcgtgatggcgggcgcctgtagtcccagctactcgggaggctgaggcaggagaatggcgtgaacccgggaggcggagcttgcagtgagccgagattgctccactgcactcccgcctgggccacagagcaagactccgtctcaaaaaaaaaaaaaaaaaaagaaaggaaaccagtaaatgaatcagtttctggatgagagtagaaagctgtccctgaaaaggaagcaaaatgacagttgttggagaataagagctagtgtgaaaccaaaatatgcacttatcaaacaaaactctcttattacctctaaattaaatctaattggttttttttttgtttgcatttgttttttagtgatttattttactggagatagcaatgtccagatagcatgtttaagcttgaccaaaaatttgaatctctaagcaacatattcactacaaaaaataaaaaagatctgaaatttgaaacacagcattttgatttttaccaggccctgtttatgatgcattagactgtcagtgaagggtgcatctcactaataattcacgggacatagattgttgcatgtctgtagcatgcaagactctgctaaatgctgcaatagaggactttatggtctaggtcagaggtcagtaaactttttctataaatgtccaggtggtaaatattttaggttttgcaggccagatggtatctaatgcaactactaagccattgtagcaaaagaaagtagccttagacgatatacatatattagtattgctgttttccaaaaatctttacttatgaatgcaagtttgaattttacataacgtttctaggttacaaaatattattcctttgatttttaaaaaattgtttagaaattgtaaaaactattcttagctcacaggctgtacaaaaacagacagcaaaccagatttggcccatacactgtagtttgctgcccttgatctaggctataatagattaaatatagttgccttaaagatacaaacaaaagttccctaggtctacggggattagagagagctcttctagttgaaaacttcaagaaggaggtgacatttcagctgacttgaaggataggattttagtatagaatgtggcgatccacactggagcttttttgagagtaaatggaaacattgttaacggttattctagggaaagaggtgtaaaccctggctatcccatgcaaattgggacatatggttatcccaggagggggagtctagaggtgctatgagcagagagctctgagtgtgcccaagggctgtgtatcattgtgtgaaaaagtccaaattggttaaaacacattaagaaggaataatgggagatacagctagaaaggtagcctggggcttgaattaggattgatcttggtccttaaacatgaagtgaagatatttgaaaactattaaataggtaatggagaggtcctgcaattttttaaacagtaaactgactcatcacatatcagtaatatcagtgatgtgcagaccgaattggatcaggcagaaactacttgcaaaatcccaattaagagaccacggcaatagtctgaagagaggattaaaaaccctggactaagtccaggcaacatcaatagaaagaaaggggtggatgaaagacacatcagagaaaaggagtcaagagaacttgtcaattgaatataaaagataagctaacaaaaagggaaagtcaaagacaactcccaacactttaagtctgggtgattataggcatacaatatttgtggattagaggtaggaggaaagggaagtctgcacatgcacatgtaattggaatcctattcttattcttttaatttggaaaatagatataaggtagcaatagtagttctgtagtttaacttttgaaaacacttttatgccagagaaacacaatctgagtaaagttttgagtggctctgtgataaatgggggtgtgggcagcttgttttgagaaagcgggactttgatttggagggagggtgagggagagagttgggcaactgtctctgtaactattctttctgtcttctttctgggacccagtgggaagcaacccatttttaacttagtacaatggttcatagtgcttgctgtgaaagtaaaaatgaatccacctaaggaaaaagtccagttatgacaagcctgtagctagaatatgattcagaataattttcagccatgagcttagatcacccagttatctcaatagctgtctaaagagttctgagaactatcccaattaaaaccttattttttcttaaaaaaagaactcatttcctatagaacatttaggattgtgacagatgctctgaaatcaaaataaagaaacaatgataaggcactacaacgtctaacacatttgaattgagtttctgctactttccttgactcacaaaatggtgcccaagctatattttgatttgttcacattcaattttccggtaactttctaagcactaattatatttttagagagaatatatctgaggaaagggagagaagcagataaattaatggaaaaaatagcaggtaattataattacctgaaagtacacacacacacacacacacacacacacacacctatttaaaaatttttctaaaacaataaagtgaatcaagttgctacagaaacaaatttagaaatactaatgtctactactggggagatttgagttcttggtttttgttcaaccaccttctctggttaagtaagacaaaattaaccagtctggccatagggtatggtctgccatttctctaaagcagtgtaccagaaaaacaaagcagacttttttttttggatatttatatcctttatttgtatgcatatagtaagcattccatacaaatttgttttgtttaagggataaagcaatcactatgtaattagatcttctactgagatatatttttttaattattatactttaagttctagggtacatgtgcacaacctgcaggtttgttacatatgtatacatgcgccatgttggtgtgctgcacccattaactcgtcatttacattaggtatatcttctaatgctatccctcccctctcccagcagactttaatatattattttccctggccccagaatagaatctccaaacaccttaaggtgtgaattattgagaaatgctgtcccattgtggtgagagactgctggggaaatagttgggtggggacagggtagttcctgatgctttagtgtttccttggcaccaaagaataaaaaataaattatagtgtaaaaccctatatagaaccaaaacaccaactgatgctaattcattagtgcaagtagtgaaagagtgttggttttactttttaaaaaacttccgccgggtgcggtggctcacgcccgtaatcccagcattttgggaggccaaggtgggtggatcacgaggtcaggagttcgaaaccagcctggccaatatggtgaaaccctgtctctactaaaaatacaaaaattagccgggcatggtggcatatgcctgtagttccagttgcttgggaggctgaggcaggagaattgcttgaaccagggagtcggaggttgcagtgagctgagattgcgccactgcactccagcctgggtgacagagcaagactccggctcaaaaaacaaacaaacaaacaaaaaccttccatttgggatccgcttctgcttctgtccttgtgctctgttctttgaaactgttaagtttctttcattgatcttcctagatgtttacctctacttgcattgactatgtagcattataaatacaaaaccttataatagtatgtaacatagagtcattatgaatacagttgttctcccttatttgaagttttgctttctgaggtttcagttatccgaggtcatctgtggccatccgtgatgcacagaaaatatgaaatagaaaattatagaaataaataatttatgtcttaaattgcccactgttctgaatagcaggataaaatctcatgccatcaaactctgtcccacccagcatgtgaatcatctctttgtccactgtatccacgttatccaggccacctaacctgcctgcccttttgccacttgctagccatcttgcttgtcagatcaactgtctcagtatcgcagtgcttgtgttcaagtaaccctgattttactttataatggctccaaagcacaggagtagtgatgcggcatattgttataatttttctattttattattagttattgttaacttcttcattgtgcttaatttataaagtaaactttatcataggtctgcatgtataggaaaaaacaaaatacagggtttggggccatccgcagttcaggcattcactaggggtcttagaatgcctcccttgcgaataaggggagactactgtatgtgttatattatgtattattagaaatgatacaaacatataacattatagatatataaggacgggatggcaggccaccctggctggtgcttctgattatatccctctctccagcttcctggtagttatgattacacaccagggctttgaaaaatgcaagatttctaattaaagcacatctatgctctagttttttctctctgagtttcttacctgtatgcattttctattcggtgttgaggtatgtaacaactgctctgacagactgagaatctaatattaagaaggatacgtaagaatgcaggtgaaacagataccctgctcacacccaagcgtgtttttgcttacaatggttgttaaccaaaaaaaaaaaaaaaaaaaaaaaacaaaaaaactagagcacctgctttcttctcttgttattattctcataattcttaaattcaaatgaaattaaaaattcctgggttgaaactagatttaaacaaatgacagtttgttgctggtttgcccaccagttaactttctctatgaaagatccatttcctattccaaggtaaagaattacaggaatgtgtgtaattgattttagatgtagctattttaaaaccttgcagaaaattacaatcatattaacataactcataagtgaaaaaggtttggcgttggagatctagatatttgcccccttctttaagaacctctttcacgtaccttaagtaagcgaactcactttactacccataatagcctaaagatattcttaggaatctctcaaggttatgtttctgaaagtaatacaagtataacaggctttatcaatgtgtgtttgttactgtgccattattattcattacttaccacttcaaaaaataagtgtgtaacttcaacctgcctgtgctaaaagattagggcatatctgtatgccctcaagatcaataacttttactatgaaaattctcatgtgcaacttttaattctgtcaaatgagctgatctttttctttactaacggagtcctcattaagtttcaaataaagaatgacagtattgctgctcactttcaagccatacctttgaccttccaaaccacttataagctgaacaagatgtaatattgggaatagaaaatactttagttgaaaaccttgagtatccctgctggatcctggctgggcttctgacctttagcaaatcactgactctctgtgagtcagatttcctctaaacctacatttacaatgtgtagcttacagaaatagctagaaaacttatacttttgaggcattttatttttaatgctttatataccttgttcctggaatagttacaactcagttctccatagaaagttaatgtagtcaatcctttatctaataatagtacccctataatgtgtatgaagaaaatgaagaagaagagggtgggaaatggctattttataccatgtgtgaaggaggcatgaagaagaaaatcataaaatcaaatagcttatattacaatttcaaataaaaaatggctatctgatgttggcatactctaatctttaaaaatattttacaaataaataagagagaacaaatactaagagttctgagggatattcattaatcatggaactatggcccctccacggctgctaatgtctttgcagaaatacatctgatctacctttcaaaattattgaataaaatatgcaattatgaaataacatctcactattactatctttttctctcttccttcattttgtgcaggaaacaggaagtcatttgggacctcttttaattatttatttctttttttgtctttaggagttgtacagatgttctgtgctgtatgatcttcctactgtgtattattggctacattgttttaggacttgtgggtgagtaaatacaggtatagaaaatatttaacacttgctaatggaataactaagtcagtgtcacatataaaaaattaattattgtcttccaaaagccttcctattattgactgttgtctttcctggaggaaatgtgcctcaccaggatttatcgggtagcagacaataaaaaatgaacataaaacagtttagtcaaaggcaagcccaaattacttaagtaaatacaattataaagcagaaagagaaaagtttgtggtttctttttaatcattgttacttttgaaattctaataagcaactaattatgttcatgttgttctttgctaataagaactagggcctagatctttttaggtaatactaaatatataaacttttctttttataagcaaattaaaaagaaggaacaattattacgaatttcaccagataattcattgacatacaaaaagttctagtctctttgcccaagtgatagctagcaaagatatactctgttatttattgttaggttaaagatttttctatgaaagtgaaaataagagaagtatggagactctttatttgaaatttttttttttttttttttttttttttgagacagagtctcactgtgttcccaggctggagtgcagcggcgcaatctcagctcactgcaacctccaactccctggttcaaatgattctcctgtctcagcctcccgagtagctgggattacaggcatgcactaccatgcccagctaatttttgtattttttttttttagtagagacaaggtttcaccatgttggccaggatggtcttgatctcctgacctcatgatctgcccccctcggcctcccaaagtgctgggattacaggcatgagctactgtgcctggcccatttggattttttttaaacaactaccaaagggactagtgtgaatattttctgtaagaaggtttcacaattgtatatgaatggatcaaacttctttttccccagagacataggttctgtcccttaaattctgacttaggaaactttaatatgttattattagggtgaaagttgtgaaagtcagatattagctagtaccaataattaatggcatggagtcaatgtggatagaatgtattagcagaaagaaagttatatcctaactggagaacaatgaaaaacatttttccctgctcttcagttttatcttccaataagagaaatactttgagaacaccaactgaaagtcatttccaaaagataatctcaatattgccatgcaaaagctacacagaattagagaattcaaaaaattaagacaggaaaatagggagggagagaaaaataaaggagcataaatcacaaagctaaatatattcttctaagaacttcagaacattctttcattatttcttaaagtgttttaacttctaaacattaatgaagttgtagtacaatatgtaatctctagagtaaatattataataaaataaattttcttacacaaaatatagaattttggtttctctcactttgggacacatctttcttatctgtgtaattttttgtttgtttttacttttcatcatagaattgaaatgtgttacataagtgaaagatttggaatcaggcacatctagagtttcagcattttttgatggtcttgggttacttactcaacctcagttttcttatctggaaagtgtggaaacattacctgcctttcagggctgttgtgaggagtaaatgaaataatacctaactgtaccaataatgctgcataacagttctgggtagtagtttgtttgctaccattgtataactgagttgttctgaattttaataaatttcttttcaatataatttacaatattatttccatggcaacccataatttggtctattaaagtttgactgcacacaggaacttcacaaagatctcatcctgtgaccagaatctttccactaggaggccttattccttcatcaaataggtctctcctctgtatctcgaagccagtctaatgtagtccacagaaaaatgctttgtgtccttatatagagtgggaaaacccactgccactcttccgtagacaaaacagaggagtgtatgccattattttctctggagcaagataagaaatttgcctttttttcccagaaccccaaattcagtttgtaaatgtcttaattcacataaggaaattggcagataaatgttactcaataaaaaactgtgttgagtagtaaattaattcagtgatgtctccagattaatcccagtgccactgattaaaattagtgactcacaaagtttacaaaatatatataccttttttttaatccctgaactatatatagccttactgacttcatttcaagataaacttaattctttgattatatctaatgttggactaaaagaagcatgaggggaaactatggcagaggttactagaagtgttaaggattttttaccatgaaagaatatataccttcatttgagcaaatatgatgctgtcagtttcactgatgtgttacagttattttggtgtcttttgccaactatattagattagtgcctttgtagacttatctttcatccatgatcttttcataaagaagtgtttccatggaagagacatttttgttgttgttgttgttgtttttgttttgttttgtttttttacaaaatctgctgagagaaactgttctttgccctttatgtggaatatggccagctagggtaatacttcagtgcaacagagacacttaacatttgattgatgaacaacagaacctttgttcaagtggatgaagtggcgtctgggtagaagtaatcaaatcttgaaagatcaaactaacctttatggtaatagcccttctttgtcctactttggtgatggttactattcaattattgtactaattagaaaaaaaataggaatatttattatgcaaattattctttcctatacttattgctatcattaagtatacaatataatagcacaattttaacattcaataaatttttatggccaggtgtggtggcagtggctcatgcctataaccccagcatttatggaggccaaggctggctgatagcttgagctcatgagtttgggaccagcctgggcaacatggcaaaatcctgtccctacgagaaatacaaaaattagccaggtgtcatggtgtgctcctgtagtctcagctactcgggaggctgagttgggaggatggctggagcctgggaggcagatgttgcagtgagccaagattatgccactgcaccccagcctgggtgatagagccagactttgtctcaaaaataaataagtaaataaataattttaatttgttttctttttaaattgattactctttgggtgatttagttcattactgtatttacttaggaagtgcttgaaattaggatccaaagtttgttttggttttgctttttttaacctttcccaggggtaattatctctagtagctgagaaagtaaaaagttaacaagaaagttaatgcaaacaagaccagaactctgtcaccatgctgtaagaaactcaagctatgtgtagcagctacgtggaggagtcctggccaacaggctcagctgggctcccagggataattagtgtccactatcagcccagttgggttttctgaagccccagtcaacacctgactgtatgagagatcccaagggagaattaagcctttccccaaattcctgacaccccaaatcatgagcaaaataaaaatttattatattaagccagtgagtttgggagtgcaacaatagataagcagaacaaaatttggtacctggaagtgggatcctggcttaacaaaacctacaatacaggcattggttttgagaccaggtggtgttcagaaaccccgtgagttttgaggaggctgtcggtgagtttgaaagaaaatgagaaagatgtgattggaagcaggggggcagggcacctcgctatgtagtggtgaaaagtctggcgtcactgttgctgtggtaatgagggatgcaggaaatgtacctaatgaattcaatgatctagctaaaaaaaattgtcctcaggaaagtagctaaccctgctgagccttgtccacacttggacctgacttaggtgatgagatctagaccttaagccagagcctgatgaggtaattggatgaagcttctggggatcttgagagaagataagtgtatttacatttggagggaatattaaaaaaaaaaaaaaagaaaaaaaaactggctagagggtggacaatggtagccttaatacatggctgcaaattctttgtcatttttcccattgagaagtaggatctgcaatcctttccccttgaatacggtcaggcttgtgattgcttctttaatagagaaatgaaccaagccaaagcacagcagtaaagagccttgacatgcagataatttatagatcagtacaaaggattaaaggaatggcatcatggcttgactggagactggagacagtggaactgaaaataccaagtagagaaagaaagaagtttacataattgcataaggctaaattttcatattcagccttaatccttcgtagaataaggtagagaataaacaaaatagttaataataaagtagtcaaaatttacctcatcatttttgatattaaactatatgtttattgttttggggcaataatacagtcacatctattttttcatttattacttaaggaaatctagcacatcacactctttcctgactaaactttcccaaaacaccaaggagggagcaatctgatttccagttcctaggtgtagagactttgtattgttctggagatctgacattttggttgtgccatttagtacatttcatagtccattgctcatcttaatcttcccactactgtagtggctcccaatccaagactactgctttttaagtctttcaccaatattcaaacattggttcccaaagcatgacaagggtcagaatggctgcatccaaactggcttcttggttgatcagaaccagcccttactcttaggccctgcttttaagcctaggaccccagcccagtctcttcctccatagtaagttccctttgagggtatttttatcctttttgtccagcaaacctagttcagagtcaatctgatctatcctaaattaaaatctcagggagaaaagtttgaggtcttatctcttccttctcttaaagcaagttagtcttcctctatcccaataaacatgaggaaggaagaaagcatattttcataactaagagaagtcactcaagtgaccttctgaagaacaaagataattccaagatgactttttcattctgtccatacaaagaagcagtgaacagtttctcttactaataaacacataaatatacatttttaatttaatttaattttttagctttatgagctatgattgacacattttaaaaagtatatatttaaggtgtacaacctggtattttagtatatgtatatcttgtgtaatgatctccacagtcaggctaacagatatatcacctcacgtagttacttttgtttgtaagtgagttttagtttggaaagaacagttaagatatattctcttagcaaatttcaagaataaaatacatcattaactgtagttaatgctgtaaatcagatctctagaacttattcatcttataactgaaagttcttactttttatccattatctcctaatttctcccacacccccagatcctggcacctaccgttctgctctctgcttctatgagttggagtattttagatttcacatataaaggagatcacgcaatacttttcttctatgtcttgtttatttcacttagcataatgtcctctaggttcactcatgctgtcacaacttggcaggattttcttcttttttaaggcttgaaaatattccattttgtgtgtatatgtgtatgtatgtatacatacacacacacatacacaagcacacatacactataatttcttaatccattcaactattgatcgatacttaaattgattccaaatcttggctattgtgaataatgctgcaatgaacatgggagtacagatatctcttcaacatactgagttcaaatcttttgggtaaatacccagatgtgggattgctggatcatatgataattctatttttaattttttgagtgacctccatgctatcattcgtaatggctatactaatttacattcctactaacagtgtacaagaattccttttttctccacatctcctcaacacttatctcttgtcttttttataataaccatctgtacctcactaggcatcctgttgttctaatttgggaacttggtggtgtgaccacaatattcattgcaagaggaaactggcaattggcaatgagtataactggaaattacattgtgctgttaatctacttttggaaataagtgaacctatcagatcacagcttggaaacattgttttagccaagtaaaatcatatctcccaattaaaaagtaagaatttttagaaattccagttctattgttttttaaattgttccaggaaccttttcttaatgaaaaatgttatcattgtatttataaccagaattagtattaaatgtccttttgcattttttacaaatatataaatatttacaaattaaattacaaacctatatacttccttttattttggaagtcttcattttaaaaagaaagcatttagttttcactgttacttgagcagatattttagtattgagtgagttttttactgtttactttgttgagtgcattcatggtagatgattttaagtggagtattgttatcatgagagggattgatttgtgctcaaggacatgaccctaaactcaccattgggtagaagaggccacctgtgaaatgacaaacaacatttttcttatctaagcaacaagatacaggactgcttccaaaaatgtttctatagcagcggtgtcatcaacacagattttcaaatttggtatcatgtgtcctattatctgcttcattgcatttgtaaattgcttgtgttaaaaagccataagcacaatttggccggcctgttcctcacatattaaaacagttaaaatgtacctttaagggatacaaagtaatgattcgaaagccaacattcccaaccagcaagtgtttagggaatgcctcccctgccccaaacagatatgcagttaatttttaagtgtcggtgcaagcagttggtctaatcacattttctccttgacagagggcttttaaatggctgcaactcctgactcaaccctagagcacaacaagaacatgctttgcaaatgtttgaaaatgagagataatgttagatcataatactcgctcctggtacttcagaaacatgcatttcctcgatatgagtgaaaagataatttgcctgaataaatttttcaccatctcttgccaatctttggttatctgctatgaatttccctaatagaattcttttacaaataatttctcttctctcttctctttctgttttatgcacacatgaagcacatgtgcacctgcacaaacgtgagtcagcttcacttaaagtggtgttttaaagttattctaaaacagtgagataatgaagaaaaaagatgattgaaccagatttgtgttggttttattcaccaacgtaacccaagtaatttaattctagagcctgtgctcttgaacactacactatactgtattttatttaataaaaacaataaatgaggaataagtaatgaaagttacagagagaggggtagaccagaaccccatgatcttcaactaatacttttctcttcctccttcacctcctgcctcctctaattccacactgagttgggcttaaaacagcgagtatccaagaacagtttgggggataaatgaaaggcaggtattcttctgcaaagatcatcaacaatctattatcttcagtcttgcccctctgagactgatatgggtcactttgctgcagtgccattgtcaatcttcagtaattaaaaaaattagtctctattttgtatagactaaaaaggggagtgtattctttatcataatccacacctaaatagttggttttctttccttcagttaatgtttgtactatggagtaaataaaattattgtaggcaatatttcattctttggccagaaaaacctcaaaggatttcatgggtctcccaaaaaagtgttatttactagtagatgttaatgagtattacatgtaacattttcagatacaatacattgtatcgatttttaggaaccatgagagctgcttcatataaagcaagaagatgtggctaattatagaagcacagttaagcaagtaaagacaagaccagaaacactgaatagggggtggcctagacctcgtccaggaaaatttgaataggaagataaggacctgcctgaacagaacctttaccagggaattcacagctgacactaacaactaaaaaaaatctccctgtagttcatcatagaaaatcctaagatgctaactctccatccatatctgaaattacgctttaccctgctttcttttcttttctttttttttttttgagacagagtctcgctctgtcacccaggctggagtgcagtggcgcgatctcggctcactgcaagctccacttcccgggttcacgccattctcctgcctcagcctcccaagtagctgggactacaggtgcccgccaccacgcctggctaattttttgtattttttagtagaaacggggtttcaccatgttagccaggatggtctcgatctcctgaactcgtgatccacccgccttggcctcccaaagtgctgggattacaggtgtgagccaacgtgcccggcctaccctgctttctgtgtaagcaccacactggtctcctttctgtcctcagtacccatcacactcccacccctcacaggccctttgtccatgttgttcatctgctggaagccttttgggcctctattcgtttttgaggtctcagctcctgaatcacttcttcagaaacatcatccctgacctccgtcatgtgatcatctgcctctgtgaatcatgttattcatgattcctttgtagcacgtgtcagaattggaattttacatttatttgtgcagttaattcattaaaatctatttctcccaacagactgtaggctttgggagagcaaggaccattatattcccaggttctaggttggtgctgacacagaggaagcactttaaacaatatttgtagaatgaacgaagaaattatttgtacaatgaatgaaggaaaaaaacccataaactctcgtcctcattatttcaaatacttccttacctttaaaatgaaaatgaaaaacctatcttctaatgtgaatcaaaatcttaaataaaatcttgaatagtggtggtctagcattgacttagaataatcagaaacataagtgtattaaagtaatcagcaaaaagtcaaatgcaaacaaacaaaaaaaacccacaggtgttataaaaagcctactttcatttcttggtaatttggttgtttttctgttttcttcaattctgtgtctattttctgcaaacctgttttaaggatatgctttgtcccatcttttacatcctactctccttccaattcatagaccttgaaatttgggtgtatcttcttgctctttgctattgctgtttcatgtagcagtaaattctgattaaagaaagtctgaaaaccttatatattttttaaatgaagtgctgaatgtcttgctgtatatatctgaagtcccactctttaataggctggtcacttgttcagaatatgggctgggcgtttttcattttcccctccaaatcttttccttattctcctcatcctgctctgtcccctgggaatctggcatttatgggttacagcaagtggctctcttgtcctctggcttccaattttgtgagattggagggtaggagcatgagtttgtagaatttcttcctttgactctcttgctgatgggtcacaacagtttggctacacctctctaaggctcctgctcctgtcagtgctgtcagtgagctctctccattcagcttcttctcctgggtttgggttacttcttctgggcctcttcaggcctaggggtggaaactgctccctattggtgccaatctctgggttctacatcaactcctgcttatttcccttcacgctgttcatacctttataaatatcttctttattaaactctactcaattattctatatgagtttaacatctgtcttctgctaggatcctgccatgctccagaaaacagctccccagcctcgaagggcattgtttcctacaaggggatataactggctcatcagggggttattctactgttccattatgccagctacttctgggtgaatggggttcagtgttggtcatctatgctgataaatttgttgcgtacacattgttagaagccaggtcatcttttgtgagtacaagtccatgttatcaaaacccacacataatcttcatccctgttatcatggttactttattacaaaatcattgaatgagtggtttccatcttgattattgaaaactacctctacagaaggggcttcactaagcagctacgtgagacaaacgtatcttcaaattctgggtccatttagaggtcaacccttgtagttatttctcaaacttcctggccattgattgtctaatatttttcttttgtagtccatgacaatgtagccaaatcattggcctctatctatgaatagattaaatgattcagatcttctactctttcggtcaaagtagacaaccagaaaaatttaccctagtcaatgctaagagatcctccacagccgtctataaatctggtttaattttttttcttcagtcagttgatcaaaggtacctttccatgattaaatttccatgatcaaagggactttttcatgtatgtgtttctttaacacatgcctattggcatcagaagttaatatattactattgtaagaattcttcttatgtaactttcttgagctttatgaccttctgaagcgttgtaggaatgtcatatccattgggaatggagtacttctgggcacaaccacctctaggcttgatggaccaaatagtaccctttaaacattatgatgggaagctcatgtcattgggtgttcattcagggccaaggggctatttctcaaaagaagaatagttattttctgaaaaaaacatggattttcttcaacaccctagagacctctactgtgactctctaatagagatttgccacaggccccataaactatcttgttctctgacaggtattttagacccagtgacacacctctttgtaaagcagcctggattatctgaaaagtattttatttctctgagctctactcaaatctgacaactaataagtattgcaccccttttaatagcagaaaatgtaagacgcagtaacttatctttaattatggagaagatataactactggacccctcaggaactttaatgaggtggaagactcctgtattgtcatatttttctcctatccattagcacacgtgtgtctttataaggcatcaagattatatgctaaccactattccccagatcttatcagcatgatgctatgaatataaggaaatctgtgtggcatcctgtggaataaggatattatcaaaaccctgtagcctaaattgtggcaaagagctagaaggtcatataaccttgagggaagaaagtgaagatgcagtactgtccttaccaggtaaaagcaaatgccctgaaggttatccacttatcggaaaaaggagaaagcatttgtttgatctagtgctgcatccaaagtgacagaggctgttttgatttgttctagcatagagacaacaacttgaagagcagctgaaattaaggcgatgacttggttgagcttaagagaatacactaacaatcttcagaacctgtcttccctctgcactgccaatcagtatcatatatagtttctctaggaagaatgtgttgagaaatagtattatactaaatatgagatgtattcatctctatatcttcagagtttatgtgtgcctatatcattcattcattcatgaccaaataaatagaaatgtgacaattgacaattcagtatgaatgaatgaatgaaaaggagtttgatcatattctagactggaattttaacataaagtttttcatgtttactttaagaactaaggtaaatagatgtcagatactgtgtaatagtttaggtcttaaggaatattttaaatcaagtttaggattccatgtgttaaatcatacagtgaggactgaaaaataccaaaatcctagaaagtgtagctataagcttaacacataataaattaaatagaaaagatgtttcctaattattatgaatatttaatttgaaaaaagaaagatggtgaaattatttccttcaaatataaaagttttttttgggcttgctgctgaggctctgtgagacagccgaaaacctttgaagacaaaggacacaacctcttggaagctccatggccccatccagctcctgagaaacctgaatacttatccacacaaccctagagcaagcttgtatccttcctatacatgctgtcttgaaagcatcacctcctggctggaggccaacacaaaataagggcagtaaataaatctacaaccaaggaccctcacagagtacacttcactcccttactacctctgccagagtaggtgctggtattcacggctgagacacctaaagatggatcacatcacagaactgttcatagacactccccagtagcagcgcacagccctttagttccactgggtggctagactcagaagagaaataacacctactgcagtttggctctcaggatgccccatcccttggggaaggagaagagcaccacatcaaggaagcaccctgtgagataaaataatctgaacagcggcccttgagccccagatcttccccctgacatagtctacccaaatgagaaggaaccagaaaaacaattctagtaatatgacaaaacaaggttttttagtacccccaaaagatcacactaactcaccagcaatggatccaaaccaagtctttgaattgccaaaaaaaaaaaaaaaaaaaaaaagaattcagaaggtcaattattaagcttctcaagaaggcaccagagaaaggtgaataccaacttacagaaatgaaaaaaagttacagaatatgaacagaaaaatctccagagaaatagacagcataaataaaaaacaatcacaacttctggaaatgaagaacacacttagagaaatacaaaatacctggaaattctcaacagcagaattgaaaaagtagaagaaagagcttcagagctcaaagacaaggctttcatattaacccaatccaacaaagacagaaaaataattaaaaaaaaacaaagcctccaaaaagtttgggattatgataaacaaccaaatttaagaataatttgtgttcacaaggaagaagagaaatctaaaagtttggataacatatttgagggactaatcgaggaaaacttccctgcccttgctagagatatagacatctgaatacaggaagctcaaagaacaaccgggaaattcatcacaaaaagatcatcatatacatcaggttatctaaagtcaagacaaaggaaagaatttcaagagctgtgaggcaaaagcatcaggtaacctataaaggaaaacctatcatattaacaggagattcctcagcagaaaccctgcaagctagaaaggattggagtcctatctttaggctccttaaacaaaaccagcaaaaccaagtttcataaatgaaaaaaaaagatacaagctttttcagacaaataagtgctgagagaatttctcactaccaagccagcatgacaagaactgctcaaaggagctctaaatcttgaaacgaatcctcaaaatacaccaaaatagcacctccttaaagcataaatctcaacggacctataaaacaataacacaatgaaaaaaatcaaggtatttaggcaacaactatcatgatgaatagaatagtacctcacttttcaatactaacattgaatgtaaatgatgtaaatgctccacttaaaagatttggattggcggaatggacaagaattcacgaacgaactatctgctatcttcaagagactcacctgacagataaggactcacatgaacttaaggtaaaggggtggaaaaagatattccatgaaaatgaacaccaaaatcaagcaagagtagctattcttatatcaaataaaacagacattaaagtgaccacagtttaaaaagacaaagagggatattatataatgataaaagaactagtccaacaggaaaatatcacaattctaaatatgtatgcacctaactctagagctccctaatttataaaactattactactagacctgagaaatgaattagatggcaacataataatagtgggggatttcaaccctccactgacagcacgaaacaggtcatcaagacaaaaagtcaaaaagcaacaatggacttaaactatatcctagaacaaatggactcaacagatatttacagaaaattctacccaacaactgcagaatatatgttctattccacagcacatggaacattctccaagatagaccatacgataggccacaaaacaagtctcaataaatttaagaaaatcaaaattatatctagtactccctcaaaccacagtagaataaaatcagaaatgaactcataaaggaactctcaaaaccatgcaaatacatggaaattaaataacctgctcctgaattattattgggtcaacaataaaatcaagatagaaatttaaaaaattatttgaactgtacgaaaatagtgacacaacctaatgaaacctctgggatacagcaaaagtggtgctaagatgactcttcatagcattaaatgctgacatcaaaaagtctgaaagagcacaaatagacaacctaagtcacacctcaaggaaccagagaaacaagaacaaaccaaacccaaacccagtagaagaaaagaaataacatcagagaagaactaaataaaattgaaacacaaaaaaaatgataaatgaaacaaaatgctggttctttgaaaagataaacaaaattgatagaccattagtgagattaatcaagaagagagaagatccaattagaaacaaaatgggagaattacaaccaatatcacagaaatacaaaagattatttaaggctacgatgaacacctgtatatgcacaaactagaaaacctagaggagatggataaattcctggaaatatacaaccctcctagattaaaccaggaagaaatagaaactctgaacagaccaacaagattgaaatgataattttaaaattgccaacaacaaaaaagtccaggaccagacagattcacagatgaatctatcagacattcaaagaaaaagttgtaccaatcctatagacactattccaaaagataaagagggaaccttctaaatcgttttatgaagccagtatcaccctaatgccaaaactgggaaagaacataacacacacaaaaaatctatagaccaatattcctgatgaacacagatgcaaaaatcctcaacaaaacactgactaactgaatccaacagcacatcaaaacaataatacattatgatcaaatgggtttcataccagagattcagggatgatttaacatatgcaagtcaataaatgtgatacatcacataaacagatttaaaaacaaaaattgtatgatcatctcaatagacacaggaaaagcatttgataaaattcagcattcctttagtattaaggccctcagcaaaattggcatataagggacacaccttaaggtaataaaagccatttatgaaaaacgcacagccaacattatactaaactgggaaaagtttaaaccattccccctgagaactgaaacaagacaaggatgcttgctttcaacacttctattcaatgtagtactagaagtcctagccagagtaaccagacaacattaataataaagggcattcaaatcagtaaagaggaagtcaaactgtcattgttcaccaatgatatgattgtctacctagaaaaccctaaagactcatccaaaaagctgctagaactgataaataaattcagtataaataaagaaagtttcaggatacaaaatcaatgtacacaaattagtagcactgctatacacaaagtgaccaaactgagaatcaaatcaagaactcaatcccttttataataactgcaaaacaaaaacaaaatacttaggaatataccaaaccaaggaggtgacacatcgctacacagaaaactacaaaacactgctgaaagaaatcatagatgacagaaacaaatggaaacacataccatgcccatgggtgggtagaatcaatattgtgaaaatgaccatactgctgaaaacaatgtacagattaggccatttcacatcaaaataccattattcttcacagaagtcgaaaaaacaatcttaaaattcatatggaatcaaaaaggagcctgcataaccaaagcaagagtaagcaaaaagaacaaatctgaagggatcacagatcacatcacccaacttcaaactatactataaggccatagtcaccaaaacagcattgtactgctataaaaataggcacatagcccaatggggcagaatagaaaacccagaaataaagccaaatacttacagccaactgatcttcgacaaagcaaacaaaaaaaaaagtagggaaaggaaatcctgctcaacaaatggtgctgggataattggtaagccacatgtagaagaataaaactggatcttcatctctcaccttatacaaaaatcaactgaagatgaatcaaagatttaaatctaagacctgaaaccataaaaattctagaatataacatcagaaaaactcttctggacattggcttagacaaaaagttcatgaccaagaacccacaagcaaatgtgacaaaaaaacaaagataaattgatgggacttaactaaaaagcttctgcacagaaaaagaaataatcagcagagtaaacagacaacacacagagttggagaaactcttcacaaaatatgtgtctgacaaaggactaatatccagaatccacaaaaaactcaaacaaatcagaaagaaaaacaccaaagaatctgatcaaaaagtgggcaaaggacatgaatagacaattctcaaaagaagatatacaaatggccaacaaacacatgaaagaatgctcaagatcactaattaccagggtaatgcaaatcaaaactacaacacaataccaccttactcctgcaagaatggccataataaaaaaaaaatagatgctgatgtagatgtgatgaaaagggaatattttacactgctggtgggaatgtaaactagtactaccactatggaaaacagtgtggagattccttaaagaactaaaagtagatctgccatttgatccagcagtccctctactgggtatctacccagagaaaaagaaatcattatacgaaaaagatacttgcacacgcatgtttaccgtcacccgattcgcaaatgcaaaaatatggtgtattagcccattctcacactgctaataaaaacatacccaagactgggtaatttataaagggaagtggtttaattaactcacagttcagcatggctggggagacctcaggaaacttacaatcatggtggaaggggaagcaaacacatccttcttcacatggtggcaggaagaagaagtgcagagcaaagggggaaaagccccttataaaaccattagatctcatgatctgtatggttcacttgctgttcactatcacaagaacagcacggcgaaactgcacccatgatctagtgaccttccatgaagctccactcccaacacgtggggattacactcagattataattcaagatgaaattttggtgggaacacagaaccagaccatattattccacccctggccccttccaaatctcacatgcttctcatatttcaatacacaattatgccttcccaacagttccttaaagtcttaactcatttcatcattaacccaaaagtccaagtccaaagtctcatctgagacaaggcaagttccttctgcctgtgaacctgttaaatcaaaagcaagttaattacttcctagatataatagggatacaggcattgggttaatacacccattccaaatgggagaaattggccaaaacaaaggggctataggccccatgcaagtctgtaatccaatagggcagtcattaaaccttaaagttttgaaacgattttctttgattctatgtctcacatccaggtcacgctaatgcaagaggtgggctcccttggtcataggcagctccacccctgtgacttggcagagtacagccccctttccagctgttgtcactggctggcattgagtgtctgtggcttttccagttgcatcatgcaagctgttggtgaacctaccattctgggatctagaggatggtgggcctcttctaacagctgcactaggcaatgccccagtggaggttctgactttatatttcccttctgcactgccctagcagaggttctccatgaggtttccacctccaaagcaaacttctgcctggacatacaggcatttccatacatcctctgaaatctaggtgaaggttcccaaacctcaattcttgtcttctgtgcacccacaggaccaacaccatatggaagttgccaaggctcgggactttcaccctatgaagcaatgggctgagctataccctggcccctttcagccacagctagagtggctgggatgtggggcaccaagtccctaggctaaatgcagcgggggggggggggggcctggcaccagcccaggaaacaatttcccctcttaggttctgagcctgtgatcagaggggctgcctttcaagtctttgacatgccctggagacattttcccctttatcttggtggttaacatctggctgcttgatacttagacaaatttctgcagcaggcttgaatttctccccagaaaatgggtttttcttttctgtcacattgttgggctgcaaattttccaaacttttatgctccacatcctcttgaacgttttgctgcttagaaatttcttccaccagataccctaaatcatctctctcaagttcaaagttccacagatctctagggcaggggcaaaatgctgccattctccttgctaaagcatagcaagagtcacttttgttccagttcccaagaagttcctcatctccatctgagatcatctcagcctggacttcattgtccatatcactatcagcattttggtcaaagctattcaacaagtctctaagttgttccaaactttcccacctctacctgtcttctgagccctccaagtctctaggaagttccaaactgtcccacattttcctgtcttcttctgagccctccaaactgctccaacctctgcctactacacagttccaaagtaacttccacatttttgggtgtctttatagcagcaccccattcctgtaccaatttattgtattattctgttctcatgctgctaataaagacacacctgagactgtgtaatttacaaaggaaagaggtttaattgattcacaattcagcatgactggggaggtctcaggaaatttacaatcatggcagaaggagaagcaaacacatctttcttcacatggaggcaggaaggagaaatgcatggtgaaggggggaaatgtcccttataaaaccatcagatctcatgagaactcactcactatcatgagaacagcatggtagaaccaccctcatgatctaatcacctcccacgagatccctcttccaacacgtgaggattataatttggataacaattcaagatgagattttagtggggacacaaggccagaccatatcatatggaattagccctagtgcccatcaatcaatgagtgaataaagaaaaggtgtttttttatatatatatataatatatataatatatacaattatatattatatatactatatataatatatactatatataatatatacaatatatatattatatatacaatatataatatatacaatatatatattatatatacaatatataatatatacaatatatatattatatatacaatatataatatatacaatatatattatatatacaatatataatatatacaatatatattatatatacaatatataatatatacaatatatattatatatacaatatataatatatacaatatatattatatatacaatatataatatatacaatatatattatatatacaatatataatatatacaatatatatatatatacacacacacacacacacacaatggaatactactcagccataacaaggaatgaaataatgtaatttgcagcaacctggatggaactggagaccatcattcaaagtgaagtaactcaggaatgcaaaaccaaacatcgtatattctcgcttatagatggaagctaagctatgaggatgcaaaagcatacaaatgatacaatgtacttcgaagactctagggaaaaagtgggaggggttgagagacaaaatactacacattgggtagaatgtacactgctcaggtgcaccaaaatctcagaaatcaccactaaaggacttatccatgtaatgaaacaccacctcttctcccaaaaccctgaaataaaaatacatacatacatgtatacatacatacaaacatacactttataagttgtaaaaaaaggaaactgtttggggatactatacattaattcaaaatataagccaaagggtaaaaaagctataagataaattctgaagaacaaaaaaaaggttttttcaaaactatataataattcattatctattgctgcattgtaaactacactcaaacttggcaacttaaaaaacaaatatttcttatttcacaatttccatggttaggaatgtaggcacagcttggttgggtggttctgggtccaggttcttcatgaagttgtggttatgatgtaagccaaagctgcagtcaactgaaggcttgagttagggtggaggatgtgccttcaaggtggcttactcctacacctcactttctgcttgactttcccatgtcccactgatgtaggtgaaaacttgttttcacatatttgaatctagaaattctgttctaacattacaaaaacttaaaaaagtggatctcatggaggtacagagtagaatggtggttagcaggggctggaaagggaatgagggagggagagatgaagagaagttggttaatgagtacaaatatgccattcaaaggaataaattttagtatctgacagtacagtggggaaactgtagttaacaataatttattgtgtatttcaaaatagcttgaagacaagaattgtagtgttcccaacacaaagaaaaaggtttgaggtgatagatattccaattatcctgatttgatcattaaaccttgtatacatgtatcaaaacatcatgtgtaccctaaaaatatgtgcaactataatatatcaataacaatataaaataaaataaagtaataaaagttattttgcatgattgcaataagtaccaagggaatttgagagaagattctacttttttgttgttagaatttgctaaaatttgttcatttaggaaaattatattattaaaaacacaccacttgttgtatttgattttcctattcaatatacatatttcctcctgcacttaaagctgctacattcacagtgattctacctgtaggtgtaagcacttgactactcacatctcttccagtttagtcacatttgagcatttgcatattgatgtgcatactatttaattataaattactttttattatttctcattcatattacataggatattttattgcctttttaaaggaaattatgagtttggctgagatatattatctgtgactattatttcaagattgtacaaggagcattgttaactattataaaaaggatgtgttgggtatgatgtgcttgagaatgactgtcatacaaactggtgatgttatggcactcataatcaccttaaagaagcccttgacactgttctttctactagaacagatctgtccaggagaaatataaagtgaattatatgtgtaagtttaaattttctgatagctacatttaagagcataaagggaaacaggtgaaaataattttaataataacttaatatattttatttacttaaatataacaaaatatttcaaatgtaaccaatataaaaattaagatattcttctttgttgttgtttataatgtctttaaaatatgatgtgtattttgcacttacagtatgtcccaatttggagaagccatttcaagtgctgaatagacacatgggtagtggctaccatattggacagcatagttttggatgttccatgaatagaaaaattccaagaaagggagtaaaatgtcagaagctccttaatttattaatagggacaaaatgatggctgctgcccatctcctttttttcctcttttttgtagctttcagctcaaagtctttatgtttcagctcaaacacagaccatctgcagcacaacttctgtgccagaggctgtgtggagaggtgtagcagcagctcagtaaacacaaccacctgccacagttcaaaaccagaaagtcaagaagaagtattcttctcttgacacttccatcttcatctctctctcctttatccccagacactcagatcccccccaatcagatatgctccttctccccctgccacaagtagaagcttttctctccaaatggcaaaagctccaaaattgcctgtcatctcttttcctacattatgaacattttgctgatctttatttagctgatgtccttgttttccccctgttaacaagctcattcctcctttatccttttgcagaaagcattatcgcctttctagtttggtggttaaaaccacaggcaatagaaagcaagcaacacacctgagttcataccttgtctatctcacttaaagctgtgtgattttgagtgataaattaaactctgagctgcagctatctataccattcaggtgaaagtaatacctaccttttaggcatgctataagactcagctgagacaatgggtgtaatcaagttagcacaacagctgtcacattgtgagcaattaataaatgaaagatcttattattatactatttcctcaatctataaatccttccctacttccagccacatgtccaaatcctaattattttttaaagtctttctcaagtctcacctgttctctaaaccttctacaaaccttattctccccttttcgtgtatttcttgagaactctaacataaattcacattggtataacttctagtatgggacacatcatgatcatttagtaaatcctttacttaattaattgatgatgaaagagggaaagaaaacaatagcagatgctgcggatacctgaccctgcttccccttgacccacctgagttgttttgcagctgtggtgggcagttttacaattcctactgacagacatgttccacacggctctgcagaagttccccagagggatggagccccagctgcccgcaacagtattccactcattaacatgcacttgattggctttgctcccttccgtctcatctcccttatacctatttaagcttcctggaatcacctcccagataaaccacctgcatcaaagctcttgtcttagattttgcttttggggaaacccaaataagacaagaactaagattactgagtccatattgtatgccaagcaccatgttagtcactctattttcattatcttcttttatattctcaacattcttgtgggattaggtattattatactcattttgtagtaacaaattagaaagtcaggactcaaaataattaagtgactcactcagggaaaatctaacaatctaaatgcttcgggtgctcatttctgaattaataattgtatacaaaaaaaagaataaggcattttagaataaagctttaaaaacattacagaaaaataggtaaaataaagctctttcttagatttagccaaaacatgacaaactaaggtatagaagcagaatgtaatgatacggggtctggagacatcgcacattgaacactttgttatttaaatgccttatttgtagtccacttttttattctgggaaatagagacgggaagatacggcagctgagagctacccgaatgagtcagatttaataagaaggtattagaagatgaaaccaatttggcctctatgacattggagaaagaattagacaaaggggacttttgtgagtgctagatactaaaaagacaggcttagattgagaaaaaatattgagaaaaaattttcttccatattgaaattctcatacagaattgatttttttatcttcccaagtcacacaggccatatacataagagtgattgaattataacatgaaatgtcaaatccaataaatgtggggagggagatagctgggcaaatgttaaaggaagcaaaggacaaagagatatgtttccatattcagaggcaagcattagatgacccaagcacatttcccagatttttaggaactgtattagtcaaattggagaagttagaaatattcagctaaaattagaaagcatttcctaattgacctaatatacgttactctctgtggtcctatggtctagctatcaagttaagtttataattcttaaaaaataagggtaatgtgtttgagcccattgtcttcatagaaaatcaagtccttagttttcatgaagtttgagatcacttgatacttctattaagctctgagattatcagacagaacttagggtaagtctttattacatattgcctctgcagttgctattgtttgcctttataatgtcacatgaaatcataaagaactagtaaatttgaattgggcattatagtttcatccctttgaattttttaatggttttcacctatgcataacccaaaagtattacatcatattatttactgtaaatgtattaggtctgctatgaagtcatttagttttgaaccctagaaaaagtgacttctagccaactgagcttttataatgtgccctctaattcacattttaataaatgtcattttctaagtgcattacctcatgttttggctacaacccagctgaatcctgagagaataagagaaatgtgctttctgactggttcatccatattttattttacttttcattaagaaattactctttgaagaaaatcaataatcttctgtgactgaggggagaggttagtgtgttgcagtggtgcattctaatatctcaaatcaaactgcctttagctggcttttgctgatagcatatttgtcctttcttgttcctgcagcctgggtacatggggaccccagaagagcagcctatcctacagacagccagggccacttttgtggccagaagggcactcccaatgagtgagtatggccacctttgctttgtgtgattttactgtctaaactggaacctagatatcacttttacagtaatcctaccagacttcttaagaagatttaaattcataaaggaagccttccctcccttttttctaacagatagctataagcagttgggaagttttatattatatgtcttaagacatgatgtcagtgttatgcagcattttattagaatgcatgaagactctagttataaaaatataattataatgaatagattggaccaatgattttatcagaagctatattttaaaatgccttataaatgggctattagaagactgaggtatgagtagctgctacaaagctagacagtccaattgttaagattatttttgtcacagtgtctactgataaatcattccacctttcgaagtaaggggcacacccagaaggtcttcaatgtttggtatccttttccaagcaacctggctgctgtgggcaatgtccctgggtagctgaaacaaacaaggaagaatgttccatcaaatttctttctaatggtaatcataacagaagttttcatttctgaaagcacattgtctatttttctaatctaagaaaataaaccacacacacaagcagccccccataaatctcatatttttagaaaaccttccctcttctctcactggtccatttctctgtggaaacctggggtggttgctggatcttttggttcttcaaaaccaatccagtttctataaaagctggctctagatggttaaaaaaaaaaccccaaagcaaccacacccctgacttccaagaacaacaacaaaaaacatagctgaggacacttcagttatgttgtctatgctgcccacttgtaactatggagcatattattccaagagatatacagattttaagaatagatgctcagtaattttaaaaattgacaacaaaaaagtccaaaatcagatgaattcacacctgaattttaccagatattcaaagaattggtaccgatcctactaaaactattccgaaagatagagaaagaggggctcctcctatatcattctaggaagcccgtatcaccctaatattaaaaccaggaaagaacataacaaaaatgaaacctacagaccaatatccttaatgaacatagatgcaaaaattcttaacaaaatactagctaactgaatccaacaggacatcaataggataatacatcaggatcaagtgagtttcataccagggatgtagggatggtttaacatatgcaagttaataaatgtgatacatcacatacacagaattaaaaacaaaaattgtgtgatcaatctcaatagatgcagaaaaagcatttgataaaatctagcattgctttctgatgagagccctcaacaaaaaggaatagaagggacttacctcaaagtaataaaaggcatctgtaacaaacccacagccaagatcatactaaatggggaaaagttgaaagcattccccctgagaactggaaaaagacaaggatgtctacatgcaacacttctattcaacatagcactggaagtcctagtcagagcaaccagacaaaaaaagaaataaagggcaagttggaaaagaggaagtcaaactgtcactgtttgctgatgatatgatcacatagctagaaaactaaagactcatccaaaaggctcctagacccgataaatgaattcactaaaggctcgggttacaaaatcaatgtacacaaattagtagcactgctctccatcaacagtgaccaagctgagaatcaaatcaagaactcaattcctttcacaacatctgcaaaaaataaaataaaatacctaggaacacacttaaccaacaaggtgaaagatctctacaaggaaaactacgaaacactgctgaaagaaatcctagatgacacagagaaatggaaacccatcctatgctcatggatggatagaattaatattgtgaaaatgaccatactgccaaaagcaatctacaaattcagtgcaattctcatccaccaggattcctcacagaactagaaaaaaacaatcctaaaattcatacggaataaaaaaagagcccacatagccaaagcaagactaagcaagaacaaatctggagacatctcattacctgacttcaaactgtactttaaggccatagtcaccaaaacagcatggtactgatataaaaataggcacatagaccaatggaaaagaatagagaacccagaagtaaagccaaatacttaacacccaactgatctttgacaaagcatacaaaacgtaaattggggaaaggacatcctgttcaataaatggtgctaggaaaactggcaagccacatgtagaataatgaaactggatcctcatctctcacttaatacaaaaatcaactcaagatggatcagacttaaatctaggacctgaaaccataaaacttctagaaaaaaacattggaaaaactcttctggacattgatttaggcaaagaattcatgactaagatccaaaagcaaagcaacaaaaacaaaaataaaaaaaaaataaaagcaaactggtcatgatacaatatctatcttgtgagaaataaaatattacaagtctaaaaaaaaaaaaaagaaatgggaccaaattaaactaaaaagcttctgctcagcaaaataaataagcagagtaaatagacaactcaaagagtgggagaaagtatttgcaaactatgcatctgacaaaggactagtgtccataatctacaagtaactcaaacaaatcagcaagaaaaatacaaacaatcccatcaaaagtgggctaaggacatgaatagacatttctcaacagaagatatacaaatagccaacaaacatatgaaaaaatgcccaacacactaatcatcagggaaatgcaaattaaaaccataatgagattccaccttactactgcaagaatggccataattaaaagtcaaaaaacaatagatgttggcatgtatgtggtgaaaagggaacatttttacatagctggtgggaatgtaaattagtacaaccagtatggaaaacagtatggggtttccttaaagaactaaaggtaggtctaccatttgattcagcaatcccattactgggtatctacccaaaggaaaggaagtcattatgtaaaaaagacacaggcacacacatgtttacagcagcacagttcacaattgcaaggatatggaaccaacgtaagtgcccctcagccaacaagtggataaagaaaatgttgtatatacacaccatggaatactactcagccataaaaaggaatgaaataatgccttttgtagcaacttgaatggagctggaagccattattctaagtgaagtaactcaggaatagaaagccaaatactgtgtgttcttacttataagtgagagctaagctatgaggacacacacacacacacacacacacacaaaacatgcagagtgatataatggacttaggggactcgaggagggggagactatgaggaggtgagggataaaagaaaacacattgcatacagtatatactgctcaagagatgggtgcgctaaaatctcagaattcaccacctaagaattcatccatggaaccaaaaatcatctgtacccaaaaaactattaacatttttaaaaataatttttaaatgtaaataagaaaagaaaaaagacagattcagaaaatggttaacaaaattcatgaagtagaattatcacaatcaagaaaacccagaaatttaaggagaggggcaaattcctaatcatgtcagggtaaatttataggggactagttgactcctcattgcctgttagagatgactgggctaaattttgatccagggaggtaattcttttaacttcagtaactcagaaaattctagacattgcccacaaaacctttgcaaccttcacactgtgaaggacaaagagagcaccaagtggtaaaagaaaccatacaaatctctcaatctctagttctttaagacagtttgtttttaaaagggcatttgtaacaagaagttttccagacataagccaatgatccacttatgtcaaacaaaaatgtgacagcacaaatttcagtacataatgatctttcaaagataggcttcgcttaatacaaacatgttcattaaagtattattcaaaataataatatattggaaactacacagatactcaacaatatgtgaatgatagtaaattatggcccatcaatttaatgaaatagaatggaaccactgaaaatcatgtatatatgttcaacagttgattctgttgattttcccttacagtttctggggtctgggttatcattgccttcctcgccctgaaaataacattctccaatatttctctagtattttgatggcttccttcttatatttaaatttctaattccctagaaatttatttttgtatatagactgaagtggaaatcaaactattttcccaaattgttgagttaattatttcagaatcgtttgttgaataatatacccatttcctctctgatttctaaaacaattactaaataataaatttatatatttgtttctgaatcctgtaacctgctctaatgtacatttttaagtctcatgattgttttaattcttatgataaatgtgtattaatttaaaattttaataagttactctaaattatatttggactttcagcagtaaaatatttacaaaaatgcaagattttagtcaatattaaaagttttttaagcataagttttattgtataaaatggtgtattagtccattttcacactggtgataaagacatacctgagactgggtaatatgtaaagaaaaaggggcttaatggactcacagttccacgtggttggggaggcctcacaatcatggcagaaggcaaaaggcacgtcttacacggtggcagacaagacagaatgagaaccaagtgaaaggggtttccccttatgaaaccatcagctcttgtgagacttattcactaacagaactgcatgggagaaactgcccccaccattcaattatctcccacgggttccctcccacaacatgtgggaattatgggagctataattcaagatgacatttaggtggggatacagccaaaccatatcaaatggtatcaagggaaaatattggagtaaatatatcatgatagtaacattattataacaatgtgaaactatcataaaaccagacagaaagaaatcctattaaaaatataaattttgaatgtgataaagatggatttcaagtcagtagcagaaagatgattattaaataaatagtattgaattaactgaaataccattcataaaaataaaataaaattggatgtttatctcatatcttataccaaaataaacactaaagcattgatgattttgtatataaaatataaaaccatagaagtaacagaagaaaatgcaagggtatatttatagaattatggggttaagaaaacttttctaaagataacaccaaaagcagaaaatagaaattttgaagaatttcaacacataaatacaccttaactcattggaaacaaagttgaaagataaatggaaatctaggaaaaacaaatattttcaacatatatatctgaccaaatgtatcaacaccttttttatatgagctgttcttcaaaatcaaaaagaaaaaaagatcatcctatatgaaagtaggtaaaagtcataaacaggaaataatataatggccaataatgatagaaatatagttcaactacagttaaaaaaagaattgcaaattaattaaaatattatttttgtcttataggttgtcaagtaaattttaaaatattaaaatttccggtgttggccagagtgaggagaaaaaatcgcctcattttctactggcagtagtgtaatttgatatttatcagattttataaaatatttatcaaacatataggttctttttgattcagcagttttcatcctagaaactcatctagtggaaatttgcatagatttcctaacgttataggcactatgtaatagtaataataaaatggaaacaacctaaatgtttctcaataggagattgattaaatgaattacggtatagtcaattataaaataccatttaatcattaattattgggtagagatatatttattggcaaggaaatgtgctcatgatatattgttaattcaagaaatgaagttattaaaatggcatgtgtagtataatttcattttgttggtatgtttgtacacttgtatactctatattcacatatatgaaaacatatgcaagaaaaaagtctgaacggatatacatatgcttacagtaattattttcaattatgggattatatttttattttcattctcatatttctgagcccctattatatcccagacagttttctaaaggctgaggttatagtaaaaacaaatgaacaagctacctgccctcatgaagcctacgtttaagttaaagggagattctcaataaaaatgtaaataacaagatagcttcaaatagtgatcaatgctatgaagaaaaaaaacaaagcagatggcctaacagagaatgactggtgtgcaatgggaggtagttaccttgtggttacggggtgagggaagcactctcatgaggaggtgacttctgaactgagatgtgaagaccaggaagacaccagcctttcaaaagccctgggaagagcactcaagccagaggcaataagtgcaaaggtcctgaggcatgagtgaccctatgatacaccaggactagcactagaaggaagccaagaggccaaaacgtagccgataaagagggtggtggaatgaggagatgtctgagaaacaggtagaagtcatattttctgtgtcctatggactctgataaagtatttggattatttataagtgcagagaaggacatagaaaggtgttccaacaagagtgaccgaatccatttaacattttaaaaagaacattcttgctgcttccttataccttcttgagctgtttcaatggttcacaataagcatgtatgcagaaaaatattaagctttttttcatttaaaaattaggccagctagggtggctcatgcctgtaatcctagccctttgggaagccgaggcgagccaatcacttgagcccagaagttcaagactggcctgggcaacatggtgaaagcctgtccctacaaaaaaataaaaataaaaataaaaaaattttaaaaaattagctgagcatgatggagtgcctgtagtcccagctatcaggaggctgagatgggaggatggcttgagcccaggaggtggaggttgcagtgaactgagattgcaccactgcactccagcctgggcaacagagccagaccttgtttgaatttaaaaaaataaaaataaaaataaatataatggcagatatccttatagaatcatgacagaaaattgagtatttttattttcttgtatgtttatgtgcattgcaagtttctaccaaaaatgtgtatcacttttatattcctaccgaattttccaaaattaaataatttaaaaaagaagtaaatatgctgagacaatagattgtcttcataattaaagcccctttaaaagaaaaaaaaaccagataaacattttctcaaaagaatatgtaccctggagtcaaattctgactttacctctagcattgacccatggcatggaacacaacctacctcagtctttatttcctgataatgaagcaaaaattaaatgagagaacagtcatgtaggagaagcatgcattggccttctaaaagcactttcatgttgttgaggtcctccaatgggccagtcactatgcaatatactagagcaaataaggcacagatttcttcttcaagagtctcttggtcttcagagataaagtcaagaaagctatggattcgatctattgtgttcggcgcagtgtgctattttaagtctaaaatatagtgctgacaatctcatctgaagcagccgcacgcaccgtcaccattcctcttcctagtctctggcacaagatcttgatttactgtcttagatacttatcactgcctgaatttatcctggttattaattggttagcttcatttatcttcccgggctgggcccaaagttctttgagatcagggccattctctgtctttttcactgtcatatcttcagaacctacagcattgtctggcattacaatatgtgctcagtaaattcattgttaaatgaatgagaaaaaaggggtaacacagataagaatgatttgctcccaaagtggaggtcagcttaaagatctgatcaggtcctcaacaacactgctaagtgagtctgactattattactattatttggaaatttagaaaactaaaattcagaaaggttaaaatacttgttaaggttcaactgtctattaaatggcaaaggtagcacattctaaccctaagtcttaagctgtttaggttacacacagacagttgcagtgaacttggctttccattttacttgtttaacccaggcctaaaaatcttaaacatagcatagcttgtaaaagtatcattacatgttttaaacaccacaaataaatgtgtgtgtgtgtgtgtgtgtgtgtgtgtgtgtgtatttctatgccaaaatgaaatgcatctatgttaggatgtgtaagaaatttaggcagctctaaaatggggaaacttacctgttagactttaacaattgtcatgatgtatttaagcaatcctttgattcccaactctggaagacattccttaataaccgagcctaaagtccatgtttagaggtggtgtgatatttgagatgtggcttttggccttttgtgctttatctaaccaaaaagactctaggagaaacaccaggggtttttacggtgtccaaagagatgaaacagcgacttcaaaggaaaacggagtgctttgttgttgtgtgtaactttctctgcctcttgagctctgggaaagttgctcatgacacttaggtacagaccttttctttgagatttccacaaaaaaagagaacgtgattgatttttgatgccacctactggctactacaaaaacttcagcttgtaaaggttgtgccgaaattactttgaacattgtctgatgtagcaccattaccaagactgaaatacctggccccatgaggttaagataaggaaacaagaaagattaagaggacaatgctcttctatttaagattttttaaaactgatatgtaatatgtaatatttgtacctatctatggggtgcatgtgatattttgttacatgcataaaatgtgtaatattcaagtcagggtatttagtgtattcatcacctaagtatttatcatttctatgtgttaagaacatttcaagtcccatctcctagctgctttgaaatgtacagtacattgttgctacctatagtcatctttccatgctatggaacattaaaatgtattccttctatctaattctatgtttgtacccattaaccattaacccattaaccagcctctcttcactccccagcccctgccccagttgcatatgctttcagtttgctagtattctgttgagaatttttgcatctatgtttatcagggatattgccccatagtgtttttttgtttgtttgtttttatgtccttgtttggttttggtatcaaagtaatgctggcctcacagaatgacttataaagaattatctcctctccaattttctggaatagtttgaagagaagtggttttaattcttctctgtaagtctggtaaaattcagcagtgaaaccatctggtcctgaacttttctttgtttggaaactttgtatcactgatccaatctcattatttgttattggtctgtttggtttttctatttcttgattcaaccttggtaggttatatgtgtccatgaatttatccatttttctagtttgttggtgtacagtttttcataacagtctctgatagcgtttttcatttctgtggtatcagttgtaatgtctcctcttttatttttgattttatttatttgggtcttctctctttttttcttggttagcctagctagcagtttatcagttttatttttttcaataaaaactttgttttgttaattgtttccattgttttttaatctctattttgttctcttctcatttttatttatttacttctactaattttgtgttggtttgttcttgcttttctagttccttgaggtgcattgttagattgtcttcgtacttttatgatgtaggtcattactgccataaattttcctcttagcactgctttttctctattccatcagttttgatacattgtgttttggttttcctttgtttgaaaaaaattttaaatttcctcctaatttctttcttgacctaacggtcattcagaagcatgttatttaatttccatttatttatagtttcccaagctcttctcattattgatttctaattgtattctattgtggtctaagaagaaacttgatatgattttaattttttataatcacacaagttgtccttgagtggcagctgcaaacagaataatctttctcagggaactgtaaacgtgtggcagccctgccactgggcacatggggatcaatgccaatggcttgcactttggccttggtgagagcagccagcagcagcacatggctgcaggtaggggatgtcaatggggctccagggatgtggagacacaagggttgttgagccctaggacaggatgcagtacagtaggttccaggctctgaaaatggtgccttgctattcctttttttttttttttttttaaatactttaagtgatgggatacatgtgcagaacatgcaggtttgttacataggtatacacgtgccatggtggtttgctgtacctatcaacctgtcgtctacactaggtatttctcctaatgctatccctcccctaagccgcaaccccccaacaggccccagtgtgtgatgttcccctccctgtgtccatgtgtgctcattgttcaactcccacttatgagtgagaacatgctatgtttggttttctgttcttgttttagtttgctgagaatgatggtttccagcttcatccatgtccacacaaaggacatgagctcatccttttttatggctgcatagtagtccatggtgtatatgtactacattttctttatccagtctatcactgatgggcatttgggtgggttccaagtctttgttactgtgaacagtgctgcaataaacatacgtgtgtatgtgtctttatagtagaatgatttataatcctttgggtatatacccagtaatgggattgctgggtcaaatggtatttctagttctagatccttgaggaatcaccacactgccttccacaagggttgaactaatttacactcctaccaacagtgtaaaagcattcctatttctccacatcctctccagcatctgttgtttcctgactttttaatgaccatcattctaactggcatgagatggtatctcattgtggttttgattttatttgtctaatgaccagtgatgatgagctttttttcatatgtttgttggctgcataaatgtcttcttctaagaagtgtctgttcatatccttcagccactttttgatggtgttgtttgtttttatcttgtaaatttgtttaagttatttgtagattctggatattagccatttgtcagatgggtagattgcaaaaattttctcccattctgtcggttgcttgttcactctgatgttaatttcttttgctgtgccaaagttctttagtttaattagaccccatttgtcaattttggcttttgttgccattgctttcatgttttagtcatgaagtccttgcctatgcctatgtcctaaatggtattgcctaagtttttgtctagggttttttatggtttaaggtcttatttttaagtcgttaatccatattgagttactttttgtataaggtaaagaagggatccagtttcagctttctgcatatggctagccagttttcccaacaccatttattaaattgggaattctttccagattgcttgtttttgtcaggtttgtcaaagatcagatggttgtagatatgtgacgttatttctgaggcctttgttctgttccattggtctatatatctgttttggtactagtaccatgctgtttttattactgtagccttgtagtatagtttgaagtcaggtagtgtgatgcctccagctttgttcttttggcttaggattgtcttggcaatgcgggctcttttttggttccatatgaacttttaagtagttttttccaattctatgaagaaagtcagtggtagcttgatggggatagcattgaatctataaattactttgggaaatatggcattttcacaatattgtttcttcctatccataagcatgaaatatttttccatttgtttatgtcctctcttacttccttgaacagtggtttgtagttctcctcgaagagatgcttcacatcccttgtaagttggattcctaggtattttattctctttgtagcaattgtgaatgggagttcactgatagttttgctctctatttgttcttggtgtataggaatgcttgtgctttttgcacattgattttgtatcctgagactttgctgaagttgtttatcagcttaagaagatttggggctgagatgatggggttttctaaatatacaatcatgtcatctgcaaacagagacaatttgacttcctcttttcatacttgaatacccattgtttatttctctttcttgattgccctggccagaacttctaatactgtgaaggagtggtgagagagggcatccttgtgttgtgccggttttcaaagggattgtttccagtttttgccctttcagtatgatactggctgtgggtttgtcatgaatagctcttattttgagatacgttccatcaatacctagtttaaagagaatttttagcatgaagggctgttgaattttgtcgaaggccttttcttcatctattgagataatcatgtggtttttggtcattggttgttatgcgatggattacatttattgttttgcatccctgggatgaagctgacttgctcgtggtggataagctttttgatgtgctgcaggactcagtttgccagtattttattgaggattttcgcatccatgttcatcagggatattggcctgaaatttctgttgttgtgtctctgccaggttttggcattaggatgatgctggcttcataaaatgatttagggaggattccctctttttctattgtttgaaatagtttcagaaggagtggtaccagttcttctttgtacctctggtggaatttggctgtgaatccatctggtcctggacttttcttagttggtaggctattaattgctgcctcaatttcagaacttgttactggtctattccaggattcaacttctccctggtttagtcttgggagggtgtatgtgtccaggaagttatccatttcttctagattttctagtttctttgagtagaggtgtttacagtattctctggtggtagtttgtatttctgtgggatcggtggtgatatcccctttatcattttttattgggtctatttgattcttctctcttttcttctttattactctcgctagctgactattttgttcatcatttcaaaaaaccagatcctggattcattgattttttgaagagttttttgtgtctctgtgcccttccgttctgctctgatcttagtaatttcttgctttctgctagcttttgaatttgtttgctcttgcttctctagttcttttaaatgtgatgttagtgtcgattttagatctttcctgctttatcttgtgggcatttggtgctataaatgtccctctacagactgctttaaatgtgtcccagagattctggtatggtgtgtctttgttctcattggtttcaaagaacatctatatttctgccttcatttcaatatttacccagtagtcattcaggagcatgttgtctactttccatgtacttctgcagttttgagtgagtttcttagtcctgagttctaatttgattgcactgtggtctgagagactgtttgttatgatttctgttcttttgcatttgctgaggagtgttttacttccagttatgtggtcaattttagaataagtgtaatgtggtgctgagaagaatgtatattctgctgatatggagtggagagttttgtagatgtctattaggtctgcttgttgcagagctgagttcaggtcccggatatccttgttaacattctgtctcattgatctgtttactattgacagtggggtgttaaagtctcccactattattgtgtgggagtctaagcctctttgtaggtctctaataacttgttttataatctgggtgttcctgtattgggtgcatatatatttaggatggttactgcttcttgttgcattgacccctttaccagtatgtaatgcccttctttgtctcttttgatctttgttcgtttaaagtctgttttatcagagactaggattgcaacccctgcttttttgctttccatttgcttagtaaatattcctccatccctttattttgagcctatgtgtgtctttgcatgtgaaatgggtctcctgaatatagcacaccaatgggtgttgactttttatccaatttgccagtctgtcttttaattggggcagttagcccatttacatttaaggttaatattgttatatgtgaatttgatcctgccattatgatgccagctggttattttgctcgttagttgatgcagtttcttcctagcatcgatggtctttacaatttggcctgtttttgcagtggctggtactggttgttcctttccatgtttagcgcttccttcaggagctcttttagggcaggcctggtggtgacaaaatctctcagcatttgcttattgtaaagattttatttctccttcacttatgaagcttagtttggctggatatgaaattctgggttgaaaattcttttctttaagaatgttgaatattggcccccattctcttctggcctctagggtttctgctaagagatctgctgtttgtctgatgggcttcccgttgtgggtaacctgacctttctctctggctgcccttaatattttttcctttatttcaaccttggtgaatctgatgattgtgtgtcttgtggttgctcttctcaaggaatatctttgtggtgttttctgtatttcctgaatttgaatattggcctgccttgctagactggggaagttctcctggctaatatcccaaagagtgttttccaacttggttccattctccctgtcactttcaggtacaccaatcaaacatatatttggtcttttcacatagtcccatatttcttggaggctttgttcatttctcttcactcttttttctctaatcttgtcttctcactttatttcattgagttgatcttcaatctctgacattctttcttccacttgatcgattctgctattgatacttgtgtatgctttgcgaaattcttgtgctgtgtttttcagctccatcaggtcatttatgttcttctctatactggttattaaagttagcaattcatctaaccttttctcaaggttcttagcttccttgcattgggttagaacatgctcctttagctcagaggagtttgtcattacccatcttctgaagcctaattctgtcaatttgtcaaactcattctctgtccagttttgttgccttgctggcgaggagttgtgatcctttgcaggagaagatgcattctggtttttggaattttcagcctttttgtgctgatttccccccatcttcatggatttatctacctttggtctttaaagtcagtgacctttggctggggtctctgagtagatgtcctttttgttgctgttgatactgttcttttctgtttgttagctttccttctaacagtaaggcccctctgctgcaggtctgctggagtttactggaggtccactccagaccctgtttgcctgggtgtcactggcagaatcgcagaatggccaagattgctgcctgttccttcctctggaagcttcgtcccagaggggcacctgccagatgccagccagagctctcctgtatgaggtgtctattggcgcctactgggaggtgtctcccagtcaagatacccaggggtcagggacccacttgagaaggcagtctgtcccttattggagctcaaacgctgtgctgggagatctgctgctctcttcagagctgccagcagggacttttaagtctgctgaagctggacccccgaccgccccttcctccaggtgctctgtcccagggagttgggggttttatctgtaagtccctgactggggctgctgcctttttttcagagatgccctgcccagagaggaggaaatctggagaggcagtctggcagcagtggccttgctgagctgtggtgagctccacccagttccaacttcccaacgactttgtaaaaccacctactcaagccacagcaatggcagacaccccttccctgacgaagctcaagcatcccaggtcgagctcagactgctgtgctcaaagtgagagtttcaagccagtggatcttagctttctggtctccgtggttgtgggaactgccaagccagaccacttggttccctggcttcagccccctttctaggggagtgaacagttctgtctcactggcattccaggcgccactggggtatgaaaaaaaactgtgactagcttggtgtctgcccaaatggccacccagttttgtgctggaaacccagggccctggtggagtgggccctggagtgaatcttctggtctgcgggttgcgaagaccgtgggaaaagctcaaaatctgggccagagtgcatgatacagtccctaatggctatttccttaggctaggagagggagttccctgaccccttatgcttcctgggtgaggtgacaacccaccctgctttggctcgccctccctgggctacacccactgtccaactagtcccactgagatgtactggttacctcagttggaaatgcagaaatcaccctttttctgagtagttctcgctgggagctgcagaccagagctgttcctatttagccatcttgccagccaccttgctgtttcttcttagacctcagggaggggtgtgagacccagtagaagctttctctttggagcaatgctgttatgcagtctccaggcaatttcctatgttagtctcagtgcctgagtgggtcaaggggctcacccatggctagaattgcaggagtttgtgttgggaatgtggaccactaggggtctctcacccttttcctgcatcggaaagcctctctaggttcccagctgatcctggctgagcatgctgcctctcttcactctttttccatgccttagctgtttcctgttcactttggctgttgaattctggcattcttgcttaggtgatctattcaaagtgtgattatctacttgttattttggttcttctttgtagtgcaagtgggtactatatgcttctcatcagccattttgaagtccctcccttttaagccttgcatccaattcagcatctatgtgaagcaatagcaacttagttttcaattcactgacctctgacaaaatggcaaaaatatctcacaaatctctttgattgaacttactaccagtatccacacacaatttgtttaatgtttaaaatttgaatcaaaataatatatgcatgtgaaaacaaacaaaatagtaatgaagagtttataataaaagcaatggtctctcattctaggacttttcacccacactttcctttcactgggacaatctcttctctctctggttttagttcttctggcagttggtttttacagaactttaaataataagcttattttattttgtgcttattaagtttagataatatccactgacagtctgctatgggaaatgaatatttctaactcatatacattatcttactgatccccttcacccatgtttggtagttaaattactacttttggattgccttgtggttacttttatgactttaaatagtatgcaatacctctacttcttgttctgctaacttttgtcagtgtctcagctcatctttatgtaagaggatattatcacccctacccttctgtccatcttttcgttccctttcaccttttactttctggaaatactttctataaataccattttacatgatcagatttgtcaccatttatgttcagttctggaacttcaacagaatcttgcatgatgtattggtaggttggttccagaatttgaaaatgattttaaaaacttctgctttgtcataactctacaaactgtattcactgtcaggccattactttcttatttgtaccatgtccttgatatcaaagccaaatctcacacttcattagcagcataggatcatctcacattttagtttgcttcaacatagtgactttctaacataatgttttgtttacccacaaggtttttcttggatagccttcatcagaacaatgtgcttttctgccatctcaatcatactatttttcaggggccccttttccctgaaggtctaccttgcagagctgctgtccttttgctttactcaggacctggtaaattgtaggcctattgcatagctttaattctggggcttctctaccttgttaaattgtctttttctagagttaacagatttatgaaacaaaagcacagaatgcccagttaactttttaatttcatataaataataatttttagcgtaagtatgtgaatttattgtttcctatatcccaaggctgcctctctttctgttgacccacctgttttcatggagaatattctcaattaccttcctaaaaaaagaaagcataagaagtaaacttgctgagttcctataaatgtcttctttgtctcttcatcttttcttttctctttttatatttgattgatggtatagctatagaagtgtagattgaaaaacaattcttttcagaaatgtgaagacattgctccatcatttttgttatccagaatgtctaatgccagtagaattcacatacatcatgataagtattttccttttagaaagtacttaaaatcatttctttattcttagtgttctgaaatctcacaatttgatagaggcctgtttaattctttctttgagtccttagtaagtcctttaatcctgaagaactatgactctcatcagctctggacaattttcttctgttatttctttgcgatttttatcccttccattttttcagttgtctttctggaactattggtcatacctggattcgtctcagtgcctctcctttttttccttctatttttcatctctgactttttgttctgtattttagaatttcttaattttttccatctcttcttttgatttttttttgttttggcaattatattttaatctttataagcctttcttgttctccaattattcttttacaataacatcacatttttattttgtgaataatctgcttaaatttctctgaatatattagaggttttaaagttccctcctatgcccttaattattttaataatttaatttttgtttgtttgtttagtttttctcttttatgttttgattcctcatatatgcctgatgctacataattatctattactaaagaaaaaaggactgggtggtttgggtggatttgctttgctgctgtgttagtcagtcatcttaccaaggaggcctctgcaccatgtggggtgacagggctgtgttgactgtcatattccattacagcatgaattggtggaaagctggatgtcaggcactggctttcaaaacgccatagaacaagcttgtgcaacccacaggtcatgggctccacgtggcccagcatggcattcagtgcagcccaacacaaaatcataaactttcttaaaacattatgagatttttttttgcaattttagttttagctcatcagctattttctggatgctggtattctaagcatagaggtctgggagaaacacagcggttctgatttgcactgaaaatctgtaaagaaactttcgattaatctctctgctttggctacatttctcactctcaactcagtctagcatgtttcatgatttctaacaggcaaattctgtcccaccctccctgtacccctgtatgtgcattcattgttcagcacacttcaatatgcatcccgtattccaaatattgctgaactctcctgtaaaattgtgatcaaatcacatcctccacattcttagcttgtgtggcgaggtttattcatttattggtacttttattattttattccgatgagtctcaggaaagaagagagataggcttaagtgcctgatacatcacctggaactagtagtttgctattgtttctattttgtttcttgatggaaatataatttaagttaaattatgagttacttcctcaattacttctacagaattgctcagctgcaaccaccaccatctactttgcacctaaaaaatctgaggtctggccgggtgcgctggcacatgcctgtaatcccagcactttgggaggccgatgcaggcagatcacctgaggtcaggagtttgagaccagcctggccaacatgccgaaaccacgtctccactaaaaggacaaaaattagctgggcatggtggtaggtgcctgtaatcccatctactcagaaggccgaggcaggagaattgcttgaaccctggaggcagaggtcgcagtgagcagagattgcgccactgcactccagcctgggcgacaagagtgagaaaccgtctaaaaaaaaaaaaagttgtggtcccctgaaatttgagaatatcagtgactgtgatagaatgactatagatttgtgctgaaatactaatgatgattctaagacttacttgaaaaaactttgagataaatattttcaaaaacattatggaattggtctcattcattccaaaacatctgataagtgtctagagtgggccaagtatgaggttaagttctggcaaggtaggatgtaaagatgaataaggtataaaccttacccttgaggataatataatctggtgaataacttgagtttacatagcagtttgcagtttataaatcaattttacctatggcaaactcttggcacttactgatttaccattcacagttttaaatactcccaagggaccccagtgatccaagatatgtataatttattcatttgctcaagtacaaatttgaatcacatgcactgtgagactgtgtggatgatgtagttgactgggtggtgaaatagccaagttagcacttgtagatctcaaagtagtagccttgtacatattgtgtattaatttataaacagcttcttcagccatttgaatttagtggaatacaaacatagaatgggtttatttttctcatatcattgcctttaaaaatgctttttcagatttcccttctcactttgatatttcaggcagattacatagttttcagacactttctgttgttaaaagttcaatgtagtccaatttaagatttcagtttcatttcttccaatccccaagctcaggtttgactctgccaaagaacttggagtgagagagagggcctggcctgctattacttgtctcctctcttcctttctggttctagcttattcattatgctgtgagggatggaaagagaagaaaagggatgatgtgttactttcctagctactgccccttcttactaaagaaaaagcaactggaatatttctgtgcacttactttgctgttgttgttgtcactgtggctcggacataactgaccagccatcaacactcactggggcaggcatccaagggctggctctctcatggggtgcaggtggacattttctgggggagtcctcactgaatagttctttcatgtaagtcatcagctttggtttgccctcctccaaaccctttcagctccatccctggtgattcacctccacagtctcttaatgtcaggtgaggtaccaccagggaggctcaagtccgtttattgactccatatcctattatgatgggctgttttactgctgccctctttctgcctcattgactttttttcaattctcttgtggtctctttgggtctcatttctccctgctcaaatgggcatggaaggctgactagcaggtctgccacataagagacattcaattgaaaaatgagatgttggtctacccctcttactgcatcttcagtctctatgagagattctcttagaaccctctataacttggaatttggaagaaacaactagtcctctcctcagtgaggattgtagggagagttctattaactgcaatcattggttgtatcctgccgactccactgtctctgatccacctccctccccacaatattggcttatgtagacaggtgtaggaagcaggtagaagtgattaaaggatctatccccaatttcttgtggaagactttctttatccttagatttggatcctacttactgattttgagtggtaggaaaaatattgctcaatagcccattacattttgtgctatgcatgtagtcacattaatttactggggagttgacaaagagttaagaaacattcttcctgaatatttagagctgtgtttcttaagatatggtttacagaacactctctctgaatccactggggagcttaggggaaaacatactaattcctgggcccaatatctagacatttggactctcaagggttgggaaagagttgggaatcaaaatgttgaacaaacacttcgggttttccttgtgcatgctgaagttgggcaaccacttgtcttaagtccactacgcattatcttaggccctcccaacactctgtgaagtaggtaggaatagtattatcttcattttactgatgagaaaattgagattcaaaagagaactgtggcttgctaaatggcagagtaatataccactcaaagctaatgataatgaatatcaacctgcttcgttactctgccactggctataattttcagcagagagaaagtatcacttaattcatttatgttttttcagattaccaaagtaatgtatatttattttatgaaatccataaaagcacaaaaaataaactaagcaatataatcccaacattcagatgtaataatgtttcttcatgttatatttgtttttaataaaattaaaatcaaaccatatgttaatactctttagtaacctgcttcctaaaattgacatattgtaaatttcaccatccattaaattagttctttagcattattttcaatggcaatgtaatgttctaccttatgggtatacaaatctatttaagcaatctcctgttgatggatagtttgattgtttcaacattttactattaaaaaaaaagatactttaaaggttaggtacctaagggagagggagaatatatttcagcctctgtagataatgaaaccaatttttaaaggttatttataaaaagtgttcagggtctgaaatgatatggaacatttccatggtcactaaaaagattatgttttctttcttaacaggaacaagaccattttgttttactttaacctgttacgctgtaccagtccctccgtgttgctaaacctacagtgccctaccacacaggtaaggcaaaaggtgcctcactggtagtgtcagccgttctgaacattcttggataaaagaattgagaaattccatttgagttctctgtgtgtgtgcgtgggcagggggttcattatgaatttctagacgatgggaagatataagtatgagcttatatttgtttatatacaatcaaaactaagcagaaattaatcattttagaatcacttaggaagctcgatgattgtcttgtccaaccacttacttttataaataaatatgtgcagcccagagaaatggagtttttatcaagatcaacattgtattaggaaaagtaaagctagctactataactaacaaaccacgtttttcagtgacttcacacaataacatttattttttgaccatataacagtaaaaggcaggtgtctgtggtcagtaggtactctcctctaggctccttccatcttaagggtggcttaagcacttaagggtggctctgctgttccttaaatcctccccatcatatgcatccagcaatgaaaaggacacagtgaggatgaataaaacatcctgctcttaaaagccttggataagaagtttcacacattgcatttccactcatatgccacagacacaaactggttataagtggtcgcatccctcaaagacctaaagacagaaataccatttgacccagcaatcccattattgggtatatacccaagggaatataaatcattctactaaaatgatgcatgcacatgtatgttcactgcagcactattcacaatagcaaagatatggaatcaatctaaatgcccatcaatgatagattggataaagaaaatgtggtacatatacaccatggaatactatgcagccataaaaaagaacaaggtcacgtccctcgcagagacatggatggagctggtggtcattatctttagaaaactaaaacaggaacagaaaaccaaatgccacgtgttctcacttataagtgacagctaaatgatgagaacatatggacacaaagaggggaacaacaggcatgggggcctatcagaaggtgaagggtgggaggagaaagaagatcagggaaaacaacgaatggatactaagcttaatacctgggtaatgaaataatctgttcaacaaaactccatgacacaagtttacctatgtaacaaacctgcacatgtacctctgaacttaaaataaaagtttttaaaaaagaaatttatatgtttctaatcccacaaaaaagataggtcacacccagattcaaggagaaaggaattgagcaatgtagctatgagctgagctgccttttctataccatggaacaaatggaacaagagacacaaacctcaatgaatagttaagtgtgtcttctatagtctacctctctggcctccagaacacacttcttcttcccaaaggagaacccagaatcccatgtagtactgtttttaactcaaagtccagaatctatagatgatgtatagttctctttatcaagtcttgacactacatgtacaatggtaacatggacagaaaaattagaattacaaactctcatttagaaaaggagtgataaatacacagcagtttctggattgtggcaatggagaacagtcttttatttcacctggattgcgttctctgagaagatttccctgtccattgcttcctatagccgtttgcttggccacctgggaggtgattttctgtcctttaacctccaggccacaccattgctgagcactggaaagtgtgctgtcttgaggcccatattgctttgaagctcacttccagttgtgcaagtttcatatcacaaatattattttaacagtgaaaggctttttaaggctacctcatgattttttctagcattacaattacctcagaaacttaatagacttctgacttttttgcttcttcttggttccatgtgccggtaactatacccaaagctagtccctaggattagtttgtaaatctgctttatttttttgcttcctcatctccctcaaagacttttgaaatcttacttctgctgagactaaagcccacttgggatgttggtatcttagttctgtgaccacttctacccacgtccccaagggcaaacccttgacctttccagtattaataattgctaccctttgtaatctcaatttctctgatcatcttgattcctctgacattgcaactccaataattcttttaccttactgggacctgcaaaccactgatcctaacccatccaaagtattgctcagctccctcaggtttgcatctctctccttacctgacttagattccacagtctctcagtgaaatcactcctgtataaacattctcaattccattgtcccctttcacttagttgtaagtccctggcaaaacctgactataaaggtagctttcagcctactccatgcctgaatccaggcagctgtgtgttcttggagaaaaacatacaacaaccatttaaattcaggacctaacttcaagtgggccgttaatgctgtctctcaaccatactacagaccgttgtccattctatagcctactgctatagaatttcacaccttttcttctcacctggaacttccaagatctctttcccaatctccatgccagcttctaactttgcttcctgtctcactgagcaagtacaagcattcagaagacaactgttaaaatctccctctctgacatccgtttgcctgcctatcttcgtctatgtcatatactcattctgccttccctctaattccccatgggtgaactgcctgtgcttctaagaccagcccatccatttgtgtattaaatctcatcctcttgcataattaagcacatcactttgaaatgtttttttattatcattttttccttctctactaaattatctccatcaatatacaaagctatggcttgatcattcatcctcttcaagtatttctgcaaatgttaccttcttagtgaggcttccttgaatacttattcaaaactataattccacccagccattcctctctgtctctagtatcctttctatccttttttacttaccatcttataccatcttattcattaccacttattaccatcttacaacaaacattttacttatctgtcatttggttcctgtctcaccctactagaagacaaattgcttaaggacaaggatttttatctgttttgttcactactgttatttctttaatcttaaaaaatttttcccttgatcccacatccccctccagctactggtccatatctctgtgcctcttttattttttttcaaaactcctcaaaagaatagtccacatttatctatctaaatcctttcctctcactctcatccaagcttttatccctacttcaatttcccctaaacaataccatcgacctcaacattattaagctaatggttagtattaaatccacatttacttgatctaacaacagtatttaatcaatcccacctccttaaaatacctttttcacctggcttccagggcacaacattcttctatatttcctcccaactctctgtctactccctatcagtctcctttgatgagttatcttaatctttctaacatcttttaaacactgcatttccctcccacaagaagcttggtccttttctaagtctgtatttacttttttgatgatctcacctagtccattgggtttaacaccatctacttgctgacttctcaaatttacatctccaaataaatctgctccttgagttccagacctttctatccaaccacccatgtgatatttctacatgaatatttggttggcatctcaaatttaacatgtccacaactgaattcctaatctctgactttatccctaaaattgttccccaccccaatgtattccctgtctcaattaatgccagctccaaataccttgatttctaccttatccttgatttctctctctctcatacccatgtttgagctctccttaggtctccctccaaaatgtaccctgagccaaactatttctcaccacctcttccctagttcaaggagccatcacctcttttttagattagttcaaggatctcctgactggtctttctgtttctgtccttgcccccttatcctttgcagtctcttttccacccagtaaccagtgtggtcctgttaaatataagtctgattatgtctcttctttgcttaaatgccccaatagcttcccaagttacttatatgaaaagccaaggtcctaacaatgacctgtaagatccttcactgtctgacccactctctgaccacatatcctattctactcccttttctcactacacttgggtcacactggccatttgttgtactaatacttgaaaggatccaggaactctcctgccttagagacttagactttgctgttctccctacctagagaattatttttccagatgactgtatgtcttgattgctcatcctgtccaagaatttctgcaaatgttaccttcttagtgaggcttctttgactacctcttcaaaattagaatcccacgcagccactcctttctctctctgtagcctcctttccagccttatttatttatcatcttataccatcttatttactactatttattaccatcttatgacaaacattttacttatttattatttcttatatgtctcccactaccactactggaagacaaattgcttgagggcaaggatttttatgtgttgttcactactatttctgtcctcagtgcctggaacaggctcagagtaggggatcagtaaatatttattaaatgaatgaacaaatgactgaatgaatgagagaatgaatatcttcctacttctagttaagaatttttccactgtactctacaaatctatcattcctatgataaaacaaaatatacttgcatattatgcttttttcttgtttcataaatgagttactagatcatcttttcttcataacaaatgtggtgttttaaccttcaatgtaattcactctcccagccaccaaattccaatttgtaactgagtgttaagactatctgaattaaagatagaaatggtaatacagagctttatgcaaagtgccctttgtggtgcacagagaatcagaactgagtcagaattagctcttattagctgagtcattattgactgctaataatgaagacttgcatttagtcttccagacggtgcatctactgatctgagccatatttctatgcacgatgtttttgttaactgctggcatggtccagacatgtgtcacaagcacttaaaggacagactgtgatcaattagaacatccaatctcaatgtgaccttcattttggctaattatatgttgattactactaatctgcaccctatttgaagtgaacaaattggtctgatagagggagaaagtaaagtgcagttgtattgttttttaacagctcatttgtgtctagaatgagatttgatgtgattctccttaacaaactacgttttactattttaattactttcttttatgtgttgcatacacagcacttttctatgtgtagtatacattgtttgtgtgtgctttataaatacagaatcatcatggtctcaattcagaagtacctaccatcatttaaagcctgtgaaagcattagttctttcagtactcacttataaatccatttaagtgtattcaatagaagtagttcagttgtctttcaaagttacatgagtcaattgttgaagtctaaatgtctgtcaagtatctcctaatatgttaatggtttattcagcttggctccaatcagaatgaacttttgacatttgcattgataatcatcttaaccttctaaaagatgtgggtgtgttgcatgctgtgaatgtccctaaattgttcttcagctttcttagaaagatacctatgaagccactaatattttctctgaaggtacatgaatatgcaaatgtcattgtgtgtgtgcatgcacacgtgtggatgagagactaagaaagaggaaatacatgtggaggtgtggatgtggagatgagttgtttgccctgccaaaatttctagagggaattgaactgctattgcttcaagaaaatattaactgtgagagaggcctatacattttgttattctcctgctaacttagctgtagggtccacaccaaatgcctttgtgtacagcaggtacataacccaaaagatggaaaggagatgtcagctaagcagcagtgtttttacctaactgccaatgagttgagctacaatttggccaatgagaataattaccagagtagggagatggagcaagtcagggctgagaaagatttcagaagaaggaactaaaggtgatggagagacttgaaagggttagctgcagctcacatggcttcatctgacttttgttttttattgtaaaaaaaagcaaaaccaatagtgtatctcctctgattctgccttccctctgtggagttactaattggatttcagtcactctgtggtggcttcgtgaagtagcatggtgatctggcttggcactgataggcccccaaagtttattaatgtaaaataattgcaaagatgacctctctgtccacatttagatggtattggtaaaagaccataatgatgattgattgtgccaaatagccttgatttgttagtttcttatggtgataaaaccccagttacattttgagaattgtgtttgagaattcacgggcactaataattattagtgtcataggtgttcaatattcagagaattttaaatcatcattttattcatatttaggaaaggaaggaagattttaaccctgaatatgcattgactacacaagcaatattaatcttaaattatactgtaaaatcataaagtgttttattaaaagtccatctctgtcctgtggtagtgatcacacaaccacatgtctgataaaatggcatagaactacgcacatacacaggcacacagaaacaagtgaatataaaacgggtgagctctgagtaaggttagtgtcttctaactgtcttactctgcttagtgttgctacaaaaggaatacctgacgctgggtaatttataaagaaaagaggtttgtttgcttatggttctgcaggctgtacaagaaacatggagccagcattgcttctgttgagggcttcagctttctgctttccactcataccagaaggcaaagaggagctggcatgtgcagaaattacatggctagtgaggaagcaagagagaggatgagggaggtgccaggctctttctaacaaccaactcttgagggaattaatagattaagaagctactcatcatcacaagaacaaggaggatctgccctcatgaacaccccattaacaggacagatgcttccctgaactataagaacagggtgctgctgcatctatgaacccaaacacctcccattaggccccatctccaacactggggatcaaatttcaacatgaggtatgtggggacaaataaccaaactataccagtaacaatattaatttcctgcttatgatattgtgttatggttatgaaagttcttaccattgaggaaaacagagtgaaaggtatgtgaaatccctattattcctcacaactacatgttgatttacaattatctcaaaatcaaaaattaaaaataagtctatcactgtatggtatcttgttttaacataacatcaatatcaaagagcaaagaatagagattggtaactagtacatgaaatttcattttttacaataagactagaaaattgatttagaccaggttcagtggcttacacctgtaatcctagcactttgggaggctgagatgggtggatcacttgagctcaggagtttgagaccagcctgggaaacatggcaaaaccccgactctgcaaaaaatacaaaaattagctgggcatggtggtgtttgcctgtagtctcagctactcaaagggctgaagtgggaggacacttgagcccagaaaggttgaggctgcagtgagccatggtcatgccactgtctctaaaaaaataaaaaagaaagaaaaagagagagagcaaggaaattgatttaggtttcttagatggaaaacagtgcattgctttttgttatggtggataatttagaagtctagctttataggtagttcctgggtttgttcaactcagttcagttctcatcactttgttcgttcacagatctgtgtctccaagtgcccagaaaaatttttaacctatgtggaaatgcaacttttgtacacaaaagacaaaagctactgggaagactaccgtcagttctgtaagaccactgctaagcctgtgaaggtatgtgtgtttaagcttaaagcaagagaacaatttaactttttttttcaatctcaagtgtaacgtgagaatttgttactgaacaagctcccaaatcttctaggaaatgattagatacaatttcattgaaacagaaatgcatgtgtactgggtgtgcatgcacaccagttatagcacatcattttgtagatttggggtgtcatgaaagactgttatgtctggttaattagcttctactattccccgacactaataaattctctacttggatagacttttactctagaactaggagttaatgtcatttgcaatcaccatttcgttaatgtggtgatgaagccccatagcaacttagtaacaagtagaattttatttccaagcccagtttgataacaactcatttaaaaaaccccaacccttacctaggtttgagatacgtaagagaattctaaatcatcacaatgttaaataatatgaatggtttctaaattagagaagatgttgtttttctagaaaaaaaaacccacaaaaaaatcagagactcaggatatggctaagacaaagacacacacctccaaaggtgttccttgttttcagatgatctggttttattattgttggtccgattgaattacagttaggacagttaagaatgtcaagcaagattgtgtgtgtgataatcttacaattaatattattagtagaagtaatttgaaataaggagattattatggagttaaattttttaaaggacatatttagattcagtataaagtaatcatcacatggcctttgaaatgttaacgttcttccttctattttagtctctcacacagcttttactggatgatgattgtccaacagcgatttttcccagcaaaccttgtaagtggcaactattttaccttagaaacataggatctaccaaaatgctacttaattaagttcccgtatttcacaattgatgagactgaggccaagaatggtcctctgactgcctaaagtcccagagttgattagcaggaaagtcaaaagtagagctcatctcttggctccagccaggtacattttcactggaactctgaatttttgaattttcctttgtaaacatacaagaaaaagattgaatgttgaaagctcagtcagattgatcatttggtgctttggaagcacgcataaacacacacacagatatgctcatatacacccactcctgattttagctgaaaagtttgttcagaaattgcctgaggagtagggggaggacatatacttgtctttatcacttgaaatatttatatatatttggaattagtcaatattttatttctttaaaattatgaactgtatactgtggacaaaatgaggccaggcataggggctcatgcctgtaatcccagcactttgggaggccaaggtgggaggattgcttgagtttgagaccaacctcagcaacatagtgaaaccctgtctctacaaaaattttaaaaagaaattagtgagacatggcaatgtgcacttgtaatcccagctacttgggaggtcaagaagggaggatcacttgagcccaggagttgaagcctgtagttagctatgattgtaccactgtacacaaccttggcaacagagtgaaacactgtctctaaaaaaataaaaagaaaaagaagaaaatgaaataatcactgagttttctttcttatggatataatcctaattacaaaaaaaagctttacattaaaatgtccatcacatttaaagtgtcaaaaagaaaaaagaaagaaatactctactatccaagaccgagaatatttaaattataatgtattcactaaatgaaatattttagaattattaaatataactattagaataacatgcatgtatatgttataatgttaaataaaattcaaactgttactatccttataatgataaacatgtataaattaaaacaaacaaataaataaccacaagaaaacctcttcaaagaaaaagattggaacgaaatataccaaaacattaagtagtcattttgggagtggcaaaactgtgggaaatttcactcttctttcttttttctatttattcactttcttacaatgtatatatttctcttaaaaaggaggaaaggcattagtcattagtttgagtagacagtcaaatacccactgaagtagctaccaccaaacatgtcttacatacttccatcactcttccctgggtcataaaagaccttgaagcaaagatgtaggtcccacagcaacagcacttaccaggaagctctcagcaacaaatgtccatagccaaaatcaatgttataaatttttatgcaaaaggataaatataaatcattagtaacaaaagatataataggtataaaggtataagacatagtctctgcccttacaagtacactttggctaagtacacaggataaagtataccttggggatacaaaaatgaataaggcgtagtccctcacagtctagtgagaaagacattatatgttgtaatcaacttgtgttcctcctaatataagattaaatagcactcaatggaatagtatgcagataataaaatttgttcattaaagagctcataaaaggaaataagtaaggttaaaacaagtaaacaagggaaaacattgcatgtcttgtgtgattttgactctcaaaaaatatttactgtagaagaaagactggaaagaaattccctaaaatgttaatatagtacactgtaggtggaaggactaatttttttaatattttatccactttccaaatatgtaatgaacacatttagtaatgaaagctaacagattgcatgagattatccagaaaaaaatatatgaaataaggtcaagggaccctctagataggaacacttgtatttaagaagtagaaagggaaagagtgcacagaaatatgggaggacatgagagaaactgaccatggaagccaagaaaagagagtttcaatatgccaaggagtatgtatctaccatgtcaaaggctcgaaaaagttaactcattcatcagcaaatattgactgatttctacagtgtgccaagccttgtgctaggtaatgggtttaagcaggatgaagactaaaacatatctggaggttttgacaattcagaggtcattgggatcactgggaggataatttccatgaagtggtggggccaaaactctgattaaactgagggtgtagaagcagctggtaaaggctactgtgtcaaatttgccacagaaaggaagggaagagcagtagaaaggtggggcaggtaaaggaatcagccacgtcctaagtgcagcagaggctagaggtgagcagacaagaaaatccttttaagccaggaaagtcgggaaaggctttaaagagacctatttcttctttccccagctcaactgctttaatatcttcaggtttaaactacatatgaaactgtgcaattcagtgatgcttcttataagaaaaaaaaatatgaaaatgatccatttctgattttccttatttcttcctttaaaattgtggttttaaaatatttttagaaataaatgtgtaaagaggcaaagactccaatcaaaataagaacatagaagattgaacagtgattttacttttcttagaaatcataccagtctacaaagtgtaggcctcttttgatagtttcagaatttccattttcagctccactaaaaaactgttgtaaatgaaaaagctgggagacaaattgttaagaattcacagacaaaaatttagttgttttagtagcctaaaatttgagctggttcttatttgccaaggtattattcactgatccccaattttcaaagttttactcaagtagttcctaatatgtatttttaatagtaaaactaaactcatccagtcatacaagttaatgtggcctttctactaaaatgtgcttaccatgaatggtatgtatcattgttactcttttaaaacctgtgatgtacattttatttatgatgacttgatgaatataccagatgtaaaataatcaagtttagaatgtagtttcagagtgtgatcatatttgctttctagtcttaggaccattagaaaatcatatcatcaagtaacaggcaatgagctatctatattgagcaatttgcatgcctagcaagaatttgattatatataacagaaagcttaagaaagggaggacatcattaaagaagaaatagaaaagtgattacaataattttaatttatttttacagttctccagagatgtttccctgacttctctaccaaaaatggcactttaacaataggaagtaagatgatgtttcaagatggaaatggagggacaagaagtgttgtagaactcgggattgctgcaaagtatgtgtgtttacattctaattttcagtttgatgcattttgttattgcactcgagactaaagcgcctattgggttaagggttataggaaaataatcacatatatatatatatatatatatatatatgaaatatacgtgttactgtgaattgaagagcttgatacatattcattaagaagaacatgtaagggagaacccagaatcatttagaaagaataatgatgcttttttctgttgcccaggctgcagagcagtggggccatatctcagctcactgcaacctccaccttcccggttcaagcaattctccttccccagcctcctgactagctgggatttaaaaaaaaaaaaaggaaaataaaagaaagaaagaataatgatgcttttcaaaatggttaaatctttcattatcaacaggtatagaagtgtgacataaagaaatgtattggtggcatatcaaatttctatgtactaagtataatgcagtaaattccccacgtcccttggctctacacacatggtgctccatgttactggaaaatatatttccctgtgtgcacgcatacacacatgtgcacaaacataaatgtgtacagcatatcgctgcattgctcagttgttgaattatagataaaaaagatattctaaaaatttatttatcttaaaagactttaggagtataattagtacagtgtagttcctgcagatttagaatacaatagcagcttgcatgattttcagaaatataaatctgtgtaaaagaagtctcaaaataatgatacaaatatgatttctttgatataaaagtcaaaaacaagcagagttaaatttatttccctgtgatgcatatataattagtaaaatgaaaaagaaaacttaggaattatcacaaaagtcagaatagtggttactttgaggaagggagaggtgttgcaattggggcacatgaagaaggggttgacaatgttgtagttacataaatgtgttcactttgataattcctcaaattggacagtgatgattgtgaaatttctagtatgtgttccatcatgccttactgtcaggattaggaagaggaattaaagatcatgttcattcttgactatgggttttgcaaattaaaagctaatcttatcatttaaattcatttcttacagtgaggtttctgcaatattgagggaatgttgcatacagtggaaaaggatttgttcaccgttcttgaaaaccatgttctctctgcgtgcagctatagctacctttgcaggtttactgaagtgacattttatgtattattgtggctaggaaaacagtcactactgatagatggtttctgaaaacatgctttcaacagcaccttgcagaatcccttttatcataaaaagaacatttctgtttagtggtcatcaaaaaataattgattttttcccttctttcaatgcagtggtatcaataaacttcttgatgcaaagtcacttggattgaaagtgtttgaagactatgcaagaacttggtattggattctcatgtaagtgaaaacacatagatgtttcttctccagccccattctgattttatctttgtagaactctttcttcaaattttatatttttattcatgaataaaagaaatgtactggtggcataacaaatttcactcagatgtcagttcctgccattttctttttcaggtgaggtgagacagggaaaagatatttggaaatatgcccactgttggcagagtgtaaattttaattttattcactaaagtactaataaaagtacctatgaatatatacttcaagtcacatggagcaatatctgcaggacttctgtatctgtaatactcgtgtgcttctcatcacatgctactgtggaggcaggattgtttctcagattcttttttctaattcgtccctcccttgactttaaaaggatcgttcctatttttcaacacatcccttccacgtaatgattggtattcatcataaccagaagtcattgtagttatgaaagctacatagctacatatgcgatacataaatatatatgtatagataacaaggaggaggagatgtaacattttcaggcataagagttgcattcctagaaagttaaggaaatgtagtcactggactggaatgggtaaatgtgtgacccatttaagactgtcattactgtctggctcttttgtcaccctccagtgcttaaaagctcccatggttccctaatggtcaaagactaaaattaaaactttttcagttacttctaaggccctttaaaacctagcccaatttagtttctcagattcatctccacccaagtttcttggttaacactatattctaaacatatcaaataatgtgcccatccctagactatcaaatcctgtaaatttgcacattctgtttcctttcctggtactgagtcctggacaactgcacctcctttttaaaaatcagctttagtatcatttataacctttattatcttccccagatgtaattacttacttcttcttatgtgttcctcatacccatcatgtgtgtacatgtgtgtgtttacacacctataaatacacacacatacttatcttccatatagcacctaccattctgtgttttatttacctggccctttccctctgataaagtatgaactttttacaatagtaactatgtctaactcatctttgttttcctaacttctatatgggtccttgaatgtagcagcacaaaaaaaatgtggttcagggaagagtacaaaaaacactagtggagcaagatagatgcatgtaactatatgatgcataataaagtctaagttgtattttgtgtgagatactagtgtgtggtgtttagagctgtaaaattagatcactttatgagattttactcattttgatgctttgtcctaaacaattacagtaattactgttagtatgttaggatttatctccagcagagattgtagtctattctcgacagtatttaaattgattctcctattgtcagacccaaatgtcactagataatttccacgcttcttcttcatttggctttttcacacctacctgaacaagtgtacattatgatagattatcctgcctacctcacccccaaaacacacaatgaaaccctctccacccaggcaccactcataagagtaaaacatgaacatctccctttattttcaattcttctgctcttatttattttataaatataaatctaaagtattgatacgcttaaaatagctgtattttttgttttttttcctctgacatttctgaatacttcccttgggctaggccatggaataatctttcaatcatattgaatatttaagcattaaagtgtccgtgattttaagagggaatgacttctcaagttaaaagcgcaggctttgcaagaccatgatacttcaatactgtgttgtcatctatccagtgacagtaattattgagattttttataataaaaagataacacttgagacaataacttaataaatgtactacactctgtctgttgctatgtttggaaacttacagatagcaccagacatatcagttcttaatagaacagtcagccaactttccgatcttaatgagttctctttgaggaaattacattagaagactccaatgtgaccttaacctggatatatgggaggaaaagaagcttctctagtagttcagtcaagctctaagaagaaattaaagctgacagaagatagtcgtgctgttaattgcttgataaagtcacatgtccctggagacacagaagccttatcatgattccaaataatggcccacagatcactggggagctggaatagaagtctggatgacataaggcatcacaaactcctagagataattagaccatagtgataatgactacagcattatgggctccggggatggccagttatttttcttatctttctgccccaaaatgattctcttacttctagatagccatattatagaagatttccaccagtcactaagtaaatggaacagaacaaattcatcatgaatacatttcacaatttatgacctagtagataggtaggaagggaaaaaataagacatggcaactgtctccaataaatcaaaattgtagttggagaaattgtatttttccttgaacaatgactgatactagacttcagtttacccaggtacatgaagatgagttctgtataaagtccctgatgatcctattctttcatatgaaagtcttaatggaaatcattgtttacactttttaacattattaatgtttctatagccaggtaaaataaaagaatttaagaataattttgaatagaaaaaaagttttgtcttgatgtttgtaatatgctgtgtttagcacacttgaccactgtgtttgttgtgggttttttctagtggcctgacgattgccatggtccttagttggatatttttgatacttctgaggttcatagctggatgcctcttctgggtcttcatgattggtgtgattggaattataggttatggtaggtatcactcctcttcaaattatcaaatatcagaataatccttttattttcaatcgctgttatcagttaccagaaagcatttgttttcagtggatctaattattctttaccctcaaaaaagctttaaacttagaaaaaatatttcattttgcatatattgtctctgtaactttttcttcctgtatctttggggaaaaaatgctgtcagaacattttactcttttccctaccagcctttggtctcctgcctcatggatactaagaaggaggtaaaaagaaatccttttagattaatgaaaaacatttcagacaacttcttttatttctttaacgtttctatccgatcaaaggccaggtccgaaaagttacagaagtgtgatctatttttctctttcaacttagtacgtttaatccaggtgctgtcacaccgtttaataattggtactccacaatgaagcattgccctctagaggcaagtattccgaattacacttttgtatggagaattacagtactgtctgtgggagctaaataatgtgtgggagctaaataatgtgtgggagctaaataatgagtacacgtggacgtagagtgtggagtaatagacagtgggaacgtggaagggttgacgactggaagggggtggataatgaaaaattatttaatggatacaatgcatgtcattcaggtgatggatacactaagagccactatgcaatatatacatataacacaattatatgcgtaccccataaatttatacaaatacaatttttaaaatcaaggttgaaatctaatcacaaacttgatccccccaaaacaatacatatcaggtataatgtgagctctacatatgaattaaagtgtctcacgtggaacagtatataccacctgtggaagcttcctttcagtcttctaaaaaaggtatgagccaatatattatatgaatgtttgagatgtttctatttaaaagaatgatttcccctacggcaccatttggactgacaacagttttatggtagtagacatcaaaaataacaatctcttatttctgtcattcaatgaagaagagctttgcacatataagaatgcagttgaatctgcaggttgtatagttagcctgtgttctaatccagctccataacatacaactgggtaactttggaagtttgttggtggttaaaagacctggtattctcgtctataatatcagcataataatggtatcttcatctcagaggatcttaaggattaaatgagacaatgaatataaagctcttagagcagtacctggaacacagctgacaatcagtatgcattgggttattgttattaccctcctcattatctccaatgagtttttagtaaatcatttggacttctcaggtgttccctatctgctcctgctgtacggctcctcttgcatcccacctgagcttcttattgagcacagccaggtaacaaataagaggtggatcagtctggtccaggaacacaagaactttcatgccctaatcagaaactgcaaaaaaaaaagttgtttaaacatcttgtttttgtgttcctgcttggagcttaaaataaactctgccctttgccactggagagtctgggcttgtgattcaatcactcttgcattgtcatcaggaaggaaagggcagtaaagtctgctattgacttaactgatgtcttaagtagcaagaaaaatctgagattggctgtagtgcagttttgacaatggcaaaaaggagaaacatggtcaacatataaaaagtgcaggtaaaacaacttaattttcgctccctattgactccctagatagtattaacccaaaaattaatggtgtaggaagtaagcttgacagtaatttactgagggaggaaaggtccagttaggttgaggagtgtcagaaaataagactacatgtaactgacctctgctactatcctggacaattgactttctacatatcatgagaaaccaattttttctactgaaatttcctactgacagcagcccatttactagagcaaataacaatgtggatgtgtcatactgagcagagaaaaagccagactgtttgtgggcaagtgtttatgaacagcaatggaacaattctcattggccagaacaggttaagaggtatacaggagaagacatataacactttggtttatgagcatctatttaaggtatgaaaaaggcacgatcccagattcatcacatattaactgtatgatcctctgcaagcatacagttttctttaattcataggtttctcaatcatataacaggaatatgtgactactaaacaaaataatgcttataaagtacttagattttgctagcatatagtaaatgttcaataaataatgtctatttttgttgttgctgatattattgttattcaggaatattattgaggaaagaggacttgaagtccagagatcataatttttaaaaatctaggacaagagagagaaagcaaagaaagagaaattggaaaatattgtctagactttcacattcactagtaggaggaaagtaaactgtctgaagggccttcttgctatgaaatcgtgacattaaaaagaggattgcgctgtattgttttatataatacattgttttgataaactttaggaaataaaggaaatctcctccaaatgaaaaaaataactcatgagctaaaatcaaagcggggaaccaagcaggaagcactgggtaacccatagcagtgctgggatcgggagacttagacctgagttggcagcagaacaggggatcatacctgaaactcctggagtaagtctggcatcctagaaatgtctaaaatgaccccagtttgttagtaccctttgactgccaaaataaacaaatgtaaatctcctctagatgaaagtttcctcaattaacatcaccaggttttcacagattcagatcaataaagtccgagactacctgacctgcaagaaaacagttctgtgtgaaaatcagtggatactataaacatgagattgaggtctccaagaattcaaatatgggaattaatagatatagaacatgtagctggctgcagtggctcactcctataatcctagcactgtgggaggccgaggcggccaatcacttgaggtgaggagtgggaggccaacctggctaacgtggtgaaaccctgtctctactaaaaatacaaaaattagctgggcatgatggtgcatacctgtagtcccagctacttgggagactgaggtgggagaattgcttgaatctgggaggaggaggttgcagtgaaccgagatcatgccactgcactccagcctgggcaacagaataagactctgtctcaaaagacaaaaacaaatcaagaaagaaagatatagaacatgaaataaccatgcatgaaaggtttaaagaattaaagatagaatcacagccaggtacagtggctcacacctgtaatcccagcactttgggaagctaaggcaggtggatcgcaaggtcaagagattgagaccatcctggccaacatggtgaaaccccgtctctgctaaaaaaaatataaaaattagctgggcatggtagcacacacctgtagtcccagctactcgggaggctgaggcacgagaattgcttgaactcaggaggcggaggttgcagtgagctgagattgtgccactgcactccagcctgggtgacagagcgagactctgtctcaaaaaaaaaaaagtgaattcattcattcatggacatggagtatcatttattaaaggcttgggcaacaaaaataaaaatcaacaaaaacgtccaggcatacatgaagaagagccatatagaacttttcaaaataaaaatgttagattaaaaactaattgataagctaaacagcaaaatagagaattaatgaactgaaatatgaatctgaagtaattaccaaaaatatagcagaatgtaacaaggggacaaaaatatgattgtgtggttcaaagaaatagaaaataggttgagaaaggcctaacatatatcaaccatatttgaaagctcttggctgagaattttctagaaccgatgaaaccatggatccatagatataggaagccctcattatactaaggagagtaaaggaagagaaatccacatctagtcatacattattctgtttattcaacaaatatcaattgaacagctgctgtgtacagacactattttagactcttgatgtacaacagtaaaggaacagactaaggttcttactctcatgatgctcatagcctaagtaatatatatcttagaaggtggttattgctatggaaaaaagaaaaggtagagcaggtaaggggagattgagaatgccatggtagggcaaggagtgaaaatggcagtattagcaggagggctcttttggggaaaatatctaagaaaacacttggaagcaatggagttagacagttaagatgaaggaaaagttccagacagtgggtacagctggagcaaaggccttataacataagagtgtgttgaagaagtggctgagagcttggtgtggatgggtgtactgagtaaaggaaaaaatagtaggagatgaggtcatagaatttatgaagggggcagagccttacagattattataaaacctaagcttttactctgaatgaaacagggaggcaatgtagggctttgggtagcaaagagatgagatataatgattgccctagtccctgtgttgagaatagaccatggtgaggcaagagtggaagcaacgagaccagtaaggagatgattgcagaaatttatatgccaaatgagagaaactcttgagggtggccatacatgcttttatttgtataatagctgtatttcctgatggattgaatgcagctatgagagacagaagaaggagaatgattccacagaaatatatgagatgtaatacaaaaataaaaaataaaaaaaagaaaacatagtgagcaaagaatataaattagtaagcttttaggtaaagctaaacaaactttgcctgcataaaataataattgctttagacattggacactaaaattattattttatgcaggcaaaatttgtttagctttacctacatgctaactaatttatttaaaatgtacataacaaaattattgagcaataattagagtgggtgattattgagtaactaaggtcttgtatttccttgttaacatattgactctaggcttattaaaaaaagaacagattttcaaggtaatctattataaaaatagagtagattgctcaaaaagagtagagaagaaaaatggaatataagtaaacaaacaaaaaatcatcaatttttaaaagacaagaattggaagaaaagaagtatagacacaaagtagaatacgaaaagcaaaattaagaacatagaaacaaatataaatatatcagtatataaagtataaatatgttaaactcaccaattagaatacagagattgtcaggtcagattaaaatatacacatacaaattggagctataaattatttataaaagttatacaacatgtaaggaaacagaacatttgcaagtgaagggatggaaagaatatactagcaatcaataacaaaagaaagtggaagaagacataatatcagacaaaacagattttagaatgacaatgttatggataaaaatgatttagttcactaaaaatatgccaaccctaaacttgttacatctattaaaataacctcaaaaatcatagaattgcaaggataaataaataaatggataatcataaattcgtattaggtataaaccttaggaggagtttttgacgcatctttctactgaacaaatatatcatgatgtcttactgatggacattaaggtcatttctagtcaaaaggacatttaaagccagatgttgccataattatcaagacaaatactgaaaacatttatatcaaatacagtagcatgtttagactattggatccaaataaaatatttgctgtgtaaatatgtgtcttgcctttgcagaaattaccatgctgatcagtttcatatagatatgtatgatgagcacatatagctcctatttcagaaaatcatattttatattattctgtttttctttctttttcaaggaatatggcactgttaccagcagtacaccaatcttcaggaacgcccaagttctgtattaactatctatgacatcgggattcagactaacataagcatgtactttgaactgcaacaaacatggttcacatttagtgagtattttaaaaactggtttcattaaaattgtaataatgagaaaatatctttttgcctaaaggaaaacttgggttggtataacctgttaaatgtatttatcactagtgtcataaaaagtaatgtgtctataatcctctaactacagtaagtggaaaagtcattgaggaaaatttattgtataatctaagaaaatgctaccttacaaggacctcaagccatttgccttcaaattaaaattgtttggttgtagacatttataggcattaacctgaggtctaagaaagatgtttaaaaagaaacaaatgcttgatttttcaaactttttatttatttatttatttatgtatttaattttctgagataggatcttgctctatcacccaggctggagtgcagtggcacaatcatggctaacttcacccttgacctcccaaactcaagcaattctaccacctcagcctcccaagtagctaggaccacagatgtgtgccaccatgcctggctaattttttaattttttgtagagatggggtctccctatgttgcctagcctggtcttgaatttctgggctcaagtgatcctcccacctcagccttctaacatgctggcatgagccaccgtgctggcgtgagccaccgtgcccagcctgaaacttgtttttaaaaaagaaaaaggaaaaggaaaaacaagcaacaatttttcataacaaaacatttaaaccacttataggaattatgagtaataagtatctgaaaataaatttgcatttttgaagtgtttcttcaaggtttttaatttcttaaggatattttttaatattaacaaatgtaaatatttatttaaatgtaacaaaattttttaagcaggatgattttagtgatggttttaatcttatattcctagaatggtgttattgtaatactccttgtaagatttgtgttctttaatcaagattttcaaaataatctctaactacatgttgctttaaaaaaaaatcatctttatattcttgaagttagagagccagacaagacacattcaaggaagcctggtaagaagcccagaaagaacctcagaagggagcaatatcttggtggggcatcatgattacaggcatgcgtcccattcccatcaatttgaaaacttgactttgccacttcattcaaggatactcaggctttcaaggacaagctcatgttaagtcaccaaagcaccctacatttgtttacatcattaggatagtctcctggtgaccaaagtgcagacattttccatataggacactaccttcctgggatcagagcacctggaaagcaagattaccaatcagaagctattttagcaaaggggctcagacagcggtgggagatgctttcctcagatgatgccaaccttgatgacctagctgagcagcacagatgtccctcccagattccttctccaccgcatttagtttttctcttaaaaaaaaaaatactgtatcaaactccaacttcttactgtttggcttctcatttctagctctcatgcagactaatatccttctctgacatcttttttccaaatatgttatggaattgtttcatttataccttttcctttttaactgcaaaaatcagccgtcctcatcaggatcagggaattgcatcctcatcatttttcctgaatttaaatgattccacatctcttcagcaacctgcttactgttgtctattatttctaaaggtgacaaatgtcacccattatgtattgaaacttctagttttactcttggatggatcttagttacgggttctgtgcccacccccggctgtctcataagacccttccacacaaacgccattgaggagatcagaatctgccattggaaaagtaaagagatgtacctttaggaaaatacagagcttaatagaattttcaagtctaggaatactgataaataagcctccgctttcataactcacttttcagattttaattgattacttgctctgtgtttggacagaattctaggtaccaaaaacaaaagcatatatgtgaaattacactcattaacacaaacactgaaagtaggcagagttataaataccaaaattgtaattttatgagttctattttgtgttcggagatggttctattcacatctctgctattaactaactatgaattcgtgtatatctcttagcccccaggtgccagtctcatcctttgttaagttacagttatactaatgactctatagggcatcgaatatatttatattatttactcttattcaaacaaaagaggggatataggatagtcatgtgttgcttaatgagagaaatacgttctgagaaatgcattgttaggcaattttttcattgtgtaaacatcatagagtatccttatgcaaacctagatggtatagcctactacactcttaggctacacgtaatggcctattgctcctagtctacaaacccatacagcatgttactctgctgaatactgtaggaaattgtaatacaatggcaggagtttgtatatctaaacataagaaagatacagtaaagatatggcataaaagattttttaaaatggtacccgtgtggagagtgtttaccatgaatggagcttgcaggactggaagttgttctgggtgtcagtaagtgagtggtgagtgaatgtgaaaagaattactgtacactactgtagactttataagcactgtacatgtaggctacaataaatttattaaaaacttccttcaataattaacctaagcttactataacttttactttataaatttttaatttttttaactttttgacttttataataacatttagctttaatttttgactcttttataatcacacgtatacaaacagctgtacaaaaacatcttctttctttacattctaattctaaaagctttttctatttttaaagttttttttttttttacttccaatatgttttgttaaaaatggaggcacaggccaggtgtggtggctcatgcctataatcctagcactttgggaggccaaggtgggaggatcatttgagcccaggagttcaagaccagcctgggcaacagaatgagaccctatctctattttatctaaaaaattagaaacaaaaaatttaaaatttaaagacacaaatacatacattatcctagacctacacagggtcaggatcatcaatatcactttcttccacctccacatcttgtcccactggaaggtcttcagggacaataaaaaacatggagctgtcatctcctattataattatgccttcttctggaatattcctgaaagacccacctgaagctattttacagataactttttttatagtaagtagtgggagtacactctgaaataacaaaaattattgtgtagtaaatacataaaacaataacaaactcattcattattagcatcaagcattatatgctatacctacttgtatgtgctgtacttttatatgactgtcagcacaattggtttgtttacaccaacatccctccaaacacatgagtaatgcattgcactaccatgccactgggcaataggaatttttcagctccattataatcttacaggactggcattttatatgaagtccattgttaaccaaaacattgtcaggcagtgcatgactgtatgtaagttcaaaagacagttatatttctctaatgtaattattttgagggtgcaattttataaaggcagaagttagatatagagggttttttaacggtgcaatgtcataaagtgactcttacatgtattatctttataggttcattcaaagaagataacaattttagcataatatggttacatgccacaattttgggttcaaattggtgttttaagagaataaaatgtacatgaaaacataaatacatagtataactaaaggaagatgtagaagtgagatgatacattactaagatcttcgtatacctctgggtgaacttctgcttactcggagacagtaactgatgtgtgatgtgtcagaatttcagtgatataataatagaatgaaataatgagctctccatcaacagaactgttcaagcatgagctaaataaccatctagcaaggaggttatagactggattctttcacaagtgggaatttaagtttccattaagttccttgaacaattttagattctgtttctggattttaagatccataccttttactttttaacacttctgaaatcaggatgcatcttaaaattattaaacatttaatgaagtgtttcttcacttttcctaaaaagttattatttaattaaggatatgtcttagaaatgaggaaatataataattgatgatatttggcttcaagtttaaaaaaaactagttcaagctagctgaagagaaaagaaaacgggaacaggctgagaacagagcagatggtatttactgtaaggatatagaagtgcctcgtcaaactcaaaaaagcagaaaggtagctggacttcaaagtttacttggagtcaggaaatgaaagccaaaaagaacccaagatttcctctccttgctgtctttctttatacaactatactttattctttctctgcagattcacttatttcacataaagatggttttgacgcagtttgtataaccttcaattcaagatttataaatttcaattcaagactaaataaatcaagttgactaaactaggttccctcagtttaaattctaatacttatattggccaagttgggttaagtttacaccccgattccatcaatggtgcccatagtgcgaagagtcacaaattaataatgggacagccaagaacctgccctgccagccagcaaggacagttaagtggcattatgaggaaagtgaacagctcaaaacgtgtcttctgtatattgtcttacttaatgaactaaaggtgaaaacatctaaaatagaactacctaaagcagcccttccctttttccattcctattttctaagttctacaagttgtgtgaaatgcttttatggatgagatgaaccctttccaaaagagatgttcaagcccttgctaaaggctttaatctagatttcttaggattttgtgaaagttaatttcgaagattggcatttttggagagataacacttcttagattatgaggtgtcagaattggcagaaataatcataaagttcaatcctagcatttgcagggaaggtttgtttccgtatctacttgtattacagactgattttttttttcctgttcaaagtgataatactctgcatcattgaagtgattgtcatcctcatgctgatcttcctcaggaatcgaatccgagtcgccattatcctgctgaaggaaggaagcaagtaaggcccttaatgtagaaactcagctaaagtgtatcagtcagtaaaatcagtcactgtcccttgcataaatatctcacctattttccttttaagaacactttttgctgggcgcggtggttcacacctgtaatcccagcactttgggaggccgaggcaggctggtcacctgaggtcgggagttcgagaccagcctgaccaacatggagaaaccccgtctctactaaagatacaaaattagccgggcgtggtggcgcatgcctgtaaccagctacttgggaggctgaggcaggagaatcacttgaaccggaaggcagaggttgcggtgagctgagatcgtgacattgcactccagcctgggcaacaagagcaaaactctgtctcaaaaaaaaaaaaaaaagaagaagaagacttttaaaagaaagcatcttccattcaggaaaacttgttcaagttcacactctgtcacttattagaaagatcaccactaacaagtcctttaatatccccaaacctcaataatcattgggtagaataagggtaaaacctatttagtctacgtattagcagtttttgaacaccaaatatgtgttaggagaatgacacatgtgaaagtaagtgataaagtgctatataaaagttagctagattacatgtaatattattttcatactgggtcatatgttcatattaatggttgagatcatttgcaaaactttaaatcaccataattctataaagtcaattatatgctattgccacttctgtctgagtgacataattttctaatagacaggacaattgattctaggagcaccagactatacatttcatatctaaagcccataatttaggaacactttataccaagagtcatttttattttttaaaagttacaaaataaacactaaatctttcataaaattcatgccaagagataataacacctatagtttccacactattccaaaaggtcattcaagaataatactgtgaactttttaataacgcatggaagtaaccgggaaagcattattataaagccaacagcccatgctctctatttagtgtgatggaaactacattgttaatgaccaagaaccaaattatttttaacagtctttaaggattatttgaagaaaattacagtattattatttttattataatagtgccacctgaagtcagtggtttaaatagttaacaagcagttagttaaactctctctccttcccacaataacctatcattagccactgaaaactactgattttctgggtttatttcttaagtagtatgatattgtgcagttcactgtaacttgctctacttgtttcacttctaaatgtgcatttgtgtgagcatatgtgtttgtgttaaagggccagtaaaactgaaacatgttggtagtttgctcagggggtaataaggactgaaataaataggtgtgagaatacagggtaaacctaaggacacacaataattcacttagcagtgtatggagaaaagagaaaacactatagattaaatagtgaggtgaggaaggtagcaaatacaaaaaaatctaagcatcaatgcattaggagtgataagattttcatcttatttctcaatggccatatgaaacagtattgtgtttaatccagtgtcatatgctgaaaagatcatgtaacagaagtcattagaagtgatgcagtcagttagtgaacatttcacaagccatgtcctattagaaaatatcaaagaaattattatccttgataattatattttccaaaattgcattttagaaattatattttcaaatataatttaaatttataatttaaaaatacatttaactgcaaatagacattatattttccaaagaaaaaagaataaggaattacctgaagtgttgctatgtggaaaaaatggtaaaatggtcatttcttccccagaagttagaggatataggttgcaaacaggcagataatgaagaaatttctaataccttgataagaaaatagaataagccatgtcatgtaaaagtaagtacccatcactcaatgtgttcaccgaagggtagtgaacacattctgaagaagtataggggattcttgaattagtggggaattccctcagtgtgacacatgatcttcaaggtcttcttcaattttaaaagtctaagaatctaaacgaaaggaagaaatgccatgattacaatgtatcaaatcagacagtagtaaccaaagggaggaaaatttgagggactttaggcaggagtctaacatgtgcatcggaaaaatgcctcaacgtacttttaaaaaaagtaaataaataaataaaaatgtaaaaccaactgagaatatgccagaatgatcaccaaaaaagagtccgtggttattaccagttttcttagaatcaattcagtctaaagcttatttctagttttaacaattgaatttcaactatttgttttatttcagagccattggatatgttcctagtacattagtctatccagctttaactttcattttgctctcaatctgcatttgctactgggtcgtgacagcagtgtatcctttggtaattggcctctttaaacctcaggttcacatgactactcgtgaaccaggagtttgtgttcagtgttttctatccctgggaagatgaggaatgtactaagaaataactatttttttcccaagctctaaaaacgtttcaatctaccgattgaatttcccctcaaatagttcatattgtagatttgttttattttgtctccacatgatactgctccttagcaataagccaagaaagctcctatacattttactgtttttaaggggccactcagtgcagctggcccacattacattaatctaggcctgaaaaatagatgaatattattaaaatattaggcattttttaagttaatttctcatgcacttttgagttgtcagtattgttttcttgtccatttattttcaatctaccagcaaatggtttatccttaatggagtttattcagtttcttggcgacatcgggggtacctgtatacaaagtcatagctccaggggggcattgtatacatgaaaatcaaacctgtgacccagaggtaagtacaagaaactctttcatttacttacttcaatatagacttctgctgcaattcattttgtagttgtggtaggaattgtcccgaagcagagatcctatacactgatggggacaactatgtgctgaagtggggagtgtgcatcaggtaagcaggagagtatggaaaacagtgggtggaatggagagaaagcactgtatttcctgagcttgcctgccctaccatatacccaagaccatagaaagtaggtatggtcaacaacaacactgataaatgtgaaattatagtgggtgcagattatgagcatttgatgaaaaatgggatactttccagcactcattagataattatataaagtgatataacagaaaatagaggagtaagagcaggagctaacagagaaacaacaggatatgcaattaaggggaagaggaaaacacagggagttgttatcttggagtgatatttaatattatgtccttgtgttcctttttctcaatgcagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacggtaagtttcaagttgaagcctacacctatcttgtcagttacatttagtgtgcttgtaattcagtcttggctcattaattcaagtggcaaggtacaaatgaaatcaaaggtatgaatcaaaattcatggatgcccattggttttgtctggtttcatagccagttttacaatccctacccaagccaatttccttctaaatgctataggttactagagagagaaaaagatagaggaggataccaaatgaaagatcaaggattaacttggctctgtgtctccattgagcagtaaaaacatcctattttatgatgatagactattggtgtcatttatgctgataaagggtaagacagatgtatatggtttaaaatcctctatagagacttttatcaatctaaataagagagtgcaaaagtctctttgctgttaatccttctgcagataccttttacttgtgaaaattattcaattagcatccccttaaataatagtattaagttttaacttattctcattttatttttgtgcagatatcacacaggatccctagcatttggatctttaattattgcattaattcaaatgtttaaaattgtactagaatacttggaccaccgtcttaaacgtaagatttcagatgtcctgacttttgtgaagataataaattgggttgggggttgggggagacctgatgattataacttggactagggtagtaaggatgaaagggcatatttgggacccgttctgttctgaaggaaaaccagagagagcttgctgaaggagttgatgtcaggggaggggagggacagtggtgaataaaagagagaaaaggtgtgtgatcctatttgttaagctgtggaagccagaagaaacaaatttcaaaaaggagattaagaattctgttttgagatgttattgttgagaagcatgatggagatgtcaggttggcagttccaagtatatagttcaggtcaggttaggcttaaaatataaatgtgggtgtcacgggcataaatcttcatacctgatatatattgtttacaaacacataaactttgcttggaatgtaccttaaaatattttattactaatattggaaaaagacttgaaaaggaacaaaaaagctggaagactcatacttcctgatttcaaaacttatcataaatctacagcaatcaaaagagtgtggtactagcataaggacagacatatagaggtaaaataaaacagaaatcccagaaactaactctcacatataagaccattcaatgggaaaagatcagtcttttcaactaatggtgctgggaaaatgggatatccacatgcaaaagaatgaagttcaaccttatcttacattaacatacaaaaattaactaaaaatggatcaaagacctaaacaaaagcacaaaaactataaaactcttagaagaaaacataagatgaaagcttcatgacattggatttggtgattatttcttagatagtacacccaaagcataggcaacaaaagaaaaataaattgaacttcatcaaatttaaaaacatttattcaacaaagaacactaccaagagagtgaaaagacagcccacatgatggaagaaaatatttccaaatcatatgccagataaggaattcatatccagaacataaaagaacttctacaactcaacagcaaaataataagcaacccagttcaaaaatggacaaagaacttgaatagatatttctccaaaaatgatatacaaatggccaatgaggacatgaaaagatgcttaatatcactagtcattagggaaatgcaagtcaaaaccacaatgagactccatacacattagaatggctattatatatatataaaaacaaagaaaaaagcagaaaataacaagtgttggtaagaatgtggagaaattggaaccctgtgtattgctggagggaatgtcaaatgatgtagtcactgtagaaaacagtatggcagcttctaaaaaatttttaaatataattttatatgacccagaaatcctatatctagatatacatgaaaagaattgaaagaaggaactcaaacagatacttgcacatcactgttcataacagcattattcagaatagccagaaggtataaacaacccaaattccaattaacaaatgaataaacaaaatgtgttatgtacacacaatcaaatattattcaaccttaaaaaggaatgaaatgatgacccttgacgacatcatgctaagtgaaataagcaagatacaaaagggtaaatattgtatgattcctcctatttgaagcacctaggagaagcaaatttatacagacaaaaaatataatggagtttactaagagctgggggaataggggaatgagcagttactgttgaagggcatagaatttgtgtttgagattttaaagttctggaaacagcagtgatggttgtacaacattataaattactcagtgccactgaactgtacacttaaaaatggttaaaatggcaaattttatattatgtatattttataacaataaaaaattttaaatctcattttaaatgttgtattatatttattttgactgataaggttcagctgcaaatcattaatagatttaaatatctccttctcataggtacccagaacacattgtctaaattcctacaatgctgcctgagatgctgcttctggtgtttggaaaatgcaataaagtttttaaacagaaatgcctatattatggtaggtagattattttattatttactaagctgcttctttgcaatcccaaaccttgtgtctacattgccctctctaaagtacttttacttcatgcagttgaatttatcactatgctgatataaggcctgtgaatccaatgcatgattcagggatatgcttccctagttgagatagtatctgaactatactttattattaccttcaatatcttttttgagagaaaaaaatattacacactttggaaacttataagtgtgttggataaaaaatggttttgtgtgtctttggcatagtttagtgggaagaaagagtatttaatctatgttttactctgagaagaaaatactttctaattctggaatttacataattttaaagaagggtcttatcctttttatgaatcttgtgttgaaatgtgtggacattgacaatgtttgactgagttttacttgtttcctatggctatatggaaattcctaaatatttttttttaacataagggatccagaaatataattcttctaacctttagaaagctacagtataaccttatgacatttgcttgttatcacagtagcacagggtctggaaaagtgattgaaatagttatggagattcaaacagtcattaatttacctccaatgagagtattatgttaaacctattcatcaataaatcaaatttagtgaaaggtattgggtttccttaagagtaattttttatgtagagactacaatatttaacctttttagcaataaactctagcccaaacattttaaagacagaagccattatctggaatttgggaaaaagagctgcctctgtttaaggctgtctaatcccccagagtttgagggcatacagtatcggaagcacacctgactgtcaatgacactgagagttgtgtagagctgaggacacacagtgtgtcccacaaatacacattagaaaaaagagtggagatagctctacaaatgacaggaattaatttggttaccttcctgtcattggattgtcttttgatcttgttagagtatgttactggctccagaataatagccactgtcttcctcagattgcaatatatggcagaaacttctgcaggtcagcaaaagatgctttcaatctgctgatgagaaatgttttgaagtaagtaatcaggctgcacaatgtaatttaacaatgtagtgaaccttgagcattacatcctttacatgttgttatttaaagtgttggtggcattattggatatgaatattatcttttaacttgatagatttaaatattctctctcataccattaatttattttcatatctgagaattgttgcttccattacccacctgtgtctttaggtccattggcattttttcatttttattatcccctctgctcaagaaattcccccagatgaaccacattatcatctttccccctcccagaattggtggagcctgagtgaacaaaatcagagaacaatacagcatcctcaggactcagggtgtctataggcttcaaatcagagaggctgacaccaccactgcagggctcctgacagccctacaatgccatcttctgtttacattaaaaataagtcagaacatcatccatgagttccaccatcatttcttgcaaaacaattgccaaatacaatttcagcaaagacacaccaaaataaactcatgaaaatttactgccataaatttcaagtaccaagtatattttaaacacagaattatactttctttttttctgatactcagagttgcagttacagatgaagttacatactttgtattattcctggggaaacttctagttgctggaagtataggtaagtaatcatgatgaaaataataaaaaaaaaagtttaaaagatgcttggaaaaactgctttactacaaaaaactatattcttttgcaaaagtataatatacatgttctaccttttcaatgtaggtgttctggccttcctattcttcacacaaagactgccagtgattgcacaaggaccagcatctttaaattactactgggtacctttgctggtaagagctggtgtctgagtcagtacaggctgctataataaaaatactatagactggatgacttaaacaacagaaatttattcctcacagttctgaaggctgggaagtccaagatcaaggtgtcagccaacttgatttctggtgagggtcctcttcctggtgagcagagagacaccctcctgtatcctcacatggtggggagagagagagagattatctctttcatttatcttataaggacactaatccgatcctcctgacctaatcacctcccaaaggtgccaccttcaaatcacattggggcttagggcttcggcaaatgaatttagggggtacacaattcattctgtagcagctgggtattgttgattctgtgatttatcagagatagcacaattttaaaaaggaatagtagaaatagtaatgatagcaaaaattattggtcttactttatgccaacccacattctactttagagactgggttccttggaaataacctgagacagaggattgcatgcggaaggtatgtcaggaagctgtctcctgagatacattggtaagaaagtgaggagggcaggataggtagcaggagaagctgacccatgccgaagttacagctgaggcctcagaattgcaggacattctggcaaagaggctggacctttgtatgctgcatcaggcagtttttggtcatgaactgacccctgcacgagggtataactttgggtgaggcaattccctgcaggaagggcaattgttagtaagggaagcaactgagtcattagcagcctagatttccaacaattgaggatggatgaggcagtgtagatctgggtgaagccctgcagtatctatcataatatattaagtcatttaacccacatttcaaaaatactggcattactcacatttgcctctcccccactgccagttttatctaggagacacagaaaggataattcacttgttgagtgcctgagctgtgattcaaacccaggcagtatgtgctcttaatgcctaacgctttattgccttgggtacaagatactaaaactgacatatttttgctaagtactgggggtggcaggaagaaaatgagcaggtcatcaattatagactggataaagaaaatgtggtacaaatacaccatggaatactatacagtcgtgagaaagaatgagatcatgtcctttgcagcaacatggatggagctggaggctgttatcctaagcaaactgaaacaggaagagaaaaccaaatgctgcatgttctcacttataagttgtaggtaaatattgagtacacatagacacaaagggggaaacagcagacactgggacctacttgagggtggagggtagaaggagggagaagatcgaaaaactacctattggatactaggcttgttacttgggtgatgaaataatctgtacacaaaacccctatgacacataatttacttatatgacaaacctgtacacataccccttaaccaaaaataaaagttaaaaaaataaaagtttaaaaagaattcaaaagaatatttcagaaataaaaacactggcatcaactgattgaagagacacaaaatatcattggcaaaatctctttgcttgatacaaaaatttgttctctctttcttctaaagagctgggcatgtggcaagagtccctggatcactgtgttgagaagggttgttctgttatctggaacacctcttataaactgttatccgagggagaaataaacttctgttttattaagaaaaagaaagaaagaagaaaggaagaaagagaaagagagagagagaaaggaaggaaggaagggaggaagggaaggagggagggagggaaaagaaaagaaaaaaaagaaaagaaaagaaaagaaaggggaaaggaagggaaggaagaaagaaaatagtaccccccaaaaaagggaaaaaaaaggcagttaatttaataaaacttgtttaagtctcagtacaaagtatgcagaagcattatcattgaactttttggtctctatactgaactcttttcccatacagagtacttcaaaactttctcatcatggctttcatttatagctgcattattcttcttctggtcaaagtaaatgacatgttggttctcttcttcatccatttacagacagtcatttttgggtcttacctgattgcacatgggttcttcagcgtctatgcaatgtgtgttgaaacaattttcatctgcttctgtgagtattcagtatgtgtgttttcccccttcggtggataactgaaaggtgagatggtgaaggcccatgtccttagctggcttggggatctgctgttacctggctgcaaccacaaaacgtgtttatctggaaagagatattgcttagtagatgttatttaaaccataatacctgagaaataagtcagatgcagaaagacaaatacttcatgatctcacttacatgtggaatctaaaaatgtcaaactcatagaaacagagtagaggggtgatgaccagagattgaggggtcagtaaaatagagagatgttggtcaaagggtacaaactttcagttatgcaggatgaataaattatggcactcacatgtacagcatggtgactatagttaataatactgtattgttaacttgaaatttgctaagctcgttagtattctcaccacacacacacaaagataactatgggaggttatggacatgttcattagcttgactgtggcaatcattttactatatatgcatatatcaaaacattacacaccttaaatatttacagttgttatttattaattatatctcaataaagttggataaaaaaattatacctcaacaaggcttagagaaaaatacaaaatttaaaaagaaatcttaacagctaagagaatggagtttgcaaagcacagaagagtcaactactgaaatgaagcacaggcttcatggcatactgttagcatgaaattattttgttcatttcttgattttttaagtgaataataatgattggcttctgccatgctttgttaacagaactgaagacgtaacaggactctgggaactagatatgtggaattctttgaggagaggatttataaattctgataaagccaagatgacaaggtggtttcaaggacatatagggccaattcgcactgtgcatcacaatgacaaatggataggattcggagaggagtgcctctaggaaatagttggattaattttgatacatagagttaaaatacttctttagagctttcatcactgacttatacatgatgctcctatagttgcatatgcaactcccatacacaaaatagggttttctttttttggctaggcactgtggctcatacctgtaatcttagtgctttcagaggccaagatggggagaactgcttgaagcccagcttgagaccagcctgggcaacatagtgagaccctatctctagaaaataaataaataaataaataaataaattagccaggcacggtagcacacacctgtagtcctagctacccaggaggctgaggtgggaggatcacctgggcccaggagttcaaggctgcagtgagctatgatagtgccactgtattccagcctgagtaacagagcaagatcctggctctgagaaaaaaaaaaagatttttttaatattagtacctcacttgaaaagtcctggagaacctagtacctagcagaagcttaatctggctttcaccttccatgccatttctttggcaaaccaacagaaagtagagtcagtaagtaaaagagcagaacttgttagctgcacaactacacatcctgagagattatttctctagcacattgcccttaagagaaacagagaacatttactctctgacaggccattactgaacaatccacttgtataaaatttacagtttgcattttagaataacccacagcaccaacttcacactgggatcaagagagacgataactatagggagatatattcaaagaaaacctcctggaaaaaagtctggccttgttttttgtttgtttgtttctgagcctgttaaaatcaattctcaataaccggacaaagaattcaagagaactttatgtactagttagctcttcctctggttgtaaatggaaatgaaatgtttaatgttttcctagtgcttcagtggtctaaggaaagccatctatctacaaaatatcacatgaacaaacagttcaggtatgggatggaagaaggagcacgagtaaggtcaagcactaaaacatggtggacgcagggctctagaatgctcaaagatctctcctctcatctccaacattaaccatgggagcaataactggaaatcactatgtgaccttccccattcttgtagctgaaaatacttatgaaaatttgtctcaggaaatgtctagaacctactagcttccagtctttggaagttttggctaatatgtggattttaagtttggcagttgattttgaattttgacagtaagaaatgttttccaccatctttattaattgccaactccttgaaagccaggtacatcagcttgattcagtgtattgcatgttgacatgaatcatttcctttcagagacacttgtctgtgataacaaagaacaaggaaacttaaattgtgtttctcttcctcccctagctgttactatgggcaacatcacactttgtaaaatattcttcttaaatgatgccctgagccaaattctgaatgtgtagatttatttatttatttattcctattgtcttggctgccagaaaactggtgatttttacaatgcaaaccatttgtaaacacttcatttttagaaacatggaatctttttattattacaaggtactgagattcatcatctcagagtgggaaaaaaataatagttgtagatgcttattaatgtgatccaggccagacttcttaccagtaccttaagagtaataacaagatagatatgttatatacagcagtaatctctccttatccatgggggttacattccaagacccctggacatgccagaattctctaatagtaccaaacccaattgctgtcaattggaacatgtttccgtttatgtcttccatccacaaatgtaatgccttttccatcctaactaagcacttatcatacactgtggccataacttttgcagtttgagatacaacaaaactagcttaaaattcttttttcttcttcacaatttcacgtataaaaaatttgttttgccgggcatggtggctcacgcctgtaatcccaacactttgggaggccgaggccggcagatcacttgagatcaggagttcgagaccagcctgaccaacatagcaaaaccctgtctctacaaataatacaaaaattagccaggcatggtggcaggtacctataatcccagctactctggaggctgagacagcagaactacttgaaactgagaggcagaggctgcagtgagctgagatcacgccactgcactccaggctaggtgacagagtgagactttgcctcaaacaaacaaacaaaaaaccgaagatttgttcttatgtagatcttagcaacctcagtataagtttatttcttattaactcgagaactttcaccttttcacttaaaggaagcattttacagcttatccaaattgccagcaacactaatcttgcaatttggggccattattaactaaaataagggttacctgaacacaagcactgtgatcttgcaacagataactgagaaagctactaagtgactaagggaagagcatcctagacagcaaggtgatgctggataaagggaggattccctgccagggtgggatagagcttgacggtttgaggtctcattatgctactcataatagtacacaatttaaaattaatgagttgtttatttctggaattttgcatttcatatttctggaccttgggtaactaaaaccacagaaagtgaaattgtagaaagcaaaactgggtaagaggggactattgtatagaaataggattaaggacaaaaaaaagcaaaatgttcagcgtctatcatgttccctcttttgcttttcattttgtatgtgaggaaggtcactgtgagcgctagtagaaatctactaaaccaatgacccaaccattcccaagactatagctactatctgctgtgaattgtatatatctgcgggaggcttaatttcatgcaaatgtatccttgtttgtcagcataattctggtgcttcctcccaactagccagcaggtgggtggtcagtgaacatgccatcaatttaatattagcctaagcaaagctgaaaggtaaattaatgtattatgagagtcagaatacattgacattagctttcaaatacaatctgaggaagaccgcaagaatttaggacagggtgccttatagttaagtagaacaagagcaaaactaggtgtcaagaagctgggtccctatctcatcctatttacctcagagcttttgacttcagcgagttgttttatatccctgggcctcagggtgttcgtctgtaacatcggagtatggactaccattagaagtgacttgaaagtctgaaattccattattattctacatttatcacagaattaatatacttcctattcagctccatcccggaggatttggcaatttatatctttctgaaatgaacagttacagaatttaaatatgacacttttttgaagggacatagaatatcttcttagcctttaaagtatcaaaatacatctctctgggagtgggagggatttaggaagtttcagtgtttcctggcagaggttgaggtttcttaccttgcccagaatcagcaagtaaactgcactaatttgtcttatatttgactttctaacactgatttttctgatttttccctgttcgaccctccaatttataaaaatgtgtataattgttctgctgcttctgcttttgcctgctttggctgctgcatatacaggtgaagatctggaaagaaatgatggatctacagaaaaaccctacttcgtaacccctaacctgcatggaattctgatcaagaagcaactagttccccagaagcagaaagagtagaaaagctccaaacagtgtcactcatttttaagtagaagttgtgtaaattaggttgattgtaatttggaaatgttgcttttgagtaatgtgaaatttctgtgcttaattctaagaagtcagcacctggtactacctgaggtgtcaggtatttgatgacattagctgctgtctactttatagacagtggtcccagctaaagatcaaaatgttaatgtcaaacgttttttaaaatctgtagccgagagtgttttaataacttttataactcagcgtgctgtttccattgcagcactttaatagcctttctttttataagtgtatatttgtaaaggatattcaggcaatttttgaaaacactataaatgtgtaattaattagccataaaatattgatttatagttaaccagcatatggtactaaatttgtaaatatggtgctatggttatatttatactgttcaagctggtggacaactctctaaactgtgattaaacttgtattaatggttccctaggaagtatatttcagtgagtcatgtccataacaaacatagatgttaatgttatataggttctacggagagcattactgggtaaaaaatactatggaaccttcagagcccattctgttttagtgaaatcatgtttatattgaagtcgaatctgagttctggagtgtcatttccaacaacatgaacctctgtccatggtgaaaatattctgaacaaaactgaaattgttacataactcatgccttttgtctttaacccaaatttcttattcccactatatagaaaatcaatatgaatttgtttcagaagagtgattatatcttttcatgagtatacctgtatttctagattaaagagattgtgtggctttgttctacagaaggtttgattttgtctcacctttcagtgaggaaagagaaaagaaagacacttcagattttaccctaaggaaatatactgttggcgctccatcatctaatacctttatgaggggcatactgtgggttaggaactctctctctgcagggcttaggaggaaagttgttgccacctgccaccgctggccgcctgaggtttctgatagtcatgtgtaagttttgaatggcagaacaaagcatgaatcagacacacatcttgcctagccatcccctgtgtgcaaatgtgtatgatgtggttaaccatgtaaaaatgcaccccaaaaggagcattgaatcaatttgtattttcttggcttttaccttaaacttgtatataaggattatttatatattgacagaaaggaacatgttgatctgaatatcactcatatatccaagaaaagagtcagaaatgtattgttgtgttatagattgatctaaatacgtattaattatcttcaagtgtagacacctagatttaaactgactctgtggcagattaattaatagcaataagccaatgaatagggaagatttttaatatataatgactaccagcttgttcttggcttacattcttgagattattgtattcaaaagtgtcagttggcttcacattttggcaaagagccttctgcattcttattctccttgaagcataatgcagataatgacaacttatctttctagattagtcttttattattcaacaagacaaaggccacaacaaaggactagtagaatagtgacctctacctgagaatttgttataactatagatgtttgtgctctgcccaagagattctgatatactgtgatttgatgtgagccacgatgtgaattattataaagttctctagttgattctgatacacataaaagttgaaaaattggccatgtgtggtgtctcacgcctgtaatcccagcactttgggagtccaagatggacagatcactggagcctaggagttccagaccagtctaggcaacatggtgaaaccccatctatctttataaaaaatataaaagttagccaagtgtggtggtgcacacctgtagtctcagctacttgggaggctgaaatgtgagggtcacttgagcccaagagatcgaggctgcagtgagccatgatcacaccactgcactccagcctgggtgacagagcaaaaccctgtttaaaaaaaaaaagttgaaaaaatcacttgaataaaataaaaatcaacacataaacaagttgccaatttatattatgagctaacatctagtcagaaaaatattctccatttactacttatttgtgtaattgaaatatgtagaataaaaatgagcattgtttttgagaagatatttagaagccattttcttacaaagcaattaaactaaaaactgtgaaaaaccagggcaatgttcctcaaaatttgcagttgatgtgtttgaaatctgaaatttcacaatttttatttttcaaggctatactatttaaattattgatggcaaaacagaatcaattttaagcaaatatagtaatttagaaagtaaattgaaaaaaagaaggtgaaagttattttctcaatcatgcaactgagagacacgcaatattggcagaatctgacctgttacacagaatgaaataatatcttgctgacataatcacaagggcttattgttttcgcataactatgtttacaataatgttgatgccaaactatgctgtttaaaaaacaacaacaaaaaaaaaacaacaaaaggattttgaactgctgtaaagcgagtatacagcagatggcggtgttacttctcttacagttctgctttgatatttactctgtaccattcttcctcctagtggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttgttggcttgcatttgcatgttttataccaaagcttatactgtactatgtgaagccatcagaagtcgcaagggaattgttaataacataaaacatttttatactaagatcatttgttttgtaattcgtttttaaagagtggcttggatgttttgaaaatactactgaatatgttaatattcttttaaatcttagattgaaaaatgatacattacttaaattgatagctcctaatatatttttaaaattacaactaaaagaagacttcttctgcagggaaaattggtcagcaaagtgaaattaaaaattttaaagtttttcccactctcgttggacagtaaatcagtgaaaggactgccccagttgagagtttgctctctttaagtatagaatgtttcctcttaaacaaattgccaatcatccagcctttactacttagccctctgacaaagtgccttactggctatttaatattacccagcttttatgggcaagtttacaaacattgttttttaaaaaattaaaacctgcaatgtttcgtgattaaaacaagtcttattgcatttgtttcactcttagctcactgattggaaaacatttgtcattttgctctgtttgatatcctcactattatggaatacattgtgcagctaaacaatttcccttgcgcctagtggacattcatgaatgtgtactacacgcaagaagaaacaaaccccgaaagaacacttgttggatttctttgtttttttttttactaaaagagaagttttaaaatgaaatgttttctatagtagatctttgaaaatacaataggtataatactgcatttctcagtgttttacaaagatcagaaagagaaacttctaggaattgcaaagggaaactttactcctcgaaagggtgctcacagatgtcatgtactgaatagctcccttttaaatgatcatttattttcatcaaagcctgttctatatatgccacttcattttctaacttttggtatgaaaaaatcagtttacttacagtatgttaattgtattgtactactataaacaggaacataatttccaattcagttttaaataattttaccagtactactaacttttaaggaaattaattcagttggttactcagtgtttgttacagaaagagtccagaaaagtattcaccctaagagaatgtcaatcatataatgataatttgtgaaagctttgagaatcaatcatcagtaagttactatcagtttataaaatattatcacatttgtttaaatgtgactttagatacttttatgccaaaaataaactcacatgagcacatgacagtctgagctctataatcagtgtgcttctgctgtgcagaaatgttagaaacgtattgtctaaatatctttgataattaaaatgtttaatatttaatgaaatttgttgttacttgttttaaatcttttttcttttaataaagatttaaataagaaat

SEQ ID NO: 70 - DNA, 333380 bp, Homo sapiens
ctttctgccgaagacaccaaggcactgaggaaggatcccttctccttctgttgactctttctatttttatggtaagtgcttacgttgaatgagctgctctgttgctgcagtgaactgaaccgttcgttccccctcttcccagctaagcttagtgaccttccttctgcatttcctctgttttcatggatcttgtctgggatgatccagcttcaaaaatgccaggggtcatttgcctggagtgtttgtctttttatcttttttccataaacgtgagctcttctgctgtgatacgaatataagtgctctgtctttgtccttgaagcagcagccggggaaatgtgttcacgatggtaaactgcagcagcgtgcagggaatctgtggaggatgactgacaaatttgggcaggatgaatcctcagtgtgccaggggcactcactcaggatcagaagggccgggggtgacctgcccacatagcaaactcttccatctttgtggataaagatgagcacacacgtgtgagttatgttgagtctgctgtgggcagctgtgttttctgcacctgcccgtgtgggtctgggatgaccctatatcttgtggggtttacaacttgggcaggaacattctcagcaggaggaatcctgagctggcagacggagtagactgcatgacctcattgcttctttcccttctgagtctcagggtacccagttctgcaaaccatattttacaggctcttcagagagtggtagggcagtgatgacaggaacatttttgagttgacaacatagttttgtcctcctgctaggagataaaatactttgaggttattagaatggttagacttttctaggagaacataagcaggtttctgacgaagactatggatgtggcagattgtttattccagggacattactcttacaatagtgctctaatttttcacctggtctcctgaggtttgctgcaaagagcatcacaacttcaagtctattactggcagcttcttgacgcccaaaggaaaccaagaacattttattagtttcactcctgtgcgttgcaggagtctctcttaacagggattttttttttttttttttggtagcaggtgtgtcgaactattttggtcaaagcatcattccaaagaatagcttcgcagttgtaattctatttagttattttcaagtcttggaccggaggtgggttatcttatttgtgtaggtttttccattctggtccatttcactctagagagggttcttgccaaatgtaattcagtctctgattcataaggtactgaactaatacaatgtgattttttgtgataagtgaggggagagaatgtggggtgaaatttccagtctctcctcctgctctttgggagtttggaatgtaaagttccctaactgcttgctcattttcactacttttatgtcccctgttcatgtggatttttcttgaaatagtggtgatgacatcagacatatgcctttaccttcttctctgggtccaaagtagatgcgtttgttgttgttctgtttttgtttgttttttatttcagtgaagggttccttgcatttgtaaaagcatacgtttaaataaaaaacaagaatttgtagatgtttacatgttagccctgttcaagagtaaaaccagcacagaggttaacagcaaaaaaaaaaaaaattcaaaacaatttttaaaatattatcagcattgcttggcttagctgttctaatatccactcttccctacactcgattgtggttcgcggcaatactgtattgtaatttgactgtcagactgctctgcttcctctttaattctttaatgtttagctgtttactttcatccttaatggtgtgttcttactttgcttaatctttttttctctttttctaattgaaaggatgttatatagtgcctggtaactcaactgaggatactcattaagatggaaagtgttagaatcagcttgggtgtcatggaaatagactcagtatttctcactgcaggcaatttcagaatcatttagaacatatttcattttaattagtagcaactttagccttgagaaaaaacattatttaggtttcctttattttgctaaacagattgtgtacctatgcaatcagaattgtatatatatgtgcaattgtttatatatatgtgtgtgtatatatatatatatacacacatatacaagcgtgtacacaaatgtactgttgtttgtactgtgtcaattgtatatacttaaaaaattgttgtagcatgcccatttggagaacagaaggaaaattcctcagatattgctttaactggcttttttttttttttggtaaggatttccccacttcctagaccccacttccagataatgcctttaagaatttctttgaattgggagagtgcatttttcagcatttccttgtctcacagcatggtgtcatgttaattcctttgcagggtctctgaaagcagcatagaaaactactgcaggaaaaattgataaaagctgtgctgagcggagcctgtagcctcttggtgtgatgaagtcactgcaacattttgtgtgtatttattttgctgctatgccttgcaactgattttgcttgcagacttagcaaattgaagttatttaaaatgggtctggaaacacctagattggtgtagatgcagttgatgcagttattctttttttttttacactctttaattacaactatcatcaaaactgtgctttcactgtttcttttggtggtggtttaatttgaaacttgcagcttaaattataaaccaagtctcccttttaaagtcctcttgccttctgctttctctcttcttcacttttgccattttatatatgtgaacatgcctacatgtacacagacaaactcagacagtgaaaaatgtacaacaattaatgaagagatgattacagcttttcttttagtaaccaaactccaaatgttgaaaccataatcatgtaactgagggaagaaattgtttctgttagtataaatataacctcatacttctgcaggcattcttatcattgaaactgttttccatagttgattaccaggaccagaaatagaattgattttgcattttaattaatgacattctggatctgtctaggttggactgccctcaaaccttgatatgtttactgtctaaaaggtctttgtgttaagagggggagtttatgggtgttataaagtaaaatcatttgattatgtgatacagcttttctttggtaactgaatgaaccatatcattagaatgttggctgaatttttatgttgcttttcccaatattatttagccaatataatcccttttaccatctctttgagccccttttacagagtacaaagagttatgtgcgactcccacatgaggcttcttagagggaagactgttcttcagcagagattcagaactacttctagcaccagctctggtaatctacttggaaaggaacttgcaattcaattggcaactcaggcagattgtataaaataggagaaatgcttcatgagctgtgttgaatactgtatttttgatctgtgcctccctactaaattcatttaggactgtctttactagatcagttttgcagggaaaaaaacatgtcctcagtagcataataatctatccagactgtcataaatgtttatattgcaagttatacttcttaggagttggagggagatggcagaattttggaggagaaccaaatcacagccccaaaataatgcaagacgaaaggggaacattcttcctatgtttagcatttaattctccagtcaggctgtttgctcttaagtctgaagagcgaagaaatgtaaaaacacataatgacaggttttgtgggctttttctctaatagaaatctttaacccttaattaggcatctgctgactgaccttttggtgtgtgtgagccagcagccattcttatagaaagcagacataatgtaatacagtaggaattcagttacttacatctttcctgttggtcccccacaggggacctcctctgagtgtcagagagggagtgagtgtctggagaccatcagagaccacagccagtcacagagagatatcttcaagccccttggattccagttcagcccccaccactaactggctgtgtgactcaaattctgtatctgctacatgaagcttggaccagataatcccagaggactgtaacccagccattaaaaattgtgaagtattaattcacttctatttgctactagatgaacgattatttctaagacaattgacccatattagacattcctggagggagtaggctgtaacttcctttgaccctgcaaagcccccagaactgtgacagtgacgtgagcatcagtgttactcagaaaagtgtgatcatggtacccttcatgaacagggcgaatatgtatatgatgactatctgcttatcctggcacattttggaaagtctcttgtgattatcaaaaaggaccttggccaggggcggtggcccatgcctgtaaatcccagcactttggtaggccgaggtgggcagatcatgaggtcaagagatcgagaccatcctggccaacatggtgaaactccatcttacgaaaaatacaaaaattagctgggcatggtggggcgcgcctgtaatcccagctactcaggaggctgaggtaagagaatcacttgaacccaggaggcggaggttgcagtgagccgagattgcgccattgcactccagcctggcaacagagcaagactccgtctcaaaaaaaaccaaaaggaaccttaaagagcaatttacctaatcctctcattccacagaagttaaggaagtgatatgacttccccaaggctggagactcacatagcacctgggccggatgactttagtgtaaggtgcattcatttactcagaaccctgctccattcccagtgtggggccccttccatgatacacagctgacactgtgccattcattgttcacaaatctgctttgtggcatctgtctcactggtgtccattatttctgggttcatttcatgcagattacgtggctgtaccagtcagagtgagtcatatcaagcaaatgtttatggtaatttgtttatgcttgtgtggaaatgcatttttatgttgaaattctgcttttcctataaacatttaaagaattttacaaaaactatgcatagtttttcccctttgcttaaactatttaaatgatcattgatttctatgtagagggggtgatgtttgtgaattaattccttcaccattcactcatttacctgttacttactgagcacctattgtgtccaccctactgccaagcagcagagatctagtggtgagacagccagacacatccactcctcttgaggagttcagagtctacttatacttcatggagttggttgtcttttcattgtcagccagtgttctatttactgattcacaatttctcaaagaatctggttgaaaaatagtttgcttgggcagatttttttccctgtggttattccattgagaaattcttttcgtagaagggcacctttgctgtcgtggtgacatatatcttccaattttcgaagatattatttttagcttctgattttgtgacctgactgaacagaagagacaaattagctaaacttatttgcactattgttgtgattcatgaaatgacaattcgtgtctttgataaaacttacctgtttcctagaatcttaaactgacagcctggatagcacagtgtccatggaacaaatcacagattaaataccacactcctttgccttgcatatcaggcccataacagtgtacagcccttgcttccttgttctatgtctggttccgaagttccatggaatgctctaggagtaccaaaaccatttgcaatactcagaaatttacagtgctctcacttgcctcagtgcctttgcacatgctatttcctcttctctcttcagactaaactttcaaagcaaatttgatgtcatctcccttggaagtgttttgacacttgccatccttattgacttcttttgcccagagctgagctaggtatactatctctgttgttctgtatccctcaggaccttacagactgtttgtctacttgtctctctctctctctctctctctctctctctcaaacagactttttgtttcttgagggcagggactatatgttctgtacctcaaatcttggtttagtgactgctgtagagcagataaccaataatccttgaacaaacagatgggaatcaccatctaaaacctatggtgctgtcattggcagcttctgctctatgtggagagtttaatttttcaaaccaatgtgactatgaattatactgagaaggataaagagattggcagacatcctgatgtagttcattagaaattctattcaaaaccccaggaaatgtttctgctttcaaatgagtttcagcaaagtaaacaatgaaaatttattaagtgccttctataagcaaagcattgcattaagtaccaaggaatgaaagatttttttttttttttaaaagcacaattcctatcctccagaaagccacaaactagtgagggtttgtcccatgtgtcaatgactggtaatgaggctgactgctataaacagagactgtagtcagctgtatacttgcagataaggcagggggtagaaagggcattctagacagaggggctggcttgagaaggaacttaaagttatgatggtcgtgccagcaatcaggtgactttgatggagcaggggctggggggtggggtggagggaaggtggaaaatgcaaggaaagatgaggaacgttgtgtggggagatgggaatggtatcaggaactctaaatgctgtttattatttttgaaagttggaggatagttaatagggtctggaaaatgccaaatagaaatttgtttggaatctcttctcaggtttaattaaatcaaaagtctgtattctgcagggaaggagagcagttgcgcagtacataactgcataacacgtttttttctcacccatcccttttgcccttgagggtacactttgccattcaaagtcatcacaaggaagtgaagccgggaagtctaacttaaatcaatcagtttagacctgaagggagtttagcattgagatcactgaggtgcctgttaacaaactgtccagggtgtggaaaaccccctgggtctttggtgctgtatttctactgtaaaaatttagttatttttttatttgacaattaactttgtgctatttacaaggaatacagttgttttatgaaccagtgagatatgcatgtgtaagtttgtttcatgtaggtgaaaaagtggcttggaaaattctgtctgtgatagattcaattcatcatcaaaatatgatttctgcttgccttgtccctcctttctttttcctaaaagaatgagtgaacatattcttagggaatggtaagttggtaggttttctgcatctcataattagatctgaccagatgactctccaccttgaaattagtctaaaaagattgaagaatttggaggaagatctctagatatcttgaccagagcatgaaagcaaataaatattgcttgtggagtgagagatgatgtggtagaaaagaagctgcattcattcattcatttattcattcatttgctcactccacaagtacttaatcgagcacgtactatgtttcagcttcctgccttcatggagctaacattctggtcagagtgggagggggagacagaaaaacacattagcaaatacgaagcaagtcagatggtgatcagtgctatggagggaaaaaaaatgaagaatgctttggctgctattatcttcacatttggttctctttaaagttatttaacttatgcattatggttaggttattttcttctctccactcattgtttttagctgcctatttttatattcactttctgacaattctatgataaaccaccatcttgagggtttttttcctcctagataaaagcagcttttgaaataattggagtactgtgaacaaaagttataatgaagcatttacttctggaattgatttaaagaaaagtactacggacatcaaagcccattagtatttttctcaagactaaagttgtcagaatttagaggaacatgggatggaaatggatctgtccctcacttaactctgagaggagcagtttggggtgttctgagaggatgggagcttggagtatagggaactccaaccccgggagcagagaaatggtgggatcacccatgagcagagctcattcagagaagagacgggagtgaattagaaagtgaacatgcaaaaattgagcaaggaatttctctttgggaggaagggaggtagggaggataaaaccagtgagataaatgtcagtgaataaacaacatttacaagaacaaattctgcccaatatagaacatctgagtgagctggttagtggaaatggtgcctcgagataaaaaacaatatttagggatttcccaatattcccatcctatattttgtgggatctttaattcagcatcaatgttccattttactgcaagcaagcctttagtcaatactttctaccttgcttctaaaataattaggatttaaaggaaaatgtctcctagcggtggagtgcctgggctctggggcagacattgtacccatccttactctgccacttactcacctttggaccttgggcaagtgagctggtctccttgtgcatcattgtcctcaattataaaaatgagattaactaattacccctacctcagagttgttatgagtgataaatgaaatagtccatggagagcccttagcacagtgcctgcaagatgattgcattatctaacaattgttaacctgttattaccatgacttgtctctctggtgttagtggtttagagaagttctcacatgtatatatgtattttcccccttagcagagctttttttttttcttcttcaacttttaagttctgcggtaatgtgcaggatgtgcaggtttgttacataggtaaacgtgtgccagggtggtttgctgcccagatcaacccaccacctgggtattaagcccagcatccattagctattcttcctgatactttccctgcccacactgacaggccccagtgtgtgttgttccccacagtgtgtccatgttttctcatcattgagctcccacttataagtgagaacacatggtgtttggttttctgttcctgtgttagtttgctgaggataatggcttccagctccattcatgtccttgagaaggacatgatcttgttcctttttatggctgcatagcattccatggtatatatatacgacatttcctttagccagtctatctttgatgggcatttaggttggttccatgtctttgctattgtgaacagtgctgcagtgaacaaatgcatgcatgtatctttataataaaatgatttatatttctttgggtatatacccggtaatgggattggtgggtcaaatggtatttctggttctaggtctctgaggaattgctacagtgtcttctgcaatggctgaagtaatttacactcccaccaacaatgtaaaagcagtccattttctccacaactttgacagcatctgtcgtttcttgactttttagtaatcacccttctgactggcgtgagatggtatttcattgtggttttgatttgcatttatctaatgatcagcgatgctgagtttttttcatgtttattggccgcatgtatgtcttcttttgagaagtatctgttcatgtcctttgcccactttttaatggagtggtttgtttctttttcttgtaaatttgtttaagttccttgtagactctggagatcagacctttgtcagatggatagattgaaaaaattttctcccattctgtaggttgtctgtttgctctgatgatagtttattttgctcctcagaagttatttagtttaattagatcccatttgtccgtttttgctttcattacaattgctgttggcattttcatgtgaagtctttgcccatgcctgtgtcctgaatggtattgcctaggttttcttctagggtttttatagttgggttttgcatttaagtctttaacctatcttgagttaatttttgtataagatgtaaagaaggagtccattttctattttatgcatatggctagccagttctcccagcaccatttattaaataggacattctttccccattgctagtgtttgtcaggttttttcaaagatcaggtggttgtaggggtgtggtcttatttctgagttctctattctgttccattggtctgtgtgtctgtttttgtaccagtaccatgctgttttggttactgtagccttgtagtatagtttgaagtccggtagtgtgatgtctccagctttattctttttgcttaggattgtcttggctatttgggttcttttttggttccatatgaatttaaaaaatagttttttctaattttgtgaagaatgtcaatggtagtttaatggtaatagtattgaatccgtaaattactttgggcagtattgccattttcatgatactggttcttcctatccatgagcatgagcattgattatacctatccatttgtttgtgtcctctcttatttccttgagcagtggcttgtagttctccttgaagtggtccttcacttcccttgctagctctattcctaggtattttattctctttgtagcaatcactttcttcttcctgtttgtgattaatgattttagggtaaatctttttggagggatctcactttttttttattcagtctcttagatagttattataatttggaatttacttagattttaagtctgtatcatagaacctaaacagtggaattggaggaccatgtggccacaaggtccctgggaggaggacccactagtcacagtaagtgatgttgtggcaggaaaagagaagagtagagtggatgagaaaaggagcaacctaacagcaaatatgatcaatgttctttttctctgttgccattcgggaggatttagggatgaaggctccttaggtggtgtgtagtgtagacaggctacagcttgcagtttcctggagggaatagccaggagagtgtgatttgtataaacaggggcaggtggctaaggaagtatagttaggtgccagtaagtttgtaggaaagaattctaaaagtggaatgcctggttcacagggtatgtgagtttaaaaattctgatggctcttactgaatcaccattaacagaagtgcgccagtttatactcccatcagcaatgaatgagaatgcctgtttcctcacacctatgcccactagcaagcattttgatctttgctaatctgctgggtgaaaagtagcatcttatagtttaatttgagcatcttttcatgtgtttactttgtattttcttcttctatgagctaactctttgttcatgccctttgcaggcccactttcaactattgagttttgattttgatttttaggaggttttttttttgtttcgttttttttttttttttttttttttttttttttttttgtgagacagagtctcgctctgtcacccaggctggagtgccgtggcgtgatctcggctcactgcaacctccgcctcctgggttcaagcaattctcctgcctcagcctcctgagtagctgagattacaggtgcccaccaccatgcccagctaatttttgtatttttagtagagacggggtttcaccatgttggtcaggctggtctcgaactgctgacctcttatctgcctgccttggcctcccaaagtgctgggattacaggtgtaagccactgcgctgtccaggagctctttatatactagaaaaattcacatttccttatgattttttttaccaagtgtttctgcttattttgttatttgtctttgatattgtttatggtatttgaggcataataaatttttatataaagttgtcacatgtttcttttgtactttctgggttttgtgtaataatcagaaaagcctaacccactctgaaaagtcatgcttctacaatttccttttgtatttttatgtaaataaaatcatacttatttgattcataattattttggattagtaatgaaatagaaattccattttattttcccccaacaactacctagttctctccaaacatttcaggcacgatgtgtcttttccttgctggctaggtggtgattcttgagaaagatgatttttacttgggccaaggcaggggtgacatggaagggtatcatcatctatgaaatccccttatgtagttagaactatttttggagagtctgctccattttcttgacttccagtttgttgcagttccacactgtgttaatcactctagttttatgaattttaatatatgatatggctagcctcacccctattacccttttgttccaggattttttttgatcttcctacatgtttatttttctgaataaactttagaaattgtctcattctaaaaaacaatcatgttttggagaaagggttaaattaaatttatagcttaatctagggagagtgttttttaacttttaagctcaggggtacaagtgtgggtttgttgcataggtaaacgtgtgccagggtggtttgtgacacagatcaacctatcacctgggtattaagcccagcatttattagctattcttcctgatgctttccctccgcccctgacaggccccagtgtgtgttgttcctcatagtgtgtccatgagttctcatcattcagctcccacttataagtgagaacacatgatgtttggttttctgttcctgcattagtttgctgaggataatggcttccagctccatccatgtccatccatgtccctgcaaaggacatgatcttgttcctttttatggctgcataatattccacggtatatatgtaccacatcttctttagccagtctgtcattgataagcatttaggttgatttcatatctttactattgtgaatagtgatgcagtgaacattcacatgcatgtatctttatggtagaatgatttatattcctctgggtatatacccagtaataggattgctgggttgaatggtatttctgtctttaggtctttgaggaatcgccacactgacttccataatgtctgaactaattgacactcccatcaacagtgtataagcgttcctttttctccacaacctcaccagtatcctttattttttgacttcttaataatagccattctgactggtgtgagatggtgtctcatttgatttgcatttatctaatgatcaatgatgtcaagctttttttcatattatcgttgccacatgtatatcttttgaaaagtgtctgttcatgccctttgcccactttttaatgggggtgttttacttgtaatttgtttaagtttcttacagaagctagatatagacccttgccagatgtatagtttgcaaaaatttgggagaattttttatgatactgacccaacctgtcgtcacacagggtatatgttcccatttattcagatcttcttttatgaatctccttagttaatgttttaagatattcttcctatatattttggcacgtattttttaaaacattatttgacatggtttataagtatttgtttagtcttcacatatttgcagaggtattgaggagtgaaaaaggaatggaagtgtttctttgacaccgtaaaatagattacctggggaaaaatattgaaactttgcataagtaaatgtaattgattcattttttcttttatctcttctgaccctatatttcgaattgttgatctaactataaaaacgtatttgttttaaatttgcaattgaatttagtaagtgtttttcacacccacaaattcaaagcaccaattgctgagattcttttgcaaagtgttccatatcattgtcttatattaattcattgactattaattaattagcttagtaagcacttaatgaacacttactatagaccaaatgttagaaatatgaagactaataagacatgatccctttcattgaaagatttgctgtttactcagagatggaatgaaatgatgaaaacaaagaattataataatataaggtaatgtgctttacactctgggaggccaaggtgggtggatctggatcacttgagaccaggagttccagacccacctggccaacatggcaaaaccccatctctactaaagatacaagaattagccagatgtggtggcatgcacctgtaatcccagctgctctggaggctgagggaggagaattgcttgaacccaggaggctgagattgcagtcagcagagatcgccccactgcactccaacctgggcgacagagcaagattctgtctcaaaaaaaaaaaaaagggtaatgtgctttcatgaaaatatgtgcaaggcagagttggaacatggagtgggagagcctcaagctgtcctggggcaatcaaagaaggctttactgagcaaccagcatctgaactgagaccattcggatgagttgctgccaggtgggcagatcaggggaggcttctccagacagagaaactagcaagtgcaaaggcactggggcatgaatcagttacaagttattcagtctatggggcttaggagattaggcttagccagtaggcagctgccagatctcaaaggctttatatgacatgcgcaagaggttgtgctatattctgtaggcactggagcaaattgtgagcaagaaaaggtcagattgtagactacataactctggtagccatatggagagcaaagtagaagggtatgggtataaaatcaggaatacaagtatggagattataacagtgggcccagttagagactgttttctcttaaactaggacagtgacattaggaatgacagagagcccctatggaagatttattcattcaacaatcatttattagaatcacctgtatgctaggctctgtgctggatgctaggcatgcagcagtgtgccagacagatatgctccccactcccaaagccatcccattcaaatgggaagagcctgataaggtgatatgtaagttgatatgttaagcagtggtatatgatgaagcagaatgcagcaggatgaaagggaaagggaacatggttaggagtatgctgatcaggatagtcctctgggcaaggtgatgtttgatcaggacatgagctggggagggagggagggtatgagccagggaaatggtgtccaagcacagggaaatggtatccaaaagagaaatggtgtccaagcagagggaacagccagtgcagaggccctgagaaggaactgtgcttggcatggttaaggaataatgaggaggccaaaagggctagagcagagtggtggaggaggtggcttaagtatttagattttatccagaatgagatggggagccagggcattatttttcatacggcagtagcatgatttgactggcagcctttaagaggatctcacctgctgctgtgtggagaatagagggagtcagggtgtaagtaggtcagttacaaggctggtgcagaggtccagaaagggaggtgatgatggaccaggatagtgattctggaggtggtgagaggtggtagaactatggatctgtcttgaacttggtactagaaggatacaggaaagtgtgcataggaagtaaaatgggcaagtgtagattagataactgctaagtgtagattagataactgctaagtgtagacatacaatattttaaagggagatgagggaagtatagccagggagggtcactttagcaagagcagtccatatggtcaataggtcaatatgatgagtacactatcatgaactcttgcaggctaaacttttattatttgtatacttatgagccacactggattgtgtgacatgactaaatagagaattcctgaaattgcctctgggaggatgtattaaatagggtcaatcagaagtacgtaaatggtgtctactcttgagcaataaaatttatagaagccacatctaaatttagctttaagcaatttcggagcctgagaattttcaggaaatagtaatcaaagccctgataatacaagaaattgacatcctttttggactgacatgggagaggaataatttgggcggtcacagaaacggactcatagatcatagatcttgggaatgtggggtcaatgaattaaatatggctgaaaattataaattacctcacatatccaattgcttttagctaaaatcaagagaaagggctttctaaagccgagatactttttttccattagcaaagggttataagatgttctggagacttgagtcaggctagttcccttatctttggaagatattcttgagtgatgcagtgctatcagtttcaaataagtatatttttgtaaatcaggtgatgttatataatgaaactgacatttgtaaaagttttttatggctcccagccaggtgccccttttgtcagaccctgacttttgaaggattttgggctgcttataaggattcagagttcccctgcaaaattgatgttggaaaccatacccacagtctgcgccagtcactgtggactggatacatttccacagtgtgagatgaaatcagaactgaatgagagtggccactgttctcttggccatacctgaccaaaggttctagtttgatgcagattattattctttagttaactgtacagtaaaccatgcacagtcctcattgtaattaggtgggttcattctttcttaattttacctgctgttgtcgtcatgagtcacaaagttgaataactcttcagttattattgtagccagagtgatggataagatagactcccctaaaccatggtagtcgatataaagcttttcttctcttgcccccatagttagcactaactggcccctgttttgtataaccttatacagacttatgtcatagtgctaatgatataccacatgtgtgtacacatatgcacatacctactcacatatacacatgcacacacatatatgtgtacacacacacacacgcgtaattcctcttctctccccccacagactgtagtaggcactttgaatcatgaatcgttcttattttccttttaactattaacacttagctcagcatctggcataaagtaggagctcaaaacatggttgtcgattgaaatctagaactgggttttgcattttcttgttattgctttgttgttgttctgttgattaagtaattctatacctagtttaggtttgaattgctttagagaccctgatgatggtgccttgtgttcttggccacttgattttatgtgacagtcttcagcatattcataactccaagctttacaaaacaggcaatattttatagggaagtagctctgttgcctttctggatgtagaggcagcatgagattataggataaaactccaatatgtttgtatttatgtatatatatattaccttattcatacataataatgtgtatacatacataataatatgaagtaaaagtaggtcagaagtaaagaagaggtgggaacaaaatgaaagcaggaatacaattaaattgcatgtcagaatgacttacatgtaagatacagaggccacctttaaaggctttaagctttcaatcagccagagggaaaagaacaggcttatgggggtaaagataaaccatttgctcaggttgattttaaccatactcttagcaccaacatcagataagaatttctcccaggagtccctatgaagagtacattgtgtttcgttatgaaaatcatcaagctttgcaaggctgattctcataagacaattttgtgttaatagcattgcctcaaggcaaaattttgtaaaagcagtcggcaaggttctgtttaggaatcagttctctgctggtcagtttgactcagggatatgaaaagtgggtggactacttgtctttaagcaatctttcctgtgtattgtttatctcaaataaagctttgaaaattgttttttaacattgaacttgaagtggcactattctccagcaagtaagggcctacagtgtagctactattctgtgtagctagttaaggagagacctggcgtcctagcagtgtcaaatgaaagctggtattagcatccatatgaggaagctgacttgcctagcaaagacatttacctgaatagcaggttgccctccttatttccaggggaagcatgggagaaccaagcagctcagccaggattatgcatagaaaattgtttggacccacgttattgctcagacaaatgggtgatcctctccaagggctttaaataggtccttttggggcagggaacccaaacacttagcaaagtacagaaggtttgaagggaatgaattcccagagtctggattggatgctcagtctcatttctcaccttcccgtttacaatccctctttttccattttagcaaagcaaggcatccttcttatccatctcagatcttactatagtgcattgtgcaggggtgtaaaaacagcctgggcaccaaacagagcagcaattggaaatatttctttgcagagaagtatggtagtgtgaacaataaaagactttccaatataaacatatgctacattgggataaaactctgtggggaagtgggctggatatgagttaaaggagaaaaactagcgatgtaaattttccaactgataaaaaggagcttgagcttggtcagatatcttaaaaatggttgaatgtgggatatgacagttgtgttttaaaacctcaatgtttatgtatgccataaattatattctttgtaatcctataagcttatgatgaagtcaacttaaaacttcactgagttggggcagatcttcagaaggggatacatagctttttgttttgttttgttttgaatctttgggccatgcgtgagcaaacatgtttgaagaccactcatctactgcatgtaatatggctctcaatcagtcctctagctcttgcatcgacctcaagtgttaggtcagcctctagctgtaactcccctccctgttcttaccactactttatatttactttaatataagtctaacagattgcatccatgattcctctaccaaataggaagatctttaattctcgaaaacggtatactatatactctgtagtttccaggaatttttttgtggtgccttatgtaaaggcaaactttaaaaaaattattgagatataatttacatatcatataattcacccatttcaagtatagaattcaataagttatagtaagtttaccaagttgtgaagtcatcatcataaatcagttttagaacatttttgtcaccccaatacgatttatcatgcccatttacgtgaatgttcctatgtttttctaatatttaaggggctacaagttcatatgacaacatgcgtagagagcagtaaggatggaggaaaacaagaggggcagggccagaattttatcatttatggaagcatgagtgctagcatcttctatttttatttttaaaaaaccactctgatgttcttctagtccttatatgtttttattgatacaaatataaccacatgttaaggcaggactctgtctatctcagttttggctaagatcccaatggccaagaatactagattaggttcccccatatcagttacctatttagaacatacaaaacattgtatgggagttagttattgtctgctccataatatgtatgaggttgatgttggggccctggtgaatgtgagggtgggagaagggtactccatcttcacttcaaaccaagtgagaggaatccttattgaacttgacattatctcctgatgggagtttggggacatgaggttcacctgaacctgtggaaggctgtgatgagagctgccgctaagaacaaagtgggagagggggctgcagggagatggccgcaagttggtgggacgaagatgtgtgagattttatcatggatcaggtggatgctctgggatcattttaactttggaatgcactcaagagggatgcctggagggaatgggggagaaacagagagagagagagggcatgagcaagtgcataagtgatggtggggggaatggttatcagttacctaactattctggatacgtaagaatgtagtgcttagagattagacagaaaaatgaaccatttgccatttgaccatctgggagacattattgtatggtctttaaatctgataaacctgaatttaaatctctccctgaccctcagcaagttactgtatttttctgagctttcagagttgtcatggccagtatttgtcgtaatgatataatcattgactttgacaagtcctggaacttgcctttcaaagtatttttgatatttgacactgattgatgagtagataaatatgaatattctgtatagacaacatctatgatctagctagagatctaaaagtcattgttaggtaccataagcgtgtaacatataacattcaatattttgcaaaatccatggtatttcatttactatactgccatttactttcttatttggattacgtaggtgataaatttgtacaagcctgttttcatatactttgaaagtgtgtgaaaataattgtatataaatggtaattctgattttctctagaatacaattcagatttaccagccttcaaataatattattttagatactattgttaataaataatattttttatttagcaaataactttacatatatatgtgtgtgtgtgtgtgtttgtgtgtgtgaatttatgcatatgtatttttccagccaacatgaaagtcttttgaggacaaaattgagtatttgccatcacaaaactataaataacttaaaaatttggcatatttaaatattgcagtaagcaataatacttttatccatttatgcaacttttgtacagaaacagatcttgtagattatcaggtaggatctatggagtgaagtttgataaacttttaaagacaatgaagttaatttttaaaacctcttaaactcaactcttaattattcttaattgtgttctttaatttcttaaattgtgttcccaaagcatttaaaatatataactatcgtagtactgaatgcatggcatagtattatttcattaattcattaatttatttaaaatgactgtagtgaactcgtatggtacaatctctgtccttatggagtctagagttcagtgggatagacgcatgaaacagacacatgagtaatatataattacaaattatgatcactgttatgagttacaggcaaatggcatgagagaataactgtggaagcataatttaattggagggaatgattctctgatgaaagatctgaaagatgagtggtccattatcagttgagaatgggtcaaagaatatttcagatagtgggaacagcatattacaaaggccctgtggtaggaaggagtatgaaatatttaaggaagaggcaaggagtggatatagatgcctcatttaggaggcaatgggaataattcattctggaaatgaggtaaactagacactagattagactagaataagttagtggcagtacagttagaagtgaatggattttaagaaatagtagaaattagagtcaataggacttcaactgtttataaaggagaaaggagaaggtgttgataaataaggctatttgtaaaggtggatggtttggattctagcacattgtactgtgattgttataccataatttatcttctgtgaacattgcaaggaagtttctgcacttattttcaagttttgatgtgtatatttttacaatactgttcacttttctaaacttttcaattgtaagtttcttataattgagaattgttttctctttctttggtatatgtccagagttcttagccctctaaattcagttgttgttgagtaaattttatttttttaaaaaatagagattagaacatctgatttcagatatttaaaaaaacttagatatttatcttgtggggaatgacttaggaacagttttcttgaatgtagagatttgaaataccaatttgcctttgggtcattattttgtaggaatgtgggaagatataaaattcaatgagcaatatgattaggcatttatataattccttaagtatatgctatgtagatctttcaacatatatattaaaagattaaaaaatgcttgattatctggctctggggtatacttgtaaaacttgcctatttgctaaggtcaaaacaggcatgcatgtattttatattctagctttatctatggtatattaataatataactggtttccagcagacacaacctagagtaatccctgcctaggcttagcctagttagagcctagttaggtcttcttgggtttggacatgatttgagatattgaaaagaaaataattgaggagattcaaagcagtattctaatgaagctatatgcaggtttactaaacagccaacttagccatttatctaaaaaaataatatatgtaaaatgtgggttttactgtaatataattaccgagtctccttaccaaaggatgggaaaactttatagccacgagtgacagaaagaaactattgttcagttgttggattccatgtttatgtctgctaaactggtcattgattttcatactgtgaactttcttaacattgccaggtatacagttagaagacctcttatcctaaatgcttaggactaatttcgttggtcagtggaaaaagatggttaaatgagggaatagttaaaacaatatgatacatgcatttcttgaacaatttattttaacctaaaacaaaaattaatttgctaatattttggtgggggctaagggttttacttcaagtaataattcattaatttttttgttttacagtttcttttttgcataatcatgcctggaattcattacctataaggacatagacacttgtgaagacaatcctagtgcagaattcatctaactttaatgaatcatttcattaaagatttcatgatttcccttattattattattacttattattgaatgtatgactcagccttataaagtgtttcctaaacttttagcttattttaaaaatagaaacaccaactttctttttacatttacatttcatttgtttacatggtacttaattaaaattatatagttataataataagtatgaatgacataaaaagttttggaaatgagcacaagtaattcttgttaaacactatagttttaaaaaagtgaagggaaatggaccattgttctaaagattagacaacttaagctatgaggcttggtgagctgtgggtatcagtctttatgtttaataaagggaatggagattgttggctaagttgaggtcaagtaacagagccccctttttgtgctggtttcagcccattacccttcaactttattcactaaatcagatagttacagtgctgcttagaatagctcctgatattaaatagtgtcaataataatactttagcagtcatctctgagcttcatcattataaactagataaataattaaaacaaataataatagaatgtttaatgggagaaataggcactgttgagagaacagtctaagattcagatcatttagctctatgcccagggatgccttactctaggtttgtgacattgaataaattgctaaacctttctggattcagcttccaaatctacaggctggtagttctcaacaaatcgtgattttgcctcccagagaacatttgacaatatctggagatatttttgattgtcataatctggggaatgttcctgatatttagtggctagaggccagcactactgctaagatcctgcaatacacaggacaggtcctaacaagaaagaattatcagttcaaaatttttgtagtgctaaaactgaggatccttgggctagctaatttatgatggtttcttcctcttccctatgtatctatcattctcaaacttaggctgatcatatatatatgtgtatatatatatgtatgtgtgtatatatatatgtgtatatatatatgtatgtgtgtatatatatatttctattttaaataacctgagtaatgacattagatgaattttttttgtctagtaggtgtttaaatgatgcaatagtaattttcaatgtcttatataacataaacagagaagaataaatatagccaaaatttactactctgtactttttctaattcagcattcccaaatgtaagttaaatataactgtagaaaacccacagtagattaaaatatttattctttcagtaaagggacagtttaccaatgctgtcaggtagataggtaccagcaatatagataggaaaggggaaaagctatgtaatgttggagagtttaaatactgtaattcagttgaaaactatatttcagctaatagcaactttgggatttatatatgtatatccctatgatttaaagtaagattcatcagtggtataaaaatgatattttagtgtgctcaattttatgacttgagaccagttcaaaacaagcatcactgctagtataattctaaattattttggaggaaatgtatattttaaaattcttggtggtaattagtgatgataggttcgctgctctatacttttttatgaaataaagtttgacttaaagaacctgagaacaggtttcaaaagtaacagcatagataccaatcacattttttctgagtttttaatttgttgacaaaattttttttaaaaaactgtgatgaaagcatgcgagacttgagatggctgtagaaggagaaactgagtaagttcctcttcttgtcttgtttcctctccctatttctccttctctgttttgcttactccaactccatgcacacttgaatcaccatgaatggtgcccaagttgaagcccaaatcaagttccttagttgttggggccgtgtcttatttgtcttttgatccctggtatctggcatgtagagtctctaagtaaactctctgcccttgacctttctgcatattataggctctgtctttgggttcctccctccctctatttcccttttttctgcttctctctcccttccttccagtttagtttggcatttatagttttcgtggttgtgtggctcttttcatctaacatttctagatgtttagagcagaagggggggccctcccacctgacctcagcctaccacattgttggaatccattcattcttcaacctattaaaatcttactccattttattaccaagtaaactctttcaaacagttaatttatgattctcctggttttattcttaccccattcaccccagcaagaaagtcggtttctcaaaaaaaaaaaaaaaatgcccttctttccctacctgattattatgtagcatgagaattgacagagcacaagcagggaatgattacacaacatttttaaaaactctgtgttgaaatgtatttgtggcattactgtctcaaggaaagccaaatgcatgcctcagaattgagaaaaatgtaagtcggcaagcttatctctaactccccatgataaaataaattgagtgttttagagctgtcagtagtacttgcgcagttctatctctactgctatgtcagttaatatttcctccctcaaaacaaaacgagtgcataggcaaaatgtaagccagcagttgagattctgaactacctccaccagtgggtttcaccccaaagtgtctcctgaaggcctattcatcctgggtttgcaatgctgggttgcaatgttaatcattttttcatgtgctgatgaggaaaatgataaagtgatggatgctgctcttccttctgctttgtcatcctgaccctgattgtgctgggtggactttctcattaacgatgcaaagtccggtgatttgcactgtgctcagctgggcatcatttcttgtatcttatttttgttggtcagcattatagctagttgttggaactgatttcccttgcactctctgtttgactatgccatggccagcacacttttgaatgaaaccgctgatggttgtcgaaactaaagggacattcctatattttggattggctcacgaattcacctgttgatgccctggaggtaattttcactggctttatttatagaaatggcttacacagtgtagttgtgtctagtcagttgccatatggtaccctaatatgccaccaaatggtaatcaaaacttagtagtaaattttcaggaactaataaaacaactgtgatggaggagcttcatttgggatggtagatatcagtggctggagcaatgaggaaggccttgcctttctcttagtgctatttgttagacagaagtttttaaacaggtatgtccagaatagtacttaatttcttaaactataaaagcaatatatggttattattaaaaatcgatttggaatggaagaataaaaataaaatgactcagttcatttttctgctatcccaataccagccttggagaatatgctttcaggtaatcatagagtcagagaaagaatagagatgaagacagagtcacatatgtgaagttaaaaaaatgtaaatttatcacaatatatatgattttccaacttactgttctcaatgagtttgtcttgaagagtgttacgtgtcaggatatataggtccacctcattcttcatagcagcagtgtggtactccagaccacagatgcaaaacgccataatttaggtaagccttccattatcgataaacataaggttattgccaatgttttacagttataaacagcaagttaatgaacatttttgtacatatatcttacagtatgtaggctgacattgccgtagtattaacacttagaaatggaactgatcattccatagttaggcatattttaaattttgatggatattctcaaattgcccctccccaaagacactatatgaaagtgctcatttcctccacatccccatcaatgcccagtcctttgcttgatggaaaaacagttttgggcatctttagtgttctggtccacagctcccatcctgaccacactcaccaaatagaatcttactttactcttggacagaacagaacaaattaaaacaaaataaaaataacaagaaacagctcaagagatgtggatcttttgagcagcttaaccaaaacctaaacaaggcaaataaagtgaccctttgttatcagcaaaggcctgtgcttcctctgtgctgctgagccacagtcagctaggctggatcatgtggagaactactcaacaaagctggatttccttgaccagtcagcaggtagaaggtttttcttcacttctttccccaaagtcccaactcgagtctaactacgattcgaagaaaatcaagagctccagtgtacaagtgacagagaccatttgttttaagacttagcagtcaccctgttcaggtcttcttaagggagacggcagctcctggacctggccacagagtgtgagaaagatggtggaagagagaaagctgtacatacacacgcacatacacacacgcacagggcgagacagaaaggcaggaggcaaattttttccaaagaaatccaaaacaataggtaaagaggatggaaaaaagagaatggtaactgggcattaccttaaccactgggaggagaacaaaagtaagtcttaaatctgatcagccatggcttattacttgataaggtgaggtgaggaggggaagatggtagaagaaacttgatcttccagtaggaatcaataaaaattgtattagatgttccccttatctttggggctcttgtcttactcgtacttcctttgtggtaactttaggattctcatgtttctcttccttgacgttgcaaaatttgatatatttccatttgttttgttatttcttttcagatctcaccgtttgctgtattttgctttgcgtaatattttcttttccttctctttctgcattatttgctttaaaacaacatatacactaaagaaatgtaacctcaaccttttcattcaagtgtgtatttctgaaaaaaaatcagatatttacagataatgaataacaccacaaaagttgttttatgctgcaactgtacttaggttcaatgtcatctttgccaccttctccctgtgttatgtaaatattccatttattgcaggcataaaaataccacctttcactgtactttatgaggaaatggaagccaaatgactttttttttatagtttaaaattcatttacttatatatgtggcaaattctaaggcaagccagctcaaatctgtgccaaattcaggaagaaaaggattatcacaagaaataataagtggattatcacaagaaagaaaaggattggtaaaatatctgttatttcacttacaggtggaaggccacccctttttgtcatttaaatgctaaattttcttctcctttttcatacctttcattttccctcttgctttgtttttgcatacaagcgagttgggacatatattgcttctatctatcacttttacataaaagatagaaatccgggaaattgcaaaaggtttacagtctttccatagactaaaatcacgagccagatgttttaaaacaattttatattaaacaattttaaaactagtatttgtataagccagtaaatctatttttttcataaatgtcctatcatgtttttccccccattgggcacttggattggaactacaaaccacaatcttcaaataattattaaatctgaaaaacctatgtcttgtagtttgtggtgactctgtaggtagccactgcaataaaatctatttggagaaggagctattatctatgcacaatgtgtatttgatgaaatgggtaggcaattacagttcacaaaaacacatactgtattagaatagttcacatatagcaaagataattagatttttcatacagtaaccagtcagccaataggagtaaaaatgctacaaatcttatttataaaaagtgccattaaaagataatcccttctaatgttgcttgagcatttttctggatatgagtgggcagatgagtaatagaaaaataacactgacataaaaattaagcctgggagattcctgagtttgttttgtgcaacttggagttttgaggctctgtcaggagaccgctggagacaagagtactggattagaagcaggaagatctggtgcttgacctgactgtactgtcagtcagtcatgtgactcatcccccaagtctcacacttctcattttcaaagagaagaaccctgtactgcagagtaagagatcaataaatgtttgttgaatgagtaaaagaatgaacaaagattttaaagattcctttccaagattctgaaattccactaggaacttgaacaagcaataaaaagacagcattgcaaattaagaacaaacaaacaaacaaaaaaaaactttagccaaacattctatttagtttaaatttgtagatatacagattttctaaatatcagttttcctcaaatggacttaagatgacttccagactcagggtacagtgtcacattagctggtttagcgagagtgttgtattctacagaaatgtgactctgaataatgccagtttgtcacagatggggatgaaatcagattttctccaaaacacccaaatgtgtgatgcataaagcaacattggcagccagtggggaagatcttatcaatgaagtacacaaagctctgaatgtttacttcgcagaggaaatggcttcacagaccggaaaatttaagttgtcatagaaacccccatgccatatattttgttttaatttgagtattggcagattaagaggactcagtgacaaaggagctatattaaaaatgttgaaattgagtgtgctggttttattttttaacttaattgatatctgttttcaaaaggacttttaatatctagaagggcaaaagtatttcatgcaaattgtgcatagatttctgttgaaaaacaatatggcattggaactttttgttataaaatggtgtgttttctcctgtttatttcttatcataaattatctttttaccgtggtatcatcaaaataacttcactggtatcaattagtaacataggaagctatatatcccaactgtctacatttttattccaactcttttacttaaggaatctgatagtagctgctattggtttaggaaggaaaattaataattagtttgacaatctacttgaagtcaaacatttaggaaaacaaacaaatactgaatcccttaactatctggagagctaatatttattgagggactgctctgggcctcgctgtgctagattctctatgtacatgatttcatttggtccttcaactactctgaaatataaattatttcatttcttgatatgtaaggtgagactaagaaacattacgtgatgctcagtaaaaaggaaaatctggaatttaaactttttcaacatccaaaatggcaccacactgcctcatgtcatataattaactagacacaaatgtctaaggagcagaacagacattttgtgatagataagacataactgattctgtagtaagaagaactaggaagatgtccaggcctcacatatgacggccccttctggaccaagttagaccttgagttagtcttcagtaactagcatcccagcttggtgtgaaaatttggaacacttaattatggacattaacatatttacacataattaacactaataccattttgataaatgattaaaaatattcctgcatatatcttcagcttttacaaagggaattatgtgattttgggttttcaattatgtgcaacctattgactggacattttctgatgtttccatggaggatttaagtgttattatgtataatatgttagctattaatttttaaataacaagtttaaattgcacaaaattactttattatagaagctgttgccaaaatcaactggcttgggaatgcacatcactgaggaatttgaaccaatcaaatcattagccagagaaatgtaattatttataactcagccaagctcttattatgggcaagttagttgcacttttctccgctcttttgtggttgatgtggtattttataatgaacgtagattagtgggaaaggagcaatatttataagcaaaagacagtgtaacagagtgaaaaattgaaatatgaaaaattatgaaagacggaaacattcagaaagcagattttctgaaattgtgtttaaagacagataaataaatatgtttgaagatggaattgagaaaaaaagatggaaaatggtcattgctcacagaaaaagattcactaagcttattcttttgatgtgatataatagtgatttgatggatgcagctaacaaaatgtctacaaaaagcccagtggtatccattaatattgatgcattgagtttcactaaccgtattcatggatgtattatttctagcaccttctgtgtttttctttttgtatttggtccataccagcgtgttgggtgctgtccatggtactggaccagcgttgcttgctagggcctgctgtttgggagattctagggatggtttcctcctcccaaccgcaatggccctgttcctttatcttacactgtgcttgaattgtaaatacaacttgtgaatttattagtaacatttctagttattgtagtttctaagtatgagatctcagtggagatctccaaacttaacctggctaaaactgagcttttatttttctccaaaccagttcctcctgcagtctcttccatctccgtcaatggcaactacatcctttgttactgaggctgaaatcttcttataatccttgactccactctttttttcacatcccacatctgtcaggtctgcctttaaaatatattcagaatccgaccagttttcaccacctcactgtggccatccttgtgtgagcccccatcatctctccctgtaatggacttctaactggccgtcctacttatgtccttctacttccccaggccaacttttaaagcctgttctctatatagtaaccagagtagtcttgtaaaacatgtcaggtcctattactcccttgctgaaaatcctctgatggctttctgctttagtcagatagtaaaagacaaagtccttataatggctcttacatcatctggccttcttgactcttcctcatgtaccctatttcagccacacaggcccttttgatgatccttgaacacacccaattatgtttttgctttaagacctttgtactcgcgattccctgtgccaatacagatcttccatcattatatgcatagctaatgtccttactttcttcaggtttttatttaaaaatatctttttcattgatatttttcctggtctttctatttaaacttgttaaaaagaaagaaatacccccccataacagcttatattttaaattaaatgtatctttgttgtttttttatccctctaagatgttggctcaatgaaagtaggaattttttctgttttgtctactgctatgcctagaataatgcctgcatagtaggagctcaataaatatctgtcagctgactaaatgaatggaattatgttaacagatgaatgattttagcggaaataaatgtcaatatttgatgatataaatatatatattagattataatcatttatcagattattattttagataataaaagcatttttagcattgcttgatttatggttaggattctgtatttggaggtgctaaaatgggtaagaagtccagccattgcagatgcagaggcctttagctgaagctctagagctgttggggtccccaggaaaaagctcacatgagatctcctgatgctacgcttctggccttcattattcacccccatttctaacatatatatgttggggggaagcttaaggttttcagtggtgtggggctacgacgggtgtcccttcacaccatttcaaatggataggggtaagttatatctagagtcttagttccagaaacaaggttgtgatacatactcctgttaaaaaatttttttttgattaatgtgcaccagccactaggggatgctagacactcatattcagagtagggtccactgtctcattgggcttggcaagaagtctggtctacctaccttcagaccatttcattatttgtattctttttagccttttgtgtaaaactaacatttatttaatatttcctccattcctccttttttcagcacattccccaattggagaggggtattttggatgcatctgggttcttgcttttaggaactgtgtttaatcatggaaacctcattcctattttccaagtggcagtgactcatgcggggagagtcaaggccctgggtctctgctagtgctttccccatcctttagcatttcttcactttgctaaaaagcgtaaaagtcttttcagtgattctgtctgtgggtgttggaaaaagattttaagaaaaatgattttcaaaatgactagtatttacacgtatgagtccctatcttttcaagtttttagtttcatgccactttaggaaaataatagcccatgcggtgccaccttattctttatatcttttacacgtgattgattgtaaaggcgatgaggataccagtatccattgccaggaggtaagcaggaatcagataaaagcaaagggtggaaggtggagatagaaatacatatatgaataacattcttcttctctccaacttcatatagcttatcaaatccttaatttagctttgggaggctggtggatcacttgaggtcaggagtttgagaccagcctggccaacatggtaaaaccccatctctactaaaaatacaaaaaatttagctgggcatggtggcatgtgcctgtaattccagctacttgggaagctgaggcatgagaatcacttaaacccaggaggtggaggttgcagtgagtcgagattgtgccactgcactccagcctgggcaacagagtgagactctgtcttaaaaaaaaaaaaaagcttaatttaaactttgatcttaggatgaaataccctcatagtgtgctctgctgttagagattcatgtgggaaaaacatatatcttggtttctttaaataaattagtagagggaaaagctgaatcgacatatgttatcatataaaggagttaaaatcatgttctttggtgtgaatagaccttggtttgaaactaaactctgctgcttattaggtgggtaacttcagagaaattactttttatctctcaatcctcagttttcttatcattaaatgagtttaataacttctatcccataaagttattgtgaagattcctgggaaatatgtatatacatatttaataaccatcagcacaaagaatggcatgcaatagttgctctatagaagttaattcctttccactttcatgtcaatatttttaacctagctgttagatgatctcagatctcagtcctagtggaggaatttgaactggactttttcctcccttaacatagtacaatgtgtatgtaaatcactagtaggaattctgtcattagaatttttaaagtgtaagttaaagttaatattttgctttatgaataagatatttttgttacttctgggtggatgtcaaggaagaaatcagtacaaggtaatcccttaatatttccttgaaatgtatgtttgtagtattatgcctgattgtaatagcatgggcaaaatcagttaaaatatagtgagctgcacacaaaaccttatatgaaattctttctttggcttgataaatgccaagacctaattctttgtgaagtgggtgccatagctttcagtgacgttaatatcattcatgtaaaatcattgttcctccagcatatttttatgggtctcagaggtcacgtgttcacagtttgtgtaagaaccagcattgtggtggagtggtgacagaattgcattgaaatcgtggctcttctactcaataattgtgtgatcttgaacaagtctgttaatctgtgtgagatacagctcttagacatataaagagtaggactatagtcattatgcctattgcatatcattgtattgatgcttaagtgaaagaatatacatgaaagcagtttatgagctctcaagtgttctccaaatgggagatggtttctcattgccacatttctggctgctgctttcacttgtcaaaccacattcctgaagcaacacagtttgctgttaaagggagaatatttaaggggcccgagatgctgtaggaaagccatctttctcttctttcttttctaaatggcagcagtaagaggtctgtgagatgggaaaataggggattaattagaagatgattctacatttgcctgagaagatgaatgatgtttaatgcgctttgagaattaggcagtgctcgggagtccattttatttttctacttgagtgttccagtgtattcgttgagtaagacctagacagattattttaccttatcccaacatgcctttctctttactttgggtaagcccaaagtgtaggttctgtcatcacagaccatcagccctctgttcttacagcagatgaactgccccgggactgcttcttgggtaataatggacatcacatgggccatccagccactctctgttggttcttatgtcatccttcctgctcagacagggatttcataccagatacttctcctgccatcattgtgatccagctgctgagataacgtttcttacattttatttcattactctagcatatttataagaaatggttaatttgacttgagtttatcagtgactgtactgtgagctcacttttagcttaagtatccactttgagcacaaaagtgtggatttttttaagttatttttttcacttttaatgagtataccataagctcttataaatattatatagaaatctgtctcttatggaaagtaagctagacccattcctcagtgactagcgtaaaaatctatttctgcctcactaagagtttaacatatgtgtaccttttataatgccttgtaacttggctaaatatgccattttgaactgatatttaaaactgtataaagatcctgtggttattgataaaagtacttgatagaaaatgctgtgacatttaaaattgtcaggctgtactggatgacttttccttgaggttgttgcagacactccacagtcgacatttagtttagttgctatttctggtggcacgtgtcttgcatgggcctcatgagtatgttgacacttgcgtattgtgcatttaagaagtacctggagaggactcctcccctgtcaaaaagttttctccatcagttttcctatagacatttgctacaattccaggttaatttcttttgattttctgtttttgaacaggttattttatgagtgaagtcactcaatgagtatttcttgtgttcctattatataacaagtcccgtgtagggtctatagtcaatcacttccacctgtggaaaaataattagcttgtttggatggggatagggagaaagaaaacaatttggggagggcactgggctcctcagtgtggtaacacaaggctgatggagaggaaaagagtgtatgaaactttgactgtaggagatgcttaatatgtatttattacataaaatgtattaaaataaacttgtggttctagcttcattaggttgtgataaggtggaagggccagtgtcctgagtgtcagaaaacatgggttttgcatggctagccctgccacccagccacttagctgtgaccctttgaacaagccatttcacttttctgggctgtgacttctttattagtagagtgatagagtgggactagatgatttctaaaattccagactcttctgatttttttcctgaagcatgccacttgcattttaatgaaaatattgattgttaatatttattgagaagtataaatgtagcgggctggtaccgtctttattcccatattacaaatgattccatttgtaagttaacaatccttaaatctgttctggtgtcagagccagggtttgaactgagatccaccagtttcaggtatgcacatgtttatgcaacacagcctccagaatgaaggctgatgaagacagggacgctcattccccaccccccaatcctctgtgtaagctttgaagatcactctggaagagtctacctgtcatgaaagaacgcagatgactttttaagaatatttatgtagtcttatatttcagggtacctgagaggccctttaaggtcctaaattattttttgttctatacaggaatcctttctgtaaaacccttgactaaaactgtctctgctaaaggatgggtattggcaggtgttggggtgagttgacgaaaaagcaaaacaatagtttctgtgaaaatgcatgttaaagagaattagcagtaaatgaacgtgtgtttccttaaataacccaacaccccaatccacctagaaccgatgacttttgctagtttttacccatcacctcaggagtcattctggtttcttggaaacgtgtaaagtatctgcttagggaaatattattttatgttgctgatgttgggaggtagcatctactttagttgaggaatagtcagctaatagttcttttctttgctgtgcttttgcttatgtatttgttcagacctgctgcttaatgatttcagctggccacctgccatgtcaaaatcactttcctctcaagatctgtggaaccaattttatctgaacacaatggaaaggaactcaccattttgagctacatatggtcttaaagataccatcttaaataaagagaaagtgaagaaaacatggtttcaatcattagtttctttcccagagccactttctccacctctaatatattgtttattttctgctaacactttaaacacttatactcagttaatatttcaactcttgtgtgaggaattggtttttatgctttctagcagacagattgcctgagactgacacttctgaccaagtaaaataagcatatttaaaatgctctgtagcttattttcgcaacgtatttgtgaacactagaacttccatatggaagggactgggggagaggatgcacacagtttgaaaaactattcaggaactggagagggtaatgaaaatgaaaaaatgtaacttatggcctccaatctatcttttcaaaaagtaattaaaaactgaaaagcaaaagaataattacttcttagtttaatacccccattctaacacctgatgtaatcattagggtttgatgcagctcaagataaacattgtataaaaagagtaatatacaaatggaatatattgtcattcacatgcataaatagattagcttactattttagagcactgattcactaatttatattcaaatttgtgtttcttacccaattcatgtttctagcctcacttccattcctgagtcatagtcaggatgaatagtcatagcctgaagatttaaatttagatgttctaccatttactacctcataattaatctcaagttttattcaccacccctccaattaagaggttcttctattagtcatttgatcttctatctcagtcttgcttacactcccttgaaaccacactttgatcttgtctcaaatctaagctccacctttgtcttactagttgtgggttcttgaggaaggtgtctagcagagtgtctggctcatagtaggagattttaaagtattgtttcttttttccttgtctcagagcctcatccttccccacccatccagatgatcctgttcattattcaaagactagatctgatcacttctcttacatggaccccatgggacttgcattcttctctgagccaaataaggaaacgtatttgtcccttaataaatactctgatttattattttctttttcatgttgtatcattggagtttttggatacaagcaatagaaaggatttggctgacatgggtaaagagaggaccttttgggagggctaaggtagctcactcgattcaccagtctagagaaccaagcttgggaatggatgggaagcaaagaggtatcacatgggtgagagacgaggaatctggtgaacagtctcataacaggagcagttgttgagcaagccaccaccaccgaggtgaatgagctctgactgcttcttccactgttgtggcaattgcttagggtgcaaataagaagagactgtgtgatgggttcagcccagctacaccagggcagttagtggaaggatctgccctttcgactgccctagtacgaggccaggcacctgaacttattatcaccaaagacttcacacagcaggagacacagaagtccctgaaaggaagtctggatgctgttaggaaggagaaactgaattgcagtgaccagaccaccaaaacgttccctaccatttttacccttcaaactctggaaattttcatttcctgaagagcatagattgtaattatgctaggttttggagttcctaaagtttgtatattcatgacatatttattaaccctttaatatacatgtaccaacatttatctgaggtgccgtgtatatagcagtgtatacataaacattcctgtcttcctggagcttgtattttggtggcaaggtgaggcagtcaatgagcaagattagaaaaatgcagcttgtattagtgatgtgtgatggaggaaaagatgacatggcagggcaatagaaaatgctatggtatatgacttgaagttttaaaaagtgattggagaaggtctcactaactaaggaggggacatttgaacaaaaactgatggatgtgaggaagctagcaatgcagatatatgagggaagagtgatccaggcaaagggaatggcaagtgcaaacacaggtgcatgtgttcccctggcacgttaaggaccagcctagaggtcattgcagctggagtggaatgaaggagaaggaaagtagtgggagatgagatcagaaatgtaggagggaaccagactaccatagatgcgacacatgaacaagatgtggcctctgcttccaatggccttgtggtctaagaggaggcacagatgtgaaaggacgtacttcagtacattgcagcaagcaccaaaattaggcagagggtgcaggctaactgcacccaggcaggaggatgggcctggttagatctctgcttgtctgtgagctctttgagggagtgatgtatcttattcattttgcatcctgggtggcttgtagagtgcctgacaaataccttttgtatatatttttgaattcattttgagtggttgaattacagatacaatgggcataatgtgtgagaaggagcaggattttccttaatcacagacagaggaggcttagggaaagagattaaggaaaataggaaagccacagacggttgaagagccaagagttgaatctctgcagtcttctctctactcggtactttttctgtccttggcatcattgctttgatgttgtaaagtattgaccacataaactactataaaagttttttgagaggtaagcataatgtctatattagttgcatgatctgcaacatcaaggtagttgattattttactgcaatttaggggtttgatttactggcttatttgtgctgttttttccccatgtggacggttttgtgcttgtctttatactttttctctacagggcactcaaggaacaccaaaatgtaaaatagaaccacaccattgtatagcagctgtagacagatatcagtgaggctgataatttggatttttctattgcaactgctactgccatctagtattatctaatactgagtggcttcttccatgatgacttcttgaattgtgaagtggaaatttggtagccttatgtaaccaagcacttacattatttaattaagcaaggtgctacatgaatcaacaaagcaacacaagctgaatatcaggaaaacacatttcaattagtgacagcaggaccagtgcctgaaggccctattcattgggtagaaaatatgacaatgccagggaaaaatgcaaattcatttcttataatattctgtgtgctgaactgctaaactaatatttattagtaatcttagagtcagtagtctttgcatatacgttttacttcctttcctttatatttcatttatcaataagtttttggagtccccgtgggtgaaaatgttgatctgttagggatttagaaaatctagtaaaagtttgcctgggctcagaagcttattaatctatttgaaaaatatgtgtctgccactgtactaggcattaagcatacaaaaatgaataaaatatgaagtctttttatatatatatttttattatactgtaagttctagggtacatgtgcacaacatgcaggtttgttacatatgtatacatgtgccatgttggtctgctgcacccattaactcgtcatttacattaggtatatctcctaatgctatccctcccccctccccccatcccacaacaggccctggtatgtgatgttccccttcctgtgtctttaagctctttctgaacaggagagaagccacaaactatcatatagtgtgatacgggctgtgatatagaatatctgggagtgctttgagaacctacaggaaagaggaggtcttctaatgaggtcataggcaatgcttccaagggagtttttcttcaaatggaggaaaaggaaaagggattctaggtgaagggaataggatgacccaaggtctaggagtttgaaaatgatggcacttgaagagatgcatacaagaatgctgggctgagggatttgcatttgccccataggtagtgaggagccaggagagatatgtgatattccaggttcctgtggatgaaccatccaggtgaagacatcagaatacagtaagagtcttaactttgactgcaggtctagaactcacaagggaagctggcttgataacatccccaaaggagagaatttacattgaaagaggaaggctgatgacaagacattagagaaaagcaatattttaataggtaggttgaagaaatgatatcagagaagccaggctttgccttgtgtttggaacaggcctgccagtagatgcctttatagtaaaagataaataacaataaatgaaatgcttttattgttaataaaaatgttgatgatgatgacaatgatagtagtagctaatacctattgagcacctactctgtactgggcacagctctaagaatttttcatttaatcctacaacaaccatatgagataaatagtactgttataatatcattttcgtttggcagataaggaaaccaagatgcagaggctttaaagtcagttgtccaaggtcacacggctaataagcaatgggtttaggacttcaacagtcttgcttcagagtttacactccctatctgctatcgtatcttttaaatagtctaacaactgtttgggagatgtcttatcaaaattgctctctcgaccgggtgcagtggttcacacctgtaatcccagcacgttgggaggccgaggcaggaggattgcttgagcccaggaatttgagaccagcctgggcaacatagtgagaccacttctgttaaaacaaattaaataaaaaagtgctctctccctgggagttcaagatttcagtgagctatgattggaccactgcactccagtctgggtggctgagggagaccttgtctctaaaaaaaaaaaaaaaaaaagctcgctcatacccaaagtcagggcaataaaggtttgagtggtcaaataaagggttgagtggtcaaagtcacataaaggtagagcttcaacagattatttttctttagattttcaagtcagcatgaggttgtctgatacaaacatcatagatgccatggttaaatggttctgtttctcagaaagccccctttcttcttataactgccccttcctttttaacagaccagcttagcctgctcagcatgagtgagccttgactattcaatattccacaggcccctatagggcctgttggtggccatggtagggggcatagtggacttgctgatccttgtgattattgagtatgaatttaagatgcacatggctgaggctggtggtggtgaaggtgcgaagatacagcagcatgaatccaggaggtggaggatgcagtgagccgagatcgcttcattacactccagcctggatgacagagtgagactccgtctcaaaaaaaaaaaaaaaaaaaaaagatttgcaagagttaccacctgctgctataagactgtaaagagcatggactaaaactgaatgggggtatggggtgccaccttggcaggagttgactgagcctcaaggtttgtttggtttttgatgattctaagctgacaatcatagggaaaaagaataagagtgcacattcagtttaaaaccaaaatatactcactatcagcatagcaggaatacagaataagaagtccacagggcctggaaaagtcagaaaagactttgtcaagggaaagagattacagctgaataggtggaggagaaggtagcttgatcaaaaatgtgctgttgggaatacatatggtaaaaacaaaagataaagagactggcccaagcatcaggtcagatgtgtggagaggaaggtggaaaataaagtttcataaataaagtgaggtcagattttatggggccttcaaaggagttcgatgttttagccatgggaaaaatggggcaggtgggaatgcttgaactaggaattaatgatgaaagaggtatttgaaggtcattaatcctaatatgttggattgcagagagactgcaggtaggaagggcagttagaaaactgtaattatcaagtgtttgagatgggttaaagcctgaaggaagatgtggatggaggactgagaagcaaggagcaagtccaatgggcagtatagttagatgaaacagaagggagactaaaagcaggttccctatcttgccttgaggattagaagactgaggacatcaccaatgaggtacttaggaagataagcctattttcattattagttagaaaactattttttttttctgaattgattctcctaagaattttatactgtattgttttcaagatggacatcattctgtctttgggatgtgtcttatacttctgctggccaggccgtaattgtgatatcattgcttttgattgtggatttgtaccagaacttgcagaatgggggccagtggctcagaagaaaatctcggagataatatgtgatctctctttgaggagatgctgtagtacctccctcttgatggcagagagaatgattttgtgtggagaagcacagaaactgaaaacaccaagtcacaatttatttagtagattccaactgcaaataaagaaagtttagggataccttaaccagtttatttctttgtaatgtaggtacaagaatatatattacaaaaaacaatctgggcaagtttaaaagcacattttaataaagataaaaaaattttaagtgataaagtattctttcatagtttaattggcctttttttcattcccagtacatatggcaatggggtatcttacaatcagtggcattttcaaataaataaggtaaaatatccaggacccactgcttgtttgaaatttgcttgctggagttaagagaagtgaacattttaaagattttttttttcctttagacagaaccttatttcatttgtgaaggctgactggacttggatgctgcccactagttaatttagtgtggcaaaaaataagaattctgtgtctgggcttcactgtctgcaaaaatgaatgcattattgtaaaatgtgcactaatctaaaaagtgtattgccttcctagaagtctgagtaatgtcttacacacataatcacactgcccgtcttcatatggacatgagtcctatagtgcttgagaaatggaaattatttgactgcatcagctagtgcatcgtacttctggttattttgaatttttgtaatcagatgctgctgaggctgtggccttttccccacctcctctctcatacatatatatgagtggtgtgttcagtgaaattttctgacatgaaaaagaagtccttaaaccaaaaataataataataataataacaataaagggaccactgtcttagaaaacattagttacccgttctctttccttctcaaggaggaatgacttcagtgcaattaacaatccgtgtctttgtgtcccagtttgatcttgcccagtttgaaacagcttgcactactagattggttcttgtaagtgttgaaagttcttaattacaaattaaatcttgatcctgtaacttggtagtaatcctaccatctatatataactttacgattttcagaggactttctttattgaaggcagtatgaagcaggaagggcaggcattgtgccactttacggttggggaaactgagacacagagagagtaaatgacttgtttgggtcatagcagttagtagtaaatgtcagaggagggatggaacctagattgggtgactccttgttcagtgctcttttatttttacttctcctgttcatattgaattgtttcagaggttggaattaggaacaaaataaacctatatcccattttctgagtcacagtccctcagacatgtgaaggcagcaatcatgagttgttgtttgttttccagccaaacatatctcttttccagactgtagtaacatagagaccccctcaaagatccctgatgtgacagaggtaaagacatttactagagtcagaggtcagctttcttacctgtgaattggccaaaggcatctattaggctatggaatgttaattatttcctgcatttgtctttggctagccttctctaaatgcaccataactcacctgaaaaactaccagatcatgttgtttttgagttaggtcaccagccctcatcaggatcttttaggcatgcctggaacgttggttgacaaaatccaatgaaatgaccacctatttttctctagccagtgagtcttaataggaggtgagcaatgggaacacctttaaaaaaaagatgcctgtgcctcatcatatagttactgaaccagaaatgaggggagaagatctcaaagatggatattatgatggtaaatacacttgggaaattctaatgtatccctgagataccactgtcatactactaaagcctaaaatgacatttaaaaaaatgctaccacctatttttattggctcatacaaatcttgtcatcatttgatattgtcatgacatccgccaaaattataactgacccaggtctccctactcatgtacatattcattcattcaacaagtattcattgagtacctggtacggtggataaggtagtgaataagacaaagtctatatcccacagagctcgtattctaatgggtaagaaggcagcaaataaataagcagaaacatctcttaggtagtggtaaatgctacaaagaaagatgaagctgggtgaggagatatagaataatgaatagggggttgcaagctaccaaaacagaatggtcaggaaggctgaggtggtgacatttgacagtcctaaataaagtgagggagcataggaagatccagggtgaacggtagtccaggcagagggaacagcaagtgtcaaagtcctgaggacaaatttggactgctagccttcatattagtttaaaatcattgtttgattttataagacatactagcctttcagaaatataggatataattgatcagggcctgaaggatgaactcattttcttctgttagctccaggtacttcttaacaatacttaatctacttttgctgtttgctctttgtagacaacaatgcagaagttggatgcatcttctatgacatttttggacttgtgttttaagagaggtacattgcctctttggggatctggaatcttcctgatagcgagtcagcaagattggtgggcccaacactggcacatgtctcagccaaattctctgtgtagcttctgacaaatgccaaactactggtaaatatccaccccccccccccccccactgaaagccaaggacaataatattctttattcattttctggctctgagtatcttttctttttgtttttgcagcctaacctttttgtcatctttggcatttttcacaggctccagctcattcctggctttagttgaacttttctgacattcttcatataggtcagtgctactcttatatttcattctttgttatatgattctccttccatcttttatgtggttgttttgaagcctgaacccctcagaaagtttcctctgtgaccacattattttctctggaagcctgctcttttatctcccctccgcagctgtttgcaagtgtgtgtatgtgtatgtgtgtgtgtgtgtgtgcctgtctgaaatgttttttagaggctcattcctttctgaggtaggtaggttcctatttagaacttctgagcctaacatcatgcttagtttacttctaattttaatgaacacttttattaagatcctgtcttagttcatgtgcactgctataacaaaataccttagactgggtaatataaagataatagaaatttgtttctcccagttctcaaggctcagaagttcaagatcaagatatgagcagattcagtgtctggtgagggctgttctctgcttccaaaatggtgccttgttgttttgtccttacatggtagaaggtggaagggtaaaggggcctacctcgatccctttagcccttttataaggcacgaattccatccaaaagagtagagcccccatggcttaaccacctcctaaaggccccacctcttaatactgttgcacggaggattaagtttcaacaagacttttggaggggacacaaactttcaaaccatggtatattctaaatttgtgtcttagttcatcctttctctttcacaaactccaggatgacataatttatttcctccaaaatttctgtcacaccagcatcaccttccagtgacttcttcttcttagaattatgatagaggagctgttaatcttcttttatagcatagcaattgagaccatgggaaaatctgggttcaagtccaacaccaccgcttactctctgggttggctgtaggcaaattgttatgaagactgaaatagtgcacaccaagtgctttaggaatgtgcttggtatatttttagtcctcaataattgctagtggttaccataatcattatcagcatcaatatcatgattctgagataagaaattattgtcaagctaagtcaagaatgaatagattcactaaacaagtatctggactgtcgacattcccctaactataatattgtaactctgtaaaaatatttctaatctatactcagaaaatatccttcacaccttctgttcctgagagcttcaatgtctttttatacagcagtttaactgtcctcaacttctcgccccaaacttacatattcaaacattcatcaagatgttcaacagaataaagggccttaccaatatcaaacaagcaccctttaaaagtgctctgtaaaattatcctgtaatttagaagacaggtagacgacgacatgaccacataaaatcctgttattgttaggaatgattactactccttcaaatacatacaaagtcacttttaagttggttaggcttttgaataaggagagaggaatggctcaaccagtcattttagaataaataattatcccatgctgatagagtggaatggaataatctgagagtgattgtgggagtttggacttcaatttgaaatatacaatgagttgttcatgttgaaaaactgaccaggatgaaagactgttggagttattagataattctcttccgatagaagctgagctaaaaataaacttcctgtttacttcctttcctttcatctaaagtcaagacgatgcatgtcaaagatggctgtgcttcattcattcattcattcattcattcattcagcagttatttattgagtatccactgtatatcaggtactgttctgggcattagaattacagaggtaaatgcaaggtgcctgccttcatggagtgtacactgtacaggaggggattagatttaagcaagagaataagccagaaagataatttcagatagtgttaaggcctgtgaagaaaagagaacaggccaatggaatgggtagtgcaaagagggaggaaatgagatacttagagacaagaatgatgataagtttcagatctggggagcattctctgaggggaaactggattttatattctatccagtgtggattgagaagccatttagaggttgcaagcaggagagtaacatgttctggatttcatctcacagcaattcccctgtgttcttaggataatgtattggaaataaatctgactggatgtgaggatgccagttaagagtctggtccaggagaaaaagggtggtggattggatgagagttggggaagtggggatggagaagagtgactagagtcaagatttattttgggttctgaagtgacaggaactcccaacagacacagctctgtggggtggtaaggtagagggatgtttctgacctgcctgtctggtggagggtggaaccctttgttgaaattagaaaggtagaggagctggctttttggagaggatagatatagagagtgaggaatgaaaaattaaagtcagggctttaaaagcctatgaggcatccacgtggaggtataaaatagtcagccggagggatagtcaaagcaagagggaaattggggaacattagcatgttcataatattaatactatgggaataggggagatcaacaaggaagaacgtagagagagaagaaaagaggacccaggacaaagccctggagaaattaattagtgggtagagaaagaggatgttgaagactgaaaaggaacagcagaggagttgggaaaaccaggcagatattttattgctaaatccaagagaagagctttcagaagttctgaaagttgtccaccatgtgaagttctactgggagattaagaaccggagagcaggaaaggcccatcatagtggccagatggaagtcattgtgctgtaagcaaaagtgttttgagtggggtgtaggtgggtggagaaaagattacagggagtgagagagtgaatgggacgtgaggaagcagatggagatggtgagtgcacatagtttttcaaagaagctgtgaatgggcggaacctggaggggatatgagtcatcacagaaatattagacatttctgagatggcacctgaaagaaaagttgacctgggagaggactggctggcatatagtaattactctggggtttaaagggtaggaatggcttgaggttaaggtctctgacctctttttagcttaggacaatctctcttcctcttttgttcctcccaagaggacgttgtttgagcatccatccatgactgaaacttgcctgtccttgtacattttagtaacatgagccaataaatttgcttatatttttatagcttaagatgtttgcaatagagtctttttattgtctatatggtacatatgtctgtatctatgtgatacatggctacataatcatataaatatattgtctacatggagtttctcagaattaagaaaaagcacaattactctgtagttcaccctaatagttatctaaactaaggaaagggggaataaatgaaaaaaagtaacattttatcataatgttgtttttagatagcatatatagcatttactttaccagttcattgtaagttggcaaacatttagaacttgaaatgaaatcagagctcatctggtttagtttcattgagtagaggaaatggaagcctaaagggagtgaatgacccatggaaggaaagaacctaggacctggctttcaacctaggaaccagagctttggagtaacacagacctgggtttgagttctgcctctgccacccatacccttgaaactctgggtgaattatttagctgctctgtgtttattttctaatccataaaatgaaattataagacattgatcttgtagttatgaggcatatatgagattgcaaattaactagcaaggcgtctagcacatagaaatcccttgatcagtgttaaatctgtagtgtcccaaaaccttgaatgaattagtagtaagctgaaaaacatgaagatcatcctagtatataaaaatcatactttcctctcttgtcttcttactgttagtttttgggtaaaccagtaattccatttttcaacaaattatttggataattattgattcatataaagttataagaaataacagaaagaacttgtgtacagtttcccccaatggtaacattttgaaaaacttaataaaatatcactcaataatttgatgttatgaacaacaaatattttactggtgctaatatctattaaaacatcagaaaattcaattttatgtaatttgggactaaagcaatatcctgaatttcagtatctgttggaaccattagacaaatggatctagtgccacagacagctgactttgctctgacttggtgaccttggccaaggcacttaatttttatgctctagagctaattataaattgggacaaaagtactcatctctgcttaattcaggggagtgttccagattaattcgatactgtgcataggtatcccctggctatctctcctgccacctttctttatatactgtctatgttttccttttccttctttgccaacccataatgattttctcagttttcaaagcacaccatgttttatctcgtttctatacattttctaatgctgttcctccatgtctatcttattcccttcctaccctgcctcccaatctatacatacacttattcttcctcctcttctttccttccacacccccccccaacttctacttaatttttgaaatcacaacttttacaaaatcttcaggggaagctctgcataacccccagaccagattaggtcccagtggtgtgttcccttagcatcctgggcctccattcacagcactttaccccatgtccttattgtgctttgtctagtgtttgtttttaccagtatgtgaagtgagggcagggagaagattgccttattcaccacttcattgtacttatcacagtgtctgccacagagtggatgcccagtaaatactcattgaatgagtgaatgaatacatttaataaacatacacttgcttttttggaaggaaacgctgtgcagatcaggtggaactgtgggtggtatttctatttagtatgtgactcatctatattgaaggctgttaaatgtttaaagtgtatctttgtatggtagtttggttttccttatttctttcttttgttttcatgtcagaattactgtgtaattatgtcttgcaaaacacctcaaatggtggccaagataattttttttttttttgaggtggagtctcactctgtcactcaggctggagcgcagtggtgcaatctcggctcactgcaagctccgcctcccgggttcacgccattctcctgactcagcctcccgagtagctgggactacaggtgcccaccaccacgcctggctaattttttgtatttttagtagagacggggtttcaccgtgttagccaggatggtctcgatctcctgacctcatgatccgcctgcctcggcctcccaaagtgctgggattacaggcgtgagccaagatgaattttaatagggaagacaaacccaaaatagagatgaatgtttactgtggtgcattaaagcattaaagagttgtgaatgtgaagctctccccagtctttagtaacatcaagttatcttggtacaggaagcaaatagccacttctcattttgcctcaggtggtgaaaaacttcccattttaggccagttgagattgtatgtgctgtatggctatgaatgccaaatatgagtcttaaactccaaatatgtggctgagctaaaagtaatgttaaattgtactgtctgctttggtgtcttataatgacttaaaataatcaaagtaagaagaaatttttgtacctatgtcaactgagatttcatttgttttttttctttttcttcctgtagattaggacttataaatgttccccttcagagtactagccttgatttatcccattgttcctgccttttgctttctctgtctctggtgttgggatagcccaataaaaccaactttcttctatactcagcaattgcattgggagggaggagcagagacttttccttgtttcatttctagtcactaagagggtattttgagccttgaggtgtatatatcagagatcctagatacctagatcctatagttggtttactatcagaatcaccaggcaaacttttaaaaaaagtgcagattctgggacccatgcccaaaaattcttattcaataagtttagggtgggactgaaaatcaaactcttttgatgatactgatgtataaccaagtttggaaactactgtttgggaatcccaaatgcttgaaaccctttgtgagtctttggtgtctttgggctaaaattccaaaccttgagcatggtcctttgtggtctgacttctcctggtccattgctccagcttcttttctgcacgcgaccccctcacactcttctactgagccatggtaactacctgtaggttactgattgctcaatggattttcttaacttttggacatggtggaacatgttttgccccctccatgtcctgggtaattcctgttgtcttttggacttctctcacctactctgatagagctgggcttgtctgggctctcctggtgccttatctcttccctttcttttcctacttatcacactgtattgatttgtcctgcacatagtgggaataaatagatagttatgaatggaataagttgcttgctcagttttctgtctttcctactgtattatgagctcctttaaataagacctgcatcttttccactttgtaggcctcgtgcacgtgttagcatgtggagagcacttaacaaatcatagttaaacatgtaaattaataactgatattgaaaataaaagaatcctgtcctttgggtaaaagatcctgcagtagttaatgttctgagctggaaaacatttgcctattacaatagacatgtattttactagaatagaaaagaacctgggccataaacagtaattgagattgggaatattaatagaaaaacagagaaacatacagttaaattgttctgtatgtattttcaagtgttttattttattttcatataggtaataccatcgtatgttacaaattttaaagataaaatagtatacagggaagaaagagtctccttcctgcctcatttctcagccaccaatttctccaacccagaggcagtcaacgttttagttttatacctttcacaagacgaatggtaacataggctgcaggctgtctgtttgcttttttacttactggtttgtcttactggcaaacatctatataaatgagtgagtacacaaggagattctttttatctctttcattgtttcaaagtattccactctatggatatattccaattcattttactagtccattattgatggatttttaggtgaccgttttaaattccatatctgtgaattcattttttcacccatgtcattttgcgcatgcacatgtatatgtaggaaaatttttagagctatattttctaggtcattgaatgtgtgctttgtaatattaccaaactgccaaaatggggattatatcaattgttctgttaattgtcaccaccaacctcaaatacctgggaccttgtgggctccggatcaattgttctgttaattgtcaccaccagcctcaaatacctgggaccttgtgggctcgggccatcaagcagatggtctttcagactgtgcaatgtattctgtaatgtgtacatttggttgagatgagttgaaagtatttgagagtacctggaactctgaagctacctcagctacctgaagcaaccattgaggctgaattttcagaatgttagtgtttatctattaaattaatcgtttatttagggatatttagttaataaataaaataataaaatgtaaacattttctcattggagttttatcagtatttctgccattgatccttggaaaggggacttatatatgattagagtcaggaatttggaaatcataggaagtaacagcaaagttgacagttgactgaaataattaaaagaaggtctaggaggacatggttcttccttgtacacctactggtcatgcccaatgaggagagtcattcctcctatgctttccattttgttgaaggatcataacaggctgcactttctgatagaatttcacatagtgctggagccaggttcaccatcattttctttattttggtttgcatttctgtcttgaggatctaaatttttttcttaggtaacttttctggcatcagaaaattttctcaggcatacattttacctgaaatacttattatgaacaatgaatattaatcattctattgagactggcagaacctaggatcatgaacaccacactttaaatgtgcttttattttaagtaagagtcatttttttctgggatttttaaaattgttgataaaaatttaggaaattcagaactatattttgaaaaggaaagaaaatgtttctacctttatcatatgaatgcagaaattattgatatttggtatgttttctttgatcttgattatatagatttcttcacattcttaaacacttatactgtgcaatgtatgtagcatcctgaattttcaactatatgaaaattacatattttttcaggttaaaaattattttaaatgattttaatgagatattaatattctatattatgcatataacataacatatttaaccattctcatattgtgggatatttgtgtttctatttttagctcttttaaaatgtgctgcagctaataacttttctgtgaatgttagtctatgactatcttgctatgcatattgcaagtggaaataccagatcaaagggtatcaatattttttaaactctagatacaaaaatgccaagatgcttccagagtaagactctaatttatacctccatcatcaatttatgaagttgtccatatcatatattcttttaactttgtcccccattttttaaaaacatgcacaattatatcttcttgtttacattttaaacattattattagtgaagtagagtattttaaaagtttgttactcatttttctttccctttttgttaaatatctatccctgcctatccttttgtatttctgtctttaggagacttgctgctttttcccagagattttaatgttctttctatataaactatatttcaatggtcacagatattttctccaggaaattccagcttttttgccttttaattttctcagactgggtaaatttaagaatttatttatatgaagtctactaatcttttactttgtgaattctttctttgcttttgtgttgggaaatcctttctatattcaaagtgatgacaaatattcatccatattttctcctattttaaaaataatttcattaaaggataagttcttaaaggagtaattctataatgtatcaggtggtgggaaatgcagagaagcaaagtgaatcaagtagggggtatgtgaagtgtgggctgtgaaggaaggcctcgcttaccagatgcacctgaccagagacctgtggggggaggggagggagacaagccaacgtacctgatgctccaagcagagggatcagcaaatgtaaaggtccttagtgggagtatgctcagctcaagggctatcaggaaggcctgtgttgggggagcagaatgagtgcttgggagagagcaggtggaaatgaggcctgaatttcagaataggccgggggcaggagcattctagcctctcataaaccattttgggtgcttgggtttttactcttaatgacacaggaatcattgcaaagacttaaataggggagtgacctgacatgacttacttttaaaaaggattactttaactgcttgagaaagcatagatatctaaaagaaaatgtccaggcacagggatcctatgtataccctccttccttttgaaatttgtgctttcttgcttataaacttgctataatctatacctaatctattaaaaacatatttcaaataaataagaaagagatggatgtagcagttcagttgtgttcagatgtatgtaacaaaccctgctgcagaggttgaatccagtggggctttatttttctctcatcacaggaaacctggaggaagacaattcaggactagttcagcagctcaaggaaggcctccaggatacaggcttcttctactgtcctaaacatgtatgtggctatcatcctcatgttgacaagattgatgctttcctccagacaccacattctgcatcctaggcaggaggaaggagatggtcagaagacagctgaaactgtcttttcactaggaaacaaaccattttcctggatcctcagtagtaggcttctgattacttcatggccagaactgggtcataccactattccttgtgggcacgttgctgccttgaataccagctataccttcttactaaggaagatggaactaacagtgtttgtgataatggatagcctgtagaaaaatggatatagatgagtctcaaaataaaaatatacaaatatacatgtcctagtcaatatacataaaaattacaaaatctgtaatattccaaaacgcaaactaaaactgtcagttaccactttgtccgtcatgttggcaatttaaataaatcgataacactcaaagttagcaagaataggtaaaatgggaatgttttatggcgccagaggtataaccttcctgggaacaatttaatcattcatgtggtgtgtatgtaagtgtatcttattgagggtttgctttgcatttccctgatgactaatgaagtagaggacctttgtacaactttctaaccatttgaatttcccctttgatgagctgcctgttcaagtctcttgaccatttttctacttaattataatctttttatataaatatgaagaggttgtttatattttctagatacaagccatttgtctggaatatgcacggcaaacatcttctcctaataagtagcttgccttttcaaagctctcttaataatttattttgtgaacagaagtttttaatattatataatttaccattcttttattgttaagtacattgtatgtcctgtttaagaaatatttccttactccaacttcatgaagatattttctaatataatgttctagagatttgtttttaccttcatatttattaaaaagactgtcctctacaattacttagtaatattacctttgccctaatttgaatgttttcatatgcattggtttctttttgagcttttgcttctgttctattggtctatttgtcaatcactgcacctgtaccactctctcttagttaccatagtttttaaataacttttggtatccaaaatttagcaggttcttccccatttttttcctgttcagaacctataaagtctttcatttacctttactttagaaattacagcatacttccgtgacctattaacttccaatgttgactgaagtatgcataaatgttttacgtgtatatttatcaaaggctaaaggtagtatctctgtcctcttcccaaataacgcaaggatctaaataccatttaactacaatcttcccattcttacatataatattacaattgttcagtattttacttatacctgctttttgatactccccaaataaaccattattactattttgttgttgtttttgtagccagtcagtagttctaggtagacttaccaacatgacaaccagtttatttatgtattattgtttttgcattttccatgttccttccggattctgtctggcttctaagaaggagcatcttttatggacagttctgagtgataaaatctctctggcttactttctgaaaaatatctttattttgcttcattcatgaatatagtgttgctaagtatagaattctaaagtgatagttattttttcttagttcttagaagataatctttttggatgtccttaggagatattttttcatcgctttctgtcatcttctgtagctgatgaaagaagtctgtcaatgtaattatggtttccttgtcaataattgttttctctgtttgctttagctgtttcctcttttctttggaagagtgcagttttacttgttgtgttagctgtggtatgtttagaaatactagagacccgtgttttccttctattatggaaagttttcaaccattactttgaatattctctcccttattctctcctcttttatttttagaatttatgtatacacagcattgagtattctgtgcctcatgtttcttaatgaatctttcatattttttatttcttcatttctccatgctgcattctgcatgattttcccaggtgtatcacctcccttattacctccctctttagttggtgtcttttttgttccttttcaaagcaaccttttattcccacagagttataaactagtcctttctactcattcactgtatttatctaatagtccattttagattttcctttcttcagttgtggggatacaaattattgtctatttttatctgcttaatcttcctcatcatgttccatttccttttgtgtttcatagcttttctttgtgagttcctcttctgcagaagttttgatagttgttgtttgtatgtacatttttgaggaggggattccatgtgtcctggcttctcatggactgggtggcattttgaggtctgtggcttcgtgtagggagactgaatgctagctttcacctcatgtggtcccaagttcatttttttttctcctcatacgctttatggcccaaacccctaagttctaaagtctaaatctaaagtccatttgaagtgcatcaattcctgcctcttggtcaggaatcaaatgccttctttgtttctatagctggggcattccatttcttagtttcaagcttggctttgtaatgctttctttgttgtatttgcatgcatcatttaagtgtgttagtaatgtcattttggtccatcgtatccttttttctcccctttatttgttttattgtcaataacttctactttctgcctttagctttaattattagttactaaaacaactttatgctaacatcagaggcttataaaaaatagaaaaatttccccataatcccatattgagtcaaaatgatctatttttattctctagatatccttcaaatctttattcatagggtgctgttgttacaatcatgccatatatttaattttgtgttataactctcttctggtttacattttgcccgtatttctttgtaatcttcaaattaccattttaatggctctatgatagcctcttgaattggtgtactctatcatacttacagagtttgttttctgtttttccttgtttatacaaatttccccagaatatttttgcatttgtagtgtttgcattattttctgcggctaaaatctcagaagagaggatgttaaattaaaaattcttaaccatgcattgccaatttgacctttgaatggcttttctcattttacagtgacattaggaataaattcacataccgacataaatttaatacctactgtgtgggaagttctgtgcattttgagtggcatagtgacaaataggacctgcttcaagtttcaaggaatttacagtgaaatcaaggatatagatatactatcaacttttataatattaggataaatggagcaagtggtacagtcaaaatctaatcaaagaaggaattttatagaagaacttgtatttcagccagggatagaggaaggggtggagtttccctgtacaaagggaggctggataatattccaggctgagagaacttaacggagaaacagccagaggtatgaaaaagtctacagtgcatttggaaactattgaaatcgatggtgtggctggaacaatgggtgagagaaaggagcttgtaggagacttgaagtactttgccgaaggattttggttataatcagccagaattttcatttctgccactaattgcaaatgctggtttgagaaaagcatgcactgtagattcatggtagcctgtgattggcagaacccaccagtctcctattttatagatgaaaacaatttctacggaaattaagaaaattttccaagtttacactaggagtgtatctgaaggcacacttgctccctttttcaagaaaaatttgtttagcatctgtttgtaactcagtagtaagtgcttggaggatagaaagtaaatacagtatagggtcaacttctgtagccagctgggggaaaaacaaatcaatatttgtaaaatggcaggataagacaatgatagaaatgagtaaagggtattttgagaacacagaagaggggaagctatttcagcttggcaagaaggatgaagagtggaagatggtggctctattaaatcataaaggatggataggaagaagcttgccaggtatacctcacccatggtgagggaagggagtttcagcctgagcaaaggcacggggtaggaatcagcatggtggatgtgggaatcagagcagcttcgcattgtggaagaatcacatgtgaggcagagagtggcaggatataaaaccagggctagatggtgtttgctatggtaagtagtatgggcttgatttttttagggctgctgaggatcttaaaatatttaagagggaaacttggcaggactttctgattgactggatgtgggagtaaggatgtgagggagagaagagcaaaatatgattctctggtagacttcttctttcttctctagttagtgagtttatcaagatttaagatggtagtggttttgtttcagcagaagccatgcagtgtggtgtcatgtggcagtggaaaaaccatcatggggcgtatggagactcaaatgttcctgaaatgcctgagagaacatccagggacatttggaggtcactgccagaggccatgcacattgtccagttttcagtggtttctcttcgttgctaagaagcttgaacatatacagaatgcatttaataatgttcagaaaaccttcttaagtggacaatctcaaatgtacaacagacaaagcagaatcagatatttttttggatggtatacctcattagtacagaataattacaacattaggtgataataatagcaactgatatttatggagtactcactgttttccatgtaggatgttaaatgctttacattcgtgatctgacttaatccttaccataatccctactcaaggaaacaaaggcacagagcatgtaattacttgcacacggtcactaactccaatgcaaaccctgaggcatgccaactccaaagccctcatttataaactccaggccatattgcctccccatgaagctgatacgcagacaagtgtggtgccactttgagattctctgggttcagctgtcaaacaatgacatcattaaattatccatgtaaaataagaagttgagtcctctatatccgctgtgtttgaggagtggcaggatgtgggatgaaagaaagaaattggattgcctctgaagccctctgaatttgtaatagaactacagcctcctcaaaccaaaattataaaataacctacatcactctgaaagaattttcttactaaatacgttaatgtgagaagacaaaaccaaaccaccaaagataatatttgaatattgataatattcaaacctcatttgaaatcaaaccactagaaccagaaaagaaaatgaaatgtgactatttaattcctcagcagagatatatgtatgaaaacataatttctatcactggtgataggagaatttgatattgaggacttcatgagttgggaagagcgatttcttaaatgaaggtgataaaagcctgtataaataatacagtcatgtattgcttaatgatggtgatatgtctgagaaatgcattgttagctgatttcatcactgtgggtacatgaaagactgcacttacacaagcttagctagtatagcccactacatagctagggtacatggtatggcctgttgctcctaggctgtaaacctgtacatgttactgtattgaatactgtaaaaaactttaacacagtggtatttttgtgtctaaacctagaaaatgtacagtaaaaatatgatattataattttatgggaccgccatcatatatgtggtccgtcattatgaggctcatgactgtctaagataaaactgtaggcctcataccaaatagagaagattggcaatatctatatgtatatgggtgtggattgtataattaatttctacttagtatcctttgcttcttagaaactttaagttccctcaatttaaaaaaatccttcttgatttcttttgctttttaaagatattttgatgtaaaagagcttttgtttttattttctttgcctggttctccactcaaaaatttaatgcctgtgtgacttagaattctcataagatttagctttctgtctttttacagatatgaagtggcatagtaggatttggggtccattttccctcagcttcctatttcttgccagtagcttcattgcaaaaccactctaccatctgccctgcttctttttctgcttccacccccagttccctcattttctaattactcccaacaggagtgactcaaacatatattggaagcaagattcccacagttgccaaataggagcagggaagtgccacgtactaggttttcacaaaagaagtcattatgtatctggatttttatctgccagagaagaagaggaatgcttgaggaagtcaagtctcagggcaaaaaagtaacataataaacaaattagagaatggcactttcacattaccatttctgttacattttgtggtagtctttcaggctgttcacaagtatatggctcccttccttttttgggctatagtacagtatcgttccgtgctagtatagttcggtccaggctcttctgcactccactgaactcggatatggccatatgacttgacttgttttagccagttaaatgtgagtggcagtgacaggtgtcacttctgagaagaagctttaaaagccagtggctttaagagcatattttgatgtcttatttttgacagtagttgctctatcaacttgagtctttaagtgacagtgtgaacagagcaccctccccataccagctgactcataatggccaggtgacatgggcaagaaagaagcctttgttgttttaagtcactgagatttggggagtaatgttatggtggcagaatctagtctgtcctgactaatacactgaaacagttttagcatgtataatctcatgtagttaagagattcaaatcataattcctccgatacatggatcaaagataatagaagacaaacatttaaagtgtttttaaagcattcactcaaaaagaatgtattttgtttgcatccatatagtagcatctaacctatcgcacaatagttttgtgttatataatagatctgccactgcttcagagcctctgtgagggcagagataaggtctcgttcttttttaatcctggcacctggcactaggtgtggcatttagtgggtacttaatactattagattagtgaagaggactgaaaactgcctggcacatgagaggtactgaataaatatttgtacagatattaatgttgttaatatctgtaccaaatattcagcacctgtcattaaaattcatccatcacctatcataaaattaattagcattggaaattctctttgtacaatcacaaataattgtacaaagtgcattttcaacatttcaaccccttggtagctactgggctaatttttcaggcacaaagaagcagtttaatgtggaccctcaagttgtattttttcctgccaccagggcctttaaagccttacttaaggaagtaccattatttcaactttggcaggagggatgatacatttgcatgtaaactggtttggagtttgatgctgagcttgcatcgtgaccacctttccactggacattataattagggggaaattctgatgctaaagcttggccagtgtatagttattaattcaaagttgattatctcaccagggattgtgaagagtttcatttggttttaaaactgcctaatacatgttattctaaggtgttgggaaattatcagtgtggctgctttgtgtgctctccttggtccagtgaaagcttcaccttactccttggcccctgccagctcctattttatctgtttcttcccaggaaggatttcaggcatctgggaacatacatgtacacaaggttgttgtcatcaggtccctgcttgcctacttccttcttcctaaatttagattctctaaatggagcttactttcctatgtctctgtcctgtctaagcagtttctccattacccaaaatgcaattccccaggttcattaattcattctcaaatatctcttaagagcctcctctataccaggcattgttcaaagccttgtgagtacagctttcctggaacttctatttcattggaagagacagatgataaataaaaaagtaaatacagtcatgcatcacttaacgatgagaatattttctgagaaatgcattgttaagtgattttatcattgtatgactatcacagtgtgtccagagttcgttccttctggtgcatttgtgttctcgctgacttcaagaatggggccgcggaccttcgcggtgagtgttacagctcttaaagatggcacagacccaaagagtgagcaacagcaagatttattgtgaagagcgaaagaacaaagcttccacagcatggaaggggacctgagagagttgccgctgctggcttgggtggccagcttttattcccttatttatcaccacccatgtcctgctgattggtccgttttagagagcactgattggttgattttacagagcattgattggcccattttacaaacctctagctagctacagagcactgattggtgcattttacaaacctcttgtaagacaggaaagttctccaagtccccattcgaccaggatgtccagctggcttcacctctcaacagtgtgtacttaaacctagatggtatagcctactatgcaccttgggtatgtgatatggtctattgctcctaggctgcaaacctgtacagcatgttactgtactgaatagtgtaggcaattgtaacacagtgataagtatttgtgtatctaaacatatctaaacatagaaaaggtacagtaaaaatacagtataaaagataaaaaatggtacacttgtataggacatttaccatgaatgaagcctgcggaactggaaattgctcttgatgaatcagtttgtgagtagtaaatgaatatgaaggcctaggacattaccatatactactgtagactttataaacatcctacatttagtctacactaaggttaaatttttttgtttcttcactgttaaattaaccttagcttactctttttgctgtataaacttatttaaaaaatgtttttgactcttttgtaataatatttcacttaaacacacattgcacaggtgtacaaaagtatttcctttcattgcattcttattctataagtttttttctattttgaatttttgttctttaaactttctttgttaagaactaagatacaaactcacacattagcgtaggcctacacagggtgaggaacattagtatcactgtcttccatctccacatcttgtcccactggaaggtcttcaggggcaataacatgcatggagctgtcatccatgataacaatgccttctggaatacttcttgaaggacctgcctgaagctgctttctagttaacttttaaatttaatttaattttaatttttaaatttgtattcttttagagccacggggtctcattatgttgcccaagctggcctcaaacacctgggctcaagcgatcctctcacctcagcctctggagtagcagctggaactataggcatgtgccactgcacccagttaaatttttaaataaatagaaggagtatactctaaaataacaataaaaagtgtagtacagtaaatacataaaccagtaacatagttttttattatccttattattattatttgagacggattttgctttgttgcccaggctggagtgcagtggtgcaatctcagctcactgcaatctccgcctcccaggttcaagtgattctcttgcctcagcctcataagtagctaggattacaggcgcctgccaccatgcccagctaatttttgtatttttagtagagatgggatttcgccatgttgaccaggctggtctcaaactcctgacctcaggtgatttgcccacctcagcctcccaaagtgctgggattacaggcgtgagccactgtgcctggcctttattatcattattaagtattatatactggacataattgtgtgtgctacacttttatgcaactggcagcacagtaggtttgttcacatcagtatcactgcaaacatgtgagtaatgcattgccctatgacattataatggctatgacatcactaggtaataggaattttccacttcggtataatgtcatgggatcaccatcatatatgttgtccatcattgactgaaacgtcattatgcagtgcatgactgtatacggtaagtcaggcagctgtaagtgctacagtgaataataaagagggaagaggtattatgtttgtggaagtagggtgggacagtgttactaatcatttcaggacaggaaaagcctaactgataaggtgttaggtaaacagctgaaaccttaaggaagtgatgaagaaagccacgagcacatggggtgaagaggagctagaaaggttcccaacagaggggacagcaggagctgaggcaggagcatgcttggcaacttcaaagaagaggaagcaggccagagtaattggggatcagagcaggatgggctgaagtggattatacagatcttgtagggctttttggtcagtgttatttagtctttagcctgagtaaggtaggaagctgttgtgagtttttgagcagagggtgccttaagaggatctggctgatacggtaagaactggtcaccagaacagaaaaagggtgaccagttagacatctgttagataataattcaggcatgaaatgaaggcattgactttcaatactcagctcaagtgttaactctaactaggaagcctctcctaactcccctaggctgagttgagtctacctcttttgagtttctgtaacaatcttactcttgaaatgaaggctttcggctgagttcacttatatttggaagctgactatatagttgagaggtctctgaattaatttacaattagaataaagtttatttatagataagtaaaagggctaacttagtatattatgtattatatattcattatgtacaaatatacgtgcattatattattaaaacttaacaataattgtggcaattacttaaaactttgtccattacaaagatttttgggacaggattattttgataaggtttaaaattgccagaaatggtaaaataaaaagcagagtgactcatgatgggttttattattgttttcaaattctttataaactaccccgtaatgcctatacccacagtggactgatctcactgccttgtcttgatatatcactgatggtaagatcttttattcaaagtgccttgagcaaaagaaaattccttcaggcacggtttgatccagggagctcgaacagtgtcatcagagctcctccaaattattccaatctgttttccatctgttttcctctgggttggcttccttctacagcaggctgtctacttttagttgcaagatgactgacagtgactccagccatccaaatgcctttctccaggtcactgcagcagaagtcccaaaatatgactctaacaatgtcgtatgcccgtacttgaaccaatcacagtggccacaggaatgcaatattctaattggcctttgaaagtcaatattctaattctgacaggcttgggtcacttgcccccatttggagctgggtatggggtaggtccattttacacgaattacatggaagtagaggaggaaaggcaggcccccaagaaaaattaagattgctgttagcagaaaaagaggagatagatatgggatattcaagctacatccatgtactacaagcaattatttctgattcctatccagaattctgtcctaaaagtgttcccacttggtaaatcaggtacatagatatgaagttctcacccccgcattgattgccactgtagcttcctcttcctttcgtaggattctcagcaggaatcccctcttcagcctctcactcacacacccacacacagacacctttcatcataagccctgcttttgcctcaaggagctttcatattgtgtgcgttcagtaaagcaaaaaataattcctcacaaaatcggcattttttattatactttaagttctgagatacatgtgcagaacgtgcaggtttgttacatagatatacatgcgccatggtggtttgctgcacccatcaacccgtcatctacattttaggtatttctcctaatgctatccctcccctaacccccgacaccctgacaggccccagtgtgtgatgttcccctccttgtgtccatgtgtcctcattgttcaactcccacttatgagtgagaacatgcagtgtttggttttctgttcctgtgttagtttgctgagaatggttttcagcttcatccatggtgtatatgtgccacattttctttatccaggctatcattgatgggcatttgggttagttccaagtctttgctatcgtgaatagtgctgcaataaacatatgtgtgcatgtgtctttatagtagaatgatttataatcctttaggtacatacccagtaatgggattgctgggtcaaatggtatttctgattctagatccttgaggaatcgccacactgtcttccacaatggttgaactaatttacactcctgccaacagtgtaaaagtgtctatatttctccgaaaagcaatgacaacaaaagccaaagttgacaaatgggatctaattaaaccaaagaacttctgcacagctaaagaaactatcatcagagtgagcaggcaacctacagaatggaagaaaatttttgcaatctatccatctgacaaagggctaatatctataatctacaagaaacttaaacaaatttatgagaaaaaaacaaccccatcaaaaagtgggcgaaggatatgaacagacacatctcaaaaggacatttatgcggccaacaaacatatgaaaaaaagctcatcatcactggtcattagagaaatgcaaatcaaaagcacaatgagatatcatctcatgccagttagaatggtgatcattaaaaagtcaggaaacaaaatttgcattttattttaccctgttgatgctgtataaatccaggtctcagcaggaaacagatggaacactcaaattaggataattcaagaagagtataataaagggactatttgcaaaggtgtgggtatcgtgtaagaaaagcacagggacattacagcgctgtgggactagtaaatgaagctctgtttatctcccccaggtctgaaaaaggttgggggaggagatagccattgccagagctaccagacttggtggggagacacagccagctgtggatgatttcataggaaagccactggggtagtaatactctgacatctctctcccttagctttcctgtcttctacaagtgcctttcattggcagaagccacacggcaggggagcccattgacagagtccattccagtcagcctctagagtggagggcagggttgacaagagaggagagaggatacggaggggaagtggatgttatccagaagagtccatctctttgtcctctcagtatatgtgcttatctttaagtgaaaagttcctgttcccttcacagaggacacaggaagtctcatcgctatggctctatgttggataattttactttaatcatactgcctcttcaaagcagtggcaggggaataaaggaataatggaaggcatagcacctgcagttcttgattctgaagcataaggtgtctactctcaccatgactccacgttccccttaccttctccagctcctcagctggatgtggctggatggcggtgacccaaaccttcgttctgcagaatctcagtgccacccctgcccccacctttttggatagcttcagtgttatttggttccaagcatggtcctcaatgttgtatcagcaacccagctgctccctggtagttgggcttactctgtaagtccttttctctgtgttagttcagtaggatgatgaatccaaactacctaggggctgtctttgcttccaacttaatggaattgtggctgtgtttcctgatagaagcatttctacattaaacatgaggacttccaaggtcatgtggtcaagctcaaggtcatagagatgagaagcaaaaattctgtaagtggatagttagtgattagggttagagttaggataagaacactgatacctctccttgttcctggtcctgtgcattctggctgaggaggagatacgttatacaaaatactgtttatgtaaaatgctttttgaatgcatatactaaattctgtgggacagcagcccaactttgtagaagttgtctcctctcctagctcccactgtaattgagcctttgctctagacactaacaagacagagaggcctgatacagtaaaggtgtactgttatccgcagtaagcaaatggatcccgattttctttactgatggggctggaggtgggaggtgagggcatgagtacattagtctggtcagtagctacataccaggcaccacactctgtgttgattgctgcaataaaaatatcacttctggagccatagttgtgattggcaatatcacttggttcagtttatgactcttgcttaacggtcttcatgtcttcagaccatcttgtatcagtcaaggttctccagagaaccagaatcagtatattgcccagatgagcattaagcaaactggagacccaggagagccaccagtggtatattttcagttcatgtccaaaggcctgagcagtaggcgagccaatggaataaggtctagcctgagtctgagtccaaaggcaggagaaaactgatgccccagctcaaagacagtcgggtgtagagagttagttcttcattattcagtccctttggtctattcagtgtttcagtgggttaaagaaggcctgtagaggacaaactgctttactcggtctacccattccaatgttagtctcatccagaaaaactctctctctgtctctctctctctcacacacacacacacacacacactcagaatgacgtttaaccaaatatatggacaccccatggcccagtcaggttgacacataaaattaaccagcacacatctgtctgactgttgctgaattaaatgaagataacataggaattatgcctacattctttgagtcctggatagtagcaccaagctctgcaattcctccaggtgtgtggctttgttcttagtttattctacagggaggggcagttttaggagtgtcattttgcactctttcattgccctcatgcaatgaatcagtaaaccaatgtagtgttttgccagttgataaatatatctgcttctactatacaatatggtactggggaaataacatcaggatggatctctggtgccgttggacccactctgagatggactcaggccaagactctgtcacctgtctccacaagcctcccatttgaatggtgtaccacagcaatatttcagagagcaacttaagtctagacccacagctaacctggggaaagcctgagcctttctttcttcagtgcacagtcaccctggaaacagccataggatgctatgtgggaggcttgaagggcgagtcacagcatgcacctgaggcagcattgttgggtccctctcaaagacacccagccactttctctattgagaggctctaggtcagtggaacttggtgagaggctaaaatccttactatggtgactgcattaggtcccagcccacgagagtagaattttgtctcttctatatgccaagtagcaccttagtaggtggtccatctatttttgtttctatttctgagattatttagtcaccaccacagatccctgtggaataagattttgattaccactcatccctgtggtttgtttcatttaccttatttctgatagttaaatgccgccaaccagttggtctcccttactcttgggttcctttatctccattgataacaaagacactgattccatttcagccacccccatcccattttccaggctgcagaagaaagccaccacacccagggcagccaccacaagctttccaagaatactcctcctcccccttgtgggagttgtggttagagaatggctgttgctcatcctaggtccacttcaccactcccatttctgagacttcagatttcttcctctccagcagggatcagctcaggaccagatcataaatattttaggctttgtgagccaagaggcaaaattcaacaggtattcttgccaaaggctgatagttttgtttgtttgtttaacatttaaaaattgtaaaaaccattcttacctttcaggccatacagaaacagacagcaggccagatgtggcccacagtctgtagtttgccaacccccttctccacaggatgccacagaagttcagttgaaccacataaacacagactacccttgagtccaggctttaattgtccaattaggtagattactgatgccactccctggtactcaacctgaaacactgaatcctaaatccggggtgagtatatcccatgagtgaatttaatgagatcaagccttatgttttgtcctcattgatccaatgcctttcgaaactcataccttctctcctggctcctgccaatatagactggtgtgaggttctataaatcttatgaaagatttcttatgtaagggatgtaggctgtctcatatttctccctctgagctgtgcttggacctgagtcttagatcaagaggcagtgagaggtgataggaatgagtcctgagggaatgaccagcaggttattatgcatggaaaagctgttcttcttagacagggaggacaaatctgtccccatgggcaagaagattttgtgggttcgaagttttcatatttgtccgtgtctgcccaaatgatcgcaatccagttatcagggtcacattcccttgatatgagacccctcgtatgagctgatcatgtacttggtgctgcagctctgcaacttttgttaggctctgagctttgtcctcagccatatctgccgtgggactctggaaaatgaggggttgctgcagttataccatctgaatagctacagggactttctgattttttctatgcgtgctctcaattgtacattcagagatttcagtttctcattttccttttgtacaccttctaaggctgtgagaagaagccaagagactcaacagtctttatagtcactgctgtaaccatagcaattaagtgcctctgccactgacctcccagcatctccccttccacctgcatttcatctcctaccactgctagagacaacttgaataactgatgtcaccacttgtcctggattatttgttttctgttttttcctggcaaagtggttctacctgtgtttctcaacaacatgatcaatctaatcctggaatcccacttcaggatctcaatagaaaacagaatgctcaaattgggatagttgaggaaaaattcatgaagggttatagaggcctaacccagtgatgatgaggagcagttactgggacttggagacaggcataactgtggaaagggttgctggaaagaagctgggatcctaagttaagcaacacagtcatcacttttgacattttcctctaatattttgtgcagttatgcagcaaattgtatttcaaaggtaaaccttatttaaaaccccatagcatcatatgactcctatttttaaaagtctgcaaaataattacatccctttctttagttatccttatcatattctacagctgatggaattcagttaagcagcattggttgtctattcaaaactaaattaatatagtgaggatttattttaagttttcattatttttttttacatcatagcccttgaaacatgacagtttgtcattccatgtatttgcaggatttttttttaagaaaaccatcctgattctctattttcttactttcaaataccatcacagtataatttattttaatcccttatcctgtgggtcacttttatctgatgattgctttcatttaaattttaattggggtttgaaaactctttttatggactggaggacaataagtaaacttttgtagtatggcagggtgatctatagtccaggaaatcaatatctaggcttctatatgcaggagctgttcaaggcaggaactattttcttatttatttttgaagtcacattagagttccaaatgtataattatacaggattccataagttaatagtataggcttattggttttaaagaagtcttcttcttcacagtgatattttttcaggtattattgagatgtgtccttatttatctggagaatagatatacttattctctgccttcatttcgttattgctacctagtggtaggagatgacaaaaaacctcatctaataggtgtcacttatacctcttaacatcactatttccaaatattaattgttccttggaaatccttttactagggctgttcttgatggtctgtctgcattcatcactttgtgattactgagttttcatatcaccttaaatctttgatgagctgttcctcaaagaaagaaggtcatttatcatgtctgttttactgaaagaaggacaagatgagacaaagaggtattacataattcagtgtgcctatgaagctttctaggccgtattccaaaatagatagcagtttcttcaatcaaactctgtataagataaatgagatattgtttggtaagaaccccccaccccactttgtgccaaacttgttggcaccctgcagtttacagcatgaaagtcagcttctctgcacagtgatttttaagactgctaaaggcaatcagctgttcttagagctgtgccccaatgcactttatatgcccttctgttatagcactgagcacctggtggtttgtaaccttttacaagtctttttccttctgtagactgaatgccctgacagcaaggactgttaattattcaccattctgcatacactctgattgggtggcttacaaacaacagaaatttatctcttgcagttttggaggctgggaggtccaatatccaagcactgacagatttggtgtctggtgagggccagcttcctggttcatacatagccatcttctcactgcattctcacatggtgcaaaggatgagggagctctctggagtctcttttataagagcactaattccattcttggtttggggtgggggctctgcactcatgacctaatcacctcccaaaggtcctacctcctaatgtcatcacattgaggattaaactttcaacatatgaattttggagggtcataaacatttagtttataaaaaagggctgcttggtgtatcatggccactgaataaattttgagtagcaatcttacctggtatgccattgcatttatatatgattgccactaataactcaaattactgaatttatgttgtatcgatgatgctgttttcctagtcttagtattagtagccaaatggccttggattaactttctcaatattattcattcattcattcattcaacatttattgaataccttactaaatggcaagctctgaattaagctttgagaatccaagaagactaagactttgttcccacctttcccttcagcttccctttcctaagatagacataataaaacaattgcatcacaacatgatggatcctgtcatagtcagagtggaaatagaaggagattgagtgggacaggggagttgaaagatgcccagcagcccccagggagagtgaaaacgtgatctcaagatcagctttattttctgaccaattctcatataccaagtgtggtcaggaacatatatttatgtgtctaggtagccagttgcatttcattttatgaagctaagtgattatgatgattagctatgggattaacatacgttttcagctaagcaagtcattaaaaacaaatgcaagtacaattatctcctcctttagcttcagtaaattaacatgttatagtaagaaccttgttcatttgtatgatgctaggaaaaagccacacaaatgacctgctttttactttatatttcggcagctataattttgtaaaaatgggacatgttggccatctgaaaagcacttagttgtataacttctacaagtcattgaaagtaattatcacatcataatccaatgttttcctgaggttcccatgggaagtaaagtatattctatcctgatgtggtttggatgtatgtccctgtccaaatctcatgtagaattgtaatcccagtgttggaggaggggcctagtgggaggtgatttgatcatgggggcggatttcctccttgctgttcttgtgatagtgagttctcacaagatctggttgtttaaaagtgtgcagcacctccctcttgtctttcttcctccttctttggccacataagaccatgcctgcttcccttttgccttctgccatggttttaagtttcttgaggcctccccagccatgcttcctgtacaacctgtggaattgtgagtcaattaaaccttttttctttataaagtacctagtctcagttagttctttatagcaatgtgagaatagactaatacagcaaattggtactgggagtgggcatttctgcaaagatacctgaaaatgtggaagtgcctttggaactgggtaatgggcagaagttgaaagagtatggagggctcagaggaagacaactgggggaaagtttggaatttcctagaaacttgttaagttgttgtaaccaaaatgctgatagcaatatggtcaatgaggtccaggctggggaggtctcagatggaaatgagtaacttattgggaactggagcaaaggtcacttttgttatacactaggaaagaggttggaggtatcatgcccctgccctagagatctgtggaactttgaatttaagagtggtgatttagggtttctggttaaagaaatgtctaagcagcaaaacattgaagatgtggtgtggctgcttctagcagcccatatttatatttgtgagccaagaaatgacctggtactggaacttatatttaaaagggaagtagagtgtaaaaattttgaaaatatgccagcccagctatgtggtagagaagaaaaatccattttctggggaagaattcaagctggctgcagaaatttgcataagtgaaaaggagctgaatgttaatagccaagacaatggggaaaatgcctcaaaggcatttcagagcagctcctcccatcatagggtcagaggcctaggagggaagagtggttttgcggactgggcccagggccccgctgacctgcgctacctcaggacactgctccctgtgtcctagctgctccagctccagctgtggctaaaagggccctagatacatcttaggccactgctacggaaggtgccagccataagcgttggtagcttccacatggtgttaagccttcttgtgcacagagggcaagagttgaggcttgggaacctctgcctagatttcagaggatgtatggaaatggctggatgtccagccagcagtctgctgcaggggtggagtcctcatggagaacctctactagggcagtgtggagggaaaatgtgaggttggagtcccccacacagagtccttcactggggcactgccttgtggagctgtgagaagagggccactgtcctctggaacccagaatggtagatccactggcaacttgtaccatgtgcctggaaaagctgcaggcaatctataccaatccttggtagcagccatgggagctgatccctgtatagccacaggggcagagctgcctaaggccttgggagcctagcccttgcatcaggtggccaggatatgagacatgaagtcaaaggagattattttggagttttaagtttttttattttttatttttatttttttgagacagagtctcactctgctgcccaggctggaatgcagtggcatgatcttggctcactgcaacctctacctcctgggttcaagtgatgctcctgcctcaacctcccaagtagatggaattacaggtatgcaccaacctgcctggctaattttcatatttttagtagagacagggttttgccatgttggtcaggctggtctcaaactcctggcctcaagtcatctgcccgcctcagcctcccaaagttctgggattccatgcgtgagccaccacacccagccaggagttttaagctgccctgcttggttttgaacttgtatgggtcctgtagccccttagttttggctgatttctccttttgattgggtgtatttccccaatgcctgtaccctcattgtatcttgaaagtaactaacttgtttttgattttacaggctcctaggcagaagggacttgccttgtctcagatgagactttggaccatggagttttgaattaatgatgaaatgagtcaaggctttgaggaactgttgagaagggatgattgtattttgcaatgtgagaaggacatgagatttgggaggggccagaggtggaatatgtggtttgggttttgtgcctgcccacctcatgtcgaattgtaatcctcagtgttggaggagggacctggtgggaggtgactggatcatggcggtggattttccccttactgttcttgtgatagtgagtgagttctcgtgagatctggttgtttaaaagtgaaacccggggtacaccatccagacaggaagccatgaagagaaagggtaggtgatttcacgcaggaatgttctatgagccagggcagcatacatcacttctgaccagaactcagacacgtactacaagggagcctagaaatgtcgtctagctgtgtgtccagaggaaaagaaggaactgggtttggtgaataactaaccacaatgatgataaacttttaaaaattaatcacattatctataactgcccctaaactgcttcaaaattttcacaacagcctcattcacccaatttcctattgacaaatatttattgttctcctgtaatgtgtcagagacattgagccagagtggagacagtagacgtggtaaaaagttgatcagattactgatatattttaaaggtaaagtcaataggatttgctgatggactgaatctgggatataagagcaacagaggattcaagaatgactttcagattttgggcatgagcaactgggaggataaaggatgccatttattgaaatcagagcactgaggtagagaggtcattttgtgggttggggggtggggataacttaacagtttgctctggccatgtcaagtttgaaatacctcttagacatcctagtggagatgccaaagagtcagttgaataaacaaatcttaatttttaaacaaagtacaaccagagccagcttcatgagtgggcaacccatgcagtcccacagggctctcctacatggaaaggtcccatacttgatgtaatggtttactgttgcagtcttgaaatttttaataaattacttagtaagtgctccgtatttttatttttcgccaggccctacaaattatgtagcttgtcctgggaggaattctttttgaggcagtggaaacttgtaagtgtggggttctgaaggcaaggaaaagaaaaccttttgagaagaaagagattgtgagagatcaaggaatataaagaccaaaaaaaaaaaaaaaaaacagtgggaattatcaagatggaattgctagtgatgtcgacaagagccatgtccaagggtggagtgggggaggataaaaatcctgttggaatgagctgaaaagaggagagctgcctatggccacagtttccccctgcagggagcagggaaatgggatgatagctggaaggttgtgctgagtcaaagcatgtttttgaaaaatgagagaaattaaaaatgtttgtctgctgatgtgagggattcaggagagagggagaaactgatgatgcagtggagaaagggaagaattacagggaaagtacgtaagtcaaggacaatggaggacatgtggaggagctggctgtaagaatagtcatgtgattccatttcaaaagcagagaaggcagatttctcaagaccatgtattgaagagactatcctttctccacatatgttcttggaacctttgttggaaatcagttgaccataaatgcatgggtttatcactggattttctattcccttccattggttgatgtgcctgtttttatgccagtaccatactattttgattactttagctatgtaatatgttttgaaatcaaataatgtgatgcttctagctttgttctttttgcgcaagattgccttggttgttcgggatctaaaaaagtaagaaattttgtcatttgtgacaaaatggatgaacctggaggatattatgctaaatgaaataagccaggtactgaaagacaaatactgcatgatctcacttatatgtggaatattaaaaaataaaactcatagaagcagagagtagaatgatgattgccaggggctgagggtaggggacggataaaggagagctgttgttcaacgggcacaaagttttggtgagacaggaaggctaagttctggagatctattgtacagcatgatgactatagttaataataatatatggtatatttgaaaattgccaagagattagattttaaatgttataatcacaaaaaaagataagtgtatgaggtgctggatatactaattagcttgatttaatcattctataatatatgatattatatatatatatcaaatcatcacattttatagcataaatatatataatttttattttccaaatataccttaatttttaagaaacagagaaagcagagtctatgggttccagaaggttggcaatttggggttggttctagaccacgtgcttttttttttttcttaatggaatatgaggtgaggtcagcagctgaggtggtgggaggagtcatgagtttggtaagagtaacttcagagaactgaaaggttaatttactagaagatggtaagattgctgggcaatcctgtgctgagttgccatttgagattttgtgaatatccatttgctgtcaacatcgtcgagtgatgtttttttctccagcatctttcagctgctcaggtgcaagtacagagtagagggatagttgagtttagacatgattggttctgttatggctcttattttacagatgaagggactagggttcagagaagaaagtaacttgctagtaatggacagagtttgcacataaatcttctctgaccctcgactccaggctcttaagcagtatgtcatatttcagagctgttcttaatatcatggaataaaaagtgtagattctgcaaacttctatcccttcccctagtggcgagcaggtgaataagcaatactgtaatttgtatctcaactttttttttcctactagcattatctaaaaagggtatctcagctagttaccaaatcccagccttgggaatcacaaagcaatattgtgcattgaagatatgctcatgggatagaaaaagtatcactgagtttgatcaccatctctcctgcctgctggccatgtgacttgcagcatggttgtaagaatctgttcagcattaactgagcacctatggtatgccaagcagtaaggaagatactgagaagatattgatgaaactgaattttgtcctcctaagaattatagtccagggaattcagtgagatagtatatgcacaatgttgtgtccaacacagggtgggcacttaataggtgttaattctctttgccttctctatccatttgtcctcaagtacctgatgacacctcttggtgaaaatatcaacactcactgagatactaaatgagggccccactcatgtgtaaatatccaatgatgttaatatttaaaaattagttcccatccactgaatcagaatctcagcaactttgagtgaaggcaggacccttaactgagttgagtcttcctctacccataaaaatatactgtatataactttttcctgaagctattggaatgaatacaagttagcatgattgtctactggcaatactagaataatctccctaaggcgtgctgttttctggctggaagttattttattctgttgaaatgtatttttttaaatgaaaggggcatttccttttcctatattatttgctttcaaaaagcgaagagaattctttaaacatggcaaattaaccactggtgaatcttaaattttaccttctcaatgatgcatgttctgattcaccagtcaatatttatttctaagccttcagatctcaaaaaggtctatatggtacctgagttagtgcatctcaagtaaccaacccctgggaaggtgttttatttctgtaacacaaatgaggcaggattttatgcccctggaggggagatgtttgtcttttatctctatattggggtacctaatacaggaaagagtgttaaatgaataaaggaatggacccacagtggggaaaaggagcttgcttgatatcagtgtgtttgaatttattaccatgaatctcactttctaaaattgctagcactattaaagtttctgacagtgaagcaagccattggaacatgtttgtggtgtgaatattaggtgtattattatgcactcaatttagcttttttattttatataatttctctccaagtggaaatcatgttctaggtaaaggaacaagaaattaagcagtgtggaggttagattcaacttccactaatggagaagatgactttggataactattggctccagtttcatttggggattagggattggattagaatttgtaaatctaattgttgtttctctgtaaaattgggagaccctcagggttgagagcagatcttcctcttttgcatctatttcagcacctagcccagtgcattgtaaatgcttaataaatactagatgaattaaaagtgaagtattctatttattctttagagaaagatacacagacgtttttgccaaccagcagaaatgaaggcagcaaccacttctagtttatcttgtattcctagcatcaggcaaaatgatagggacatggtaggcatccaacaactgttaattggctcctccaatcacccttttttgtcatccttccacaggaatttattgaatgccttctaagtgtcagaaacttggtttatattaatgaaagaacacattccagaggagtagttttatttgtataggcaattacaaagtaatgggatacaggttataatagaagtatgtaaaatttcactgaagttcacagggaggagaacctcatctgctcgggagttggggaagacactccaggatgatgagggttgagctattgaaagaggaatgggatttgttaaagtggaccagggtttgagggtattagaacacactccagttagagaagatggcacacacatgttcttggagctgtgatatagcacagtacacattgtaggggtagtttagcatggctataggaagaagtgggtaacataggggaaggaggtatggacagaattgagaaacagggatgattctgggaggttattagaggtcagagtttgaagaacatctcaaaacaggaaatactgactggtatctgagcttctctagaaggctgaagttaaattctataggtcatgtctcagtaatagcagtggtagtaatagcaatggctaatatttattgagcatttgttagagacaggtgcctttctaagcatttcatcttcttaataacttataaggtagatattgtctttatcctcatttgacagatgaggagattgaagcgtagaggtgcctcattcaaggtcaccgagcaagtccagactttaactcagagggtctggctgcagaatctgttcttaatcactatattatattacaacgcagaaaatatagtgttgtaatgctccaaagttaatttatacaataatacaatcacaaggattagaacttcattctcactttaaatccaaacagcagcatgaatcactgcttctgcctttcatatgttttttaatggcttgatcattgtcttcctgatgatttgattatgtgaggagggcaagttaaggtcactgccactaggtgctcactgttgttgcccatatgcaagacctcagtaaaagatgtctatatggcgaatgtaacttttagccaggtctttgcgctatgagagtatttagtctgtctgatctttgaagatatctatgcatggaccattggctctaaaatccccctctttgtatccccacaacaatgcatattttcatctagtgtactcttaaaaggggccagattttgtgaacatagatgcctgtccttcagagtttatttatagaatatgctccaagctcaattcccacctatgagtgagaacatgcggtgtttggttttttgtccttgcgatagtttgctgagtatgatggtttccagtttcatccatgtccctacatggacacaggaaggggaacatcacacaccagggactgttttggggtggggggaggcgggagggatagcattaggagatatacctaatgctaaatgacgagttaatgggtacagcacaccaacatggcacatgtatacatatgtaacaaacctgcacgttgtgcacatgtaccctaaaacttaaagtataataataataaaataaaataaaaaaagaagaaaggcaggaagaaatggaagaagaaaaaaacccattcctttatattataatacaaatgcatattcatattctgaattttaacattaacattataataaaactgtttttatctttaggaaaaaaaaaaaaaagaatatgctccaagcatttgcttctcaaattctccactattggataacaaataagccataatgtaacaggattttcatttaggtttttccattaagccttagccatggattgtgatggtatctggttgaggccagatctgagtttagtttttactctgctgccgaaattgttgtgtgatcttgagccagtcattgcactgttctcaacctcagtttcctcatctggaaaatgagggtgttggagcagacgatcagtgagctttctcccaactcttaacattctctacttgtagagtttttataatcaaacacaattatgtaaaagagagaaaagcagttgtcatggaaactgttatttaatacataacactgtttcttaatcagcctgttttccttgaagaaatttgcttctcttgtgatacaggcccaaaggtctcctaattctgcctttagaaaggctcagatttcagttccatcacttaagaattcaatgcatggaaccagttacttaaccaccctgtgcctaaattgctttattctaaaagtggtattgacaagaatactgacctcatagtgtggagcatcaggcctgatgcacaacaacaaaaatgttaatgataataataccaatacagataatattaaaaatatctaatgtttattgagttacttattgctactctgtgctaggcattagtaaatgtattaactcatggaatcttcaaaccaaccctgtggggtaaatgttactattaatctcataattagatcaagttacgtacttgtcccaagtcacacaacttgaacggggtggaaccagaatacttgtcgagctacataggccaatttcagagcctacactctgaaccattaacgtttctcaataataacactgttaatacataattgtgaataaccagcatcttttatggcctttgctatatgcccaaatctgttctatcctatgaggtagatgatatcatcatctctatttcgtagataagaaaactgagacctctagaggttaattaaaaacacatagttggtagtagtggaggcaggacttgaactcttgcagtctggctcctgagttcatatttttaacgatgatatctcagtatgagctattattaccctacatccagttcagttttgtgtccatgaatgatgtaagatgattatagctccacccactagatgatgtgagcctttggcagtcttctggaactctgttttttttgtttgttttttgtttttttgtttgtttgtttttgagacagagtctctctctgttccccaggctggagtgcagtggcatgatcttggctctctgcaacctctgcctcccgggttcaagcagttctcccttcctcagcctcctgagtagctaggattataggcacccgccactgtgcctggctaagttttgtattttttagtagagacgaggtttctccatgttggccaggctggtcttgaactcctgacctcaggtgatctgtccgtcttggcctcccaaattgctgggattacaggtgtgagccaccgcacccagctggagctctgtttatgctctttgttgattccctattgtgctcctaactaccacaatcgtttatggaaaagccaagctgcgacacaagtatcttgccatgtcttataaaataaaacaagaggagataagtacaaaagtctatgaatttcaggccagtaagctctaaaatttcaaacagcaaatacagtccgtaaaacatttgagagagagtttacttcagtagctccaattatctgagcaatgttttccaaataccttagcacctattgatctaagagtgaagtaggagaacttctttaaagatcagatagtaaatattttcagccttaagggccataaggtctctgtcatgactgtttaactctgttaaagtgcaaaagcagccatagatgatagtaaacaaatgtatctgtgtttcaataaaactttatttacaaaaacagatggtaggccagatggcccagaagccattgcttactgacctctaatctaagagagagatagcctactgataaagtatttaatgccaatgggttttgggataagtggcctcttgtacgtgcataaaagcaatagtaatgacatgtttattttttccttccctcctcatttttaatgagtcctgatcttgctgttccacatttactaaattaggtactggcaaaatgtgatagtgtaggcttacactattcacattactatctgctacttgactcaatatattgaaatttgactttaaggacagactttcagcagtaggaagcaatgttgacaaaacaacttttaaaaaagatcatatagaatgaaaacgtggatatgtgccttgttttgagctatctcaaatccttttgctaaataagtagggggtaaattattttaaatggggaaaatggaacacaatttttaaatattttaaggcatttcaaatgggccttaaaatacaacggttgtcctctggagggattttcattaattattaaccatatcagaaatgtaattaagtcagtgctgaaattagtcaagatcagctttataactcaaatcacataaataacatatatgggttctatgaattaatcattgtagatttgattaaaaagttccatttcaaagttcatgcaatttaatgtcatgttgtttctgtttttcaaacatttgttaaaccaactgtctatagaggcacattatatggctaaagatctaattgcaccattgttagcatagaactgtagtcagtaaataattagtggcttgcattgtgaagttttgataaatttttaggcttctctgaattaacatttgtcttatggtcagttaaggaaattaaatatcgattaaggaaattcagacagggcagcttcacagtctccctcctccacagggccccccatgaccactgccttggaggctgtgctgactttggggaaggcctatcagtggctgtgacctgggttaagctgatggaccaggggcatttttgagaatattgattagattaaggagaggtggggacctgtattagttttttattgcttctgtaacaaattaccacacactcagtgccttaaaatgtcaccaatttatcttacatttctgtgagttagatgtctggtgcaggtctcactgggccaaaatcaaagtattagctgggctgtgttccttctgtctttctggagactctaggggagaatctgttttatggcctttgttttttgggatggaatctcgctctatcacccaggctggagtgcagtggtgcgatctcagctcactgtaatctctgcctcccgcattcaagcgattctcccgcctcagccccccgagtagctgggattacaggcatgcgcaaccatgcccagctatttttagtatttgtagtagaggtggggtttcaccatgttgtccaggctggtcttgaactcctgacctcaggtgatccgcccgccttggcctcccagaatactgggattacaggcatgagccaccatacccagcctcggtgccttttccagctcctagggctgccacatccctagactcatggtccctctttcatgtttgaagccagcaacataatgtctctctgatccaagccaccaaaggttctctgtttttgaggtcttatgtgattagattgccccccttccttttggatatcccaggataacccctccatttcaaagtccttaaatctgcaaagtccctgttagtcccatgtaaggtgacatattcacaggttccagagatgaagagttgggcattttagcagagccatcattctgtctaccacacaaccgacattcagtgtattggattcactgtcggcgcttcctctgtttaccagcccatcttcttatgtttcagcttcttgtgtcctgacacccatttttgtctcagtccactttaaaccttgttcttctcagttctcaatttctctgaccttcctttagcatgcagtccagtggaccttcttctgctgagagcagtattgctggccaggctgtctgggttcaaagctaggctgtgcctcataaacatgacctttggtaagttatgcaatatctctgtaactcagttttctcatctgtaaaaggaggataaagaatgtgcctggactacatatgattgatgtggtgattacatgcattaatatattcatcactcttagaacaatgcctgagacatagtaaaccatcaatacatgctaaccattgttgctgtgaatttggttactctccttttgggtgctggtagaaattccctcaagattttatctgtgatttcttgtattttcttcggaagttgcagcttctctcaaagctttagcattcatccctaggcaaagaactccagctggacgcatttccaagctctatacctttatttctggcagtactaggtgaacatttttgtttggatgtcccaggggagccacaaagctgaacttaacatcttgcctaccgaaatattccatccgtgttcttatttctattactgtctttagatccgaagtcaatttttattctttccctctcatttaccactaaacatcaaaaaagttatcaaatactaaagactctactttcaaactatcttttaatctatttgtgtccccacttccactgctctgatccaggcttctatgaccgttaccctgatttgttgccccagttgaagtagaacagtattcttaaacctttgctctgattatgcaacccccacccccagacccgcccctcccttccaccttgctccagcatcttaagtgattccccgctgtcttagcatggagactacatccagtgtagcatataagtgagttttcttcaggaattccctaaaaatttaaaaatttcatacaaaagtatgttgtgaagatcgttgctttcagtctcaacaaccagtcactgctcacgcatcttaaacatgcttgaaacaggacatcttttcctttcatgaatgagccttgttctttcatacctgaaccttcaccatggggggcgtgctcttctcctccatctctgcctatgagaaatctacccagcaatgaggcttagtgacaatacccaccactctctttgtgaagccttccctggtagcctttccctgaaccgtgtaagtcagaggtcagcaaactacagcccacaggccaaatccagcctattgcttagttttataagttttattagaactcagtcacactcattcgtttatgtattgtctgtggctgcttttgggtctacagtagcagagttgagtagctgcaacagagaccatatggcccacaaagcccaaaataaattatgctctggctctttacagaaaaaaacatgctgacccctttctcccctcagagattacatagtctaccttgtgcatctttgacatctccttctgttagagtcacttctgcacaacttttttcctggcaagaacgatctcctcttgtagacatagattctgcctttttcatccttgtttctatccttgggcctagcaggggtagggctcagtagttgttggggacaatagattgcctgtaaaaaaattttttaaactacattttgctcacttggctaagtgacaaaaatcttatataaagcagtgttccctttagggggttagtgcttatcatttgatgtttctggtagtaaaccatttcatgtttcacttcgagaagcgcttttttgactgccaagataagctgcaaaattgagtccaaggatcttaagaaataatattcctaagccatttaagcagctcacttggtgatctcatttaataagtggtccactgaaatttaggattgcagagtatactttttcattatgcatgggtttcaccatgtgaggtagatatctagttcctactcagctatttttgttgactgcctagggtatgataatatttgaccatgctactctcttatgaaaaatgccaaatagttaaatttgttttaggaaaaccagagattcctctcttgctcctaaaggagaaaccaaatgaccctgggtttctttcttttttttttttctttctaaaacccaagaagtattgatgtcatgtcctcctgcgaagtgcattagctgtccttgcctttgctgctttagtactggggaatgcctctgtcagacagtgagctcatgagtgcaaggactctgtcttttaatttctgaatcctcagtgtttggcacagagaaagctcttgacaaatatttattaaatgaataagtcaataaataattgaagatctcagaaagaaccttttccccaaggtattacttttaaactataaacttacaattgcctacttctatctagttcacatccttaaatatcacttgggagaatttcctgttgtgatgatatagagtttatgtctagctgtgggaggtcaagggtgggctacgttgtgcctaagtccacagaacacaaggaaaacccttaaacttttgtgaggtgaccggaaataaatatctgcttcctaagtatttccctgagtgagaatgtaaaggtttaagataaattaagtatcacagggtgagacaaagtgagaaattcaggatttagattggcattcagagcagggagggaaaaaaagatgacccaaattgacacaaaatgagaaaatcttgggaaataaaagtaaacggtagcaaatgtgatgtatttgagaaccttacaaggaggttttcagtatgttccagttgatttataggatgtagaaacattaagtgttaaaatggaaaggggtggattttcaagactctcacagtgagggttcagttaggaatcagaattccaacaaacaaacagattttaataaagatgttacaaaggagaggctgggttatggaaattgacaagagatggtgaagcacccagggtctagcaagggtgaggagcctttataaaacatgcctcaagaggcaagggcaatattggagccgcgcaagagcaggagccctgggaaaggggctacccaataggagtagaccttgcagagggctttccaaatggctagggccctcacaagtattcacacaggaagggagcagggaagaagtaactcagcctgtttttcctcccaacctttagctccttcttgtgcctccattggctgaggccaactggaggcctgtgagggagcccaggtgatgaaggagtcaccttcccaggacacagaacaggtggagaatggatttgaagtaggtggaggcccacaaaacgtcaccagcacagggaccatctccagcctttcagtttacaaatgaggaaaacgaggcccagactgggggaaatgaacaccttggaaattcatccctttcagccttaacacttaatgttcttttttttctttttataggtagtctcttatttttattattattattattatacttcaagttttagggtacatgtgcacaatgtgcaggtttgttacatatgtatgcatgtgccatgctgctgtgctgcacccattaactcgtcatttagcattaggtatatctcctaatgctatccctcccccctccccccaccccacaacagtccccagagtgtgatgttccccttcctgtgtccatgtgttctcattgttcaattctcatctatgagtgagaacatgtggtgtttggttttttgtccttgcgatagtttactgagaatgatgatttccgatttcatccatgtccctacaaaggacatgatctcatcattttttatggctgcatagtattccatggtgtatatgtgccacattttcttaatccagtatatcattgtcggacatttaggttggttccaagtctttgctattgtgaatagtgccgcagtaaacatatgtgtgcatgtgtctttatagcagcatgatttatagtcctttgggtatatacccagtaatgggatggctgggtcaagtggtatttctagttctagatccctgaggaatcgccacactgacttccacaatggttgaactagtttactactcatctgacaaagggctaatatccagaatctacaatgaactcaaacaaatttacaagaaaaaaacaaccccctcgaatagtggacaaaggatatgagcagacacttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggatgtaaactagttcaacacttaatgttctatatcctcataaatcagtgttcaaatgagaaagacaataaggactgactgaataaataaatggaagaataaattaatttgaagaataaatgaatttttcatatcataaatccatttttcaccaacatgtttgctaggtggcattctaacctatcagtggaccataatatatttaactattgccctattaacagttatttttctagtttctaatattactataatcataattattatagttatgtcagtattaattataattatgatactaagtactatttattgagtatgtcaggcaccatgctgtgtgaaaacatatactttttttagcccttattatgaatatttgaagtatgaatttaaactcccattttgtaaaagaggaaattgaagctcacgtagtaactcaatcataactcatcagaagttccacagctactacaagatagacccagaatatgcacgaatatccattcaacacaaaagtccatctctctattgcttccctatttaataaaaattttgaatggaacattttcttacgtaactgttagtatgtcttatcattttcttgagataacttcctagaagtagaattcttgggtccaaagagatgatcctatttttaagtagtaagaaataacatttagttgcaatttgaaacatattaaatatctgtgagagaaaccttatatgggtatgaaatttttagttttgtcaaatgatctgattgcgaatggtgagatagccatgtctgagagcccccattttcttatgttaccagcagtgaagagcatcttttttaatagcctgtattttttagagcagttttaggttcacagcaaaattgactgcaaaatacagacattccttgtgtatctcctgcccctacatgtgcatagcctcctctattatgaccttcccacaccagagtggtacaattattacaattgatgaacctacattgacacatcatcacccagagtccatagtgtgtattagcgttcactgttggtgttgtacattctgtgggttttgacaaatttattacaatatgtatgcaccattatagcattaaacagagtagttttattgccctaaaaatcccttgtgctctgcctatttctccctcctttcttctttcctcgtggcaaccactgatctttttactgtctccatagttttgccttttctagaatgccatgtagttggaactatgtaatatgtagccttttcagactggcttctttcacttagtaatggttcttgaacatttaaggtaagtaaatggacagttaaggttcccacatgtcttttcatggcttgacagtttgttttgttttaatgcttaataatattccattgtctgaatgtatcacagtttatttgtcagtttacctactgaaggacatcttggttgtttccaagttttggcaattatgaataaaactgctgtaaacattcatgcgcaggtttctgtgggaacataagttttcatctcacttgggtaaataccaaggtgcatgattgctggattgtatggtgagagtaagttgagttttgtgagaaactgccaaactgtcttccaaagtggccataccattttgtatttccaccagcagtgaatgaaggttcctgtcgcactgtattcttgccatcatttgatgttgttggtgtttttgactttcactattctaatagatgtggagtggtatctcgttgttttaatttgcaattaattacccaatgacatctacattattttttaagatttatttttattttaatattttatttatgtacttattttcaattaacaaataaaaattgtatatgtttatcatttataacataaagttttgaaatgtgtatacattgtgggatagctaaatcaatgcaattaatacatatgttatatcacatacttgtcaatttttatggtgagaatgcttaaaattactctgttagtgatttttaagaatacaatacattattattaagtatacccactattttgtataatagatccccagaacttatttctcctgtctaaatgaaattttgtatcctttgaccaacatctccacaactgagctccaccccccagcttttggtaaccgccattctactctctggtacttatgagttcaaaattccacaaataactgagatcatgtggagtttgtcttcctgtgcctggcttattttacttaatgtcctccaggttcatccatattattgcaaatgacaggattttccttgtttttctttttaaggttgaatagaatgtctttgaatatatccaccacacattttctctgtcaatttttccattgatagatacttagattccatattatggctgtgttttggctattgtgtctaaagttgcagtgaccacaggagtactgatagctgttggacgtactactttcatctcctttggctatatactacaacatttaaagagttttaaatcactctttatgaattaaaaaaaatctcaggttgttttcactgtagatgggctagtagggttgaggaaaggagagtgggaaggctaagctattcaaggttgtcttcaatgaccactttcccttactcaccccctcttccaaggtcttagctaatctcccagggactgaacactctccagacaaaatcaacgtaacagaagtctggcatttgagaatatttgagtttagttacctgtagtcttccttaggtatccctagaaagattagttcctggataaccacctccctcccttccccagataccaaaatgttcaagtcccttacatgaaatagcaaagtatttacatattacctatgtgcatccttccatatactttaaataatctctagattacttataatacccagtacaatgtaaatgatatgtaaatagttgttatactgtattttaaaatttattttcctttattattgttttaattgtagtttttttttttctgaatattttctatccgaggttggtttattccacagacatgggaactgcagataaggagggccgtctgtactttgtttgatacctgtcctgccggctccctgccacccccggcaccctccgtttctttctagaactatttacattaatgtctactgtgagctaggcattgtgataggcatgaaataagacacagtcctggccccacattcaggggacatatatatagacaatcacagtgcagttgggtaggtcttggtgtagttatgtaccaggtgctaacagagtgcaggggagggacatgtgagctgagggttctggggatgcttggtagagttaggggttgggaataatggggtttcttcagaagggtggtgaatgagctgatcttaggagaatatattggattagggctatgaaagagagcatttcaggcaagaaggaggatttttttttttttcatgaactcactacttaggaccaaactgtgagcaccagcactgtttcattttcaccttatggagaccattattggaggtgtgttcatcaagttttttctatgaaccaacaaacccaaatctcagtggttcacacccagaaacatttgtctttttgttcagagttttttcaggcagctgttgtttgcctgatattggctggtttaagtaaggcttggtccaggttgcagatcaggtttgagtttgttcttagtgtctccttctgggacccatggctagtcgggacatgtgctttttatgataatagcagaagcaaaagagaccaagcctaaaccacacaagcacatttctgctttcatctgtttgctaacatccctttgactaaagcaagtcatgatggccaagtccaaaaccaatggagcagggaatataccttctctctctattgggaagtactaacaagtcacatggcagagagaagttatgaattacgaatcaggggcaataatctactctgccactgtggtttcctgaaatgaagtcctgatagaatttggtcgcagggggattaaaagggagattctcactcagcctcagcaacaggaaagaaagaagttacaaaaagcctgtaaagaatctaaaggaggatttgaaggagagaaagcaccaataatctaactgcagcactttatttgaatttaagtaacgctggtcaaacattcttacaggctcttaccctttctgatctataaattcttcatgtagatattgagccaaaggttagatctagaaaatattatatctagtccttagcatgttggtttcttttcaatgcgcttaaacgctcagttaacgtggctttagacataattgtaacagaattacaaaggacagcaccttggcagaaagttcttcctggttttgatgtgttgctactgccagatttttgtgacatgctgatgctaatctgtcaaatagcctgacactaagtgagaagagaaataaaaggaggcatgacagggccaaggacctggtgtggtggaggatggttgggcagtagcaaatcctctcatcagccctactgagactaagcaacaacctatcttcaggtctctgggttcggtggttggggggagcgggggcggtcctacgtgggttagaactcatactactctcagaaatgcacctactttcagttacccaccaattctgatgctcaaagcccctccaaacctgttttctgtgggtccacctgagctcgcttaactaagatagcacaaattctgccccctcttatgggaacatacctaagctaatgacacatgaggtgctacctcttccgcatgtatacctacgtgtttgagctttttcctcccttggatgtgggagggtatcagtctattttataaacattttgtcaagtgtcctttgagtcaaataagagaggatattagaaaagctccagaaaactttgggaggccgaggcgggcggatcacgaggtcaggagattgagaccatcccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccatctcaaaaaaaaaaaaaaaagaaaaagaaaagctccagaaagtttggaaaagtaaattcagacctgagagtaaccaagagagttcccaccttccttctggtcaatgttccaggaaggcgaagcactggatttaccctccactttgcagttaaagaggaaactcgaaataaatattcccttctacaggtttttttttttaattaagaatagatgagtcttatgttttgtgtgtggtggtgacattcaaaacatagtttttcagtgttttgaaaagtaatttacctaagaaatgacaagaagagtaatgcaacacatagacagcattgctgtgagttgtaaaacattgacagaacgacaaatgttcctgtggcatagagtccttctgaatcacagaaatgacatttggatgaaagcaaatcatttttacataggcacactgctaactgtgcagtgaagccagaaatagcacaccttggaagtgggccagagagaaagaacacctaagaattttatgttattcagaaaaattttcactttttcggtaggatttttgaggagtaaagaaaatatttgagagccttaaagaaaatctgagctttgttttttttttttttttgagacagagttttgctctttgttgcccaggctggagtgcagtggtgctatctcagctcactgaaacctccgcctcttgggttcaagcgattctcctgtctcagtctcccgagtagttgggatgacaggcacccaccaccatgcccagctaatttttgtatttttagcagagatggggtttcaccatgttggccaggctggcctcaaactcctgacctcagatgatccacccgccttggcctcccaaagtgctgggattataggtgtgagccactgtgcctggcctttgatttttatttattaaaatattagtcatttattgtgttcccgtatactcatcaagtgtctcttgagaaaactcagaccaagcaggaaacataggcttgatgtttaggagacagagtaaagtgggaggcatgacatggggagctgatcacacagagattacagatggagataaggagtgcataacatccccaaggatggacaggatggagagaagaaaaggccaaaatcaaaactttggaaaatgcccactgtggtgggctgataatggctcccaaatatctgtccacattctaattcccagaacctgcaagtgttaccttgtttgaaaagagtctttgcatatgtggtttacttaggaatcttgagatagggagattatcctccattatccaggtgatccctaaatgtcacaaccagcgtccttataagagagaggcagagggagattagacacaaacactgagaaggtgatataatcacagagatagagattggagtgatgttgtcacaaggcgaggaacaccaaggaatgctggcgcccgtgagaagctgaaggaggcaaggaatggattctccccagagcttctgtctacctttctggagtcttgattggcctacaggtgttcagtttgcacttctgtggaaacagggaacatacagcagtgacacagagccctgccgacaccatggtgagagacacctggccttcagaactgtgagatgataaaatcttgtttgaactcatcctggttgtggtaatttgttaaattgggctttgggaactaatatacccacctttgggaacaggaacagaaagagtttaaaaaagtaaggggaggtagcaagaagcttaagtgtcatgaaaacgaaagccaaagcaagagtttaaaaacagatgagcagaggcaatggtataaacgctagagcctaaagcctaatgggtaaaaatgaagattgaggagaatcattgatatgatagaagctaatgatggcagctaacttgtactgagcacccattatgctggacattgccataagcactctgcagatataaactcaattctcacaaaaccctatcaggtatgaattattgttaccccattttacaggtgaaaaaactgaggcaaaaatttaaataaatgcattaagtaacataggtggtaaatggtgtggccaagatttgagcccagaattctggctacagcatccacattttagccactactttgtactaacctcaccttatcccccaaggtgtgtgtttcccaaggttctgactttgggtcttttatcaagtaaggtagatgatgtgtctcaagaggaaaaggtatttttgtaatgattatttgaggttgaaaggaggaagattaggaactttatatcacctggaccccatcttctcagctgagttggagaggaggctatctgatgaggctgagggaggcagctaagtttctgacctcagggagcctaggaaagacagtgaggatacaataaaacaggaagcactaaatgaaaaacttgctgcacagtgaagcatgctcagtgttatttccttgactggcttttggcactgtgccatctgtgcccaagatgtctgcaccatgtagcgtgccaagtgcagaaggaaaagggactgaaggggcatcatcgccccacacctgccctatggaaagtactttgttcagagacgaagaaggaatccgaaaactgcacaatatgacctttgtcattagaaactcttgaacgtttgagaaatggaccatccatgtactggcagatgaatgagagttcaagggcattacatgataagggctaattgcaagactagagactggagtgggtcagaggaactgaaatgtgtcaaggggaaggtacagctctagatagttcttactaaggtctttgacagctgatcaagaatcaggaggacatttcagcctggacgatgccatgggccaagcatgggagaggggagaaacagatggttctttaagagcttaggccaaaggactctcaacattctgggcttccaatctgtcccccacccaggatagctttctgttaagttactattcagaaccactgcaggcttaaaacaatgagtgtttatattggtattgaatccattagactgcatggtatagtggaaaaaggcaaggttaaaatatcagttaatcactttgttgtgtgaccttggtcaagtaacttctcgagcctcagatttcccatttgtaaaacatagataccaattctcaggctcttatggttgtgatgatacattaatgggataatgatcaatatcgagtgtggtgcctgacatttaatagatagtgtcaacaatttttttttagactaagaacaaattggatgatgtaatttattggctgacaattcatttctaaagatgtgacttcagaatgttctataaatgttaacattttcaaatgcccagagtatattttctatcttgcatactagctatttatttacaaatctctttctcccattgacttagcccttgtgtgaggagagctcttttaggctaggccctttatctgtactttgaggacccttaattcctagaggaagaacatggatttttctcaggcattaaagattccttccaaatttccatgtaacatacccactttcctcatacctatcttctcctggtaatattcttgaattattttttatttttaacattttttgctatgatctacattattatattttaaaaacacaatttcaagttatatattttaaaaaaatgccatttatttccatgatacaatttctattctcatttacgtcattttgtgcttccttcagaaaagttatataaaagctaaaagtgctgtgctgagtcagaatcctgttcccctcagcccaataagcctctgcaaaaaggaaaagaagaaattttttcaggagagcagtctatttcatatttgcagactgagagtgcatgtatcatctgatgttgacttaaaatgtctctccccttcccttcatctgtcatccacaaagctgtttgcattcttctggagtcttgatgggtctacagatggttcagtttgtacctccgtggaaacagggaacatgcaccagtggcacagagcatggtggagtggaagaaaatcactccaccatgatgtggatgatgcatgtgtggttgatgctgtggtgtctgtcctacttatagagagagacctctgggagtagaaggctcatacttgcctaggcacctgagcatcagagtgcctgggggcagcctgccagcctatctcctacggggccacccagcctgacagtcctaacctgggtgaatctcctgagaccaaggcttaggctcacagcattgtgggcttagaaacaacatcttgggggcagactcataccaagcaattcatgtggaggtagatgtgtgaaagcccaggatgtccatctgttagctcacactgagaaccctagctgccaggtagacaggaacactagcgtgaaaactctcttcctgtactggaagcccaatcctaatccataggttatccggtgagcactgttggaatgagggcagttaaatggataaaggagagtaaaaccatatgtcaggactgtctggcggtgcaactggaattcttgaacttagtctgtttcttagatgagtgctgcctatatttgttacagtttgttttaatgatttcctggcttaacaagccctaatctgatttgagtcatccttccttaagatttgctagagtttacaaattggcccaggtcatatcctctttttcccctgggaaaatttaaggtgacccttcttacctttgacatgacctatgattggtgattttgcagtttacctcttagcagacttgttattttccctgtttctgggtttttagtagacttcttattgtagctttaaaataattttttttacattccatttttttaatgttcaatatccattttaatgcatacaacaacattataaggtagatactgttttatatcccatttacatataaagaaacctgagactcagaggctaatgaacttgcctagaaatacctggccagtaaaggaagaggttgtgattcaaacctacgcactctgattccaatacttaagacatacctgtggctacttttctgaatgtttcacatgtactatctaatgtaatccttacagttacacaatttttattaaaaagtacagttctcactcagaaagaaagaaggatttgcataaaaaagaatttcaagcccagaaatactaatattacaggtgtcaggaatagtaacatccagcctacttccagcctttctctctctctctttctctccttccctcctttcttttctccctacttccttctctctctctccctctcccaccctccctccttctttctctttttatttacttacttatttatttatttttattatactttgagttctagggtacatgtgcacaacgtgcaggtttgttacatatgtatacatgtgccatgttggtgtgctgcactcattaactcgtcatttacattaggtatctcctaatgctatccctcccccctccccctaccccatgacaggccccagtgtgtgatgttccccttcctgtgtccaagtgttctcattgttcagttcccacctatgagtgagaacatgcagtgtttgggtttttctgtccgtcaatgatagactggattaagaaaatgtggaacatatacaccacggaatactatgcagccataaaaaaggatgagttcatgtcctttatagggacatggatgaagctggaaaccatcattctcagcaaactatcacagggacagaaaaccaaaaaatccaaaataatttttaattctctttcttatcggtgtttcttagcaagaattcttctgtagtgaagaattttccctcatcaactaataaaaaatggctagtaaaggcaggataaatgcttgctttattccctttattaatcttctgagtaacgaattggtatcttaggaacctccaatggtgaacaatgagtgttttaaaaagatacacattgaactcagcctttctttatacagttgatatgcatcagtagatggagtccatattaatgatgtaatctatataggctgatgtaatcaattctacttttgaggagattgacatgatgtctggaatttgctttaaatactccagcatctaaaaagcaaatcaacaacaaagggagtgggatcgatgaaaaaaaattggaaaaatcttgatatttgttgacactggttgatgagtacatggagttcattatactattcattttgcttttggtatgtttgaaatatttccaaataaaatagttctcaagatgcatataattctaaggttatcaagagtgtaaatgtgagtttagccaacaactttggcctatctgtgaatcttgtggagaaagttcttgatttttattgaaattccagataccccaacagtagttcctaagccctactgctttggcaacagcatgtcaaatatgtgcacattttcccagcattttggaaggaatttttataagaattttcagatttgactgattggatcctgattcataaaagtcttgtcttggtaactaaggatgtctacttttgagtgatgcataccttaagaatttgaaacatggttgcttctgttctctggacttcatatgagagcgtaacagccttttagccattctgaagtgacttcttcagtctaatggtgccatttctcattccaggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatggaaaaaccaaagtcttccacccaggtgatgcatggggaagttcaacggggacccatttcagtagcaacctgaccacagtctgcattatatttttattgtgtaaatatgccatactttcagctaagcttgcttttgttaggagtcttgttctatttccccttctgctcacctcagtcaatggtaaatatcaccaagacgaataagaggggagagagcttggtggttcagagaaggttgaggctatgtgcacagtggtagaatctaaatgaaaatcagagtgcataaactcttgctcagttcaggaaagctcattatataataaaacaacatagagatttggtcattttcctgataatttgctctaagattggtcaggaaaaaaattcaagccaaaaaacacccactttgaaacctaggttatctgtgttggcttgcccacatcctcctgagatcaggagagaagactggagtcattatattatattgttttaagtcttctgggaagcatctgtgatctctttaaaatattaaaatgattctacattaaatgaagtaaaaacatcttatgtgcttatttgggggaaaagctcatttaagtattcattcattcattgaacaaatatgtattgagtgccagctacatgctaggcattgttttgggttcaaggaaatatcagtgaccaaggcaatgttcctgcaaagtgactttatagaaacatcaaattgcgaaagaattcataagtcattgagaataactctcacccaatcctgattcctctctgtaatgtcctagtggatgaccacacagctgctactgaagccagcctccatctctactcatgtcacaccaccttctctctcttagcatgtaaccttgcttcctaacccatcaagaaacaccagggccgttgggcatgaattactggaggtcccttatcctctctcttcaaatgtattgctctttatgcatcattccccactttcctccagttttcagaagatgaggggcctcccactgtctttgaccaagctcttacccatgtcctttagccatggtcacctttcacctcttctgaagcttcctcaggagaatgtgtcctcttgttttcatctctttcacccttccacactgctagctgtttaccttcagtctatgaaaaggctcaagcttctaccattctgatcatttaacactgtacccttttccctcttctgccactttttcctcctcccttccaagccaaacttctgaaaataataatttacttttgattgctctgttctgtcgagagtaaccaacacaatctggtttctagctcctccattccattctggctgtttttgaggccctcagtgacctccttttatcacaatgtagtggatgcttgccagactttcctgatgcaccagaccaaggtggacaacccacttgtttcccaaacactgttcccttggcttccatgacaatcttagggttcttctcttatttctctcgcatgtaactttcctggtttctcccactccagcatctctttcctcctcttgcctcctttcccagtacgtaccaaatccagaatgattcatctgtacccctaatcagttactgtgcttgttctaccaattacagggtccagttcaaacttcttagcatgttaaaaacaaatgccttttgtgatctggcccctactgctttcacccttcattttttgccctcttcttccttaagctttattactatagtgcatcaatcaaggttcaatcagaaaagcaaaaccagtagaaagtatgtactagagactaattacaaagaattggctttcattgtgggagatggctaggcaagtctgaattcataggtcaggctatctgcaagggcaggctggaactcttgggcacagctcttaaaagcttcagctctgcttttaaggcttttcaactgacctagattatcaaggagaatctcctttacataaagtcaactgactatgaactttaattgcatctacaaaacaccttcattgcagcactagattagtgttcattgaataactggagactgtagcctggccaagttggttcatcaaatagaccatcgcatctgagtatatcaatgtgctttcacttctctaaatatgtgatgctgtttcatgcctcccaacctttgctcctgctgttctttcttcccaggataccctggttttgctctgttatctttgaacatgttgaaattacttgtctatccgtccactgaaaggtctttaagggcagggattctggattatttatctttgtactcccaataaatatttgtagggtaggaccgaacaaaaccttcattagctgtgttttagactactacaatagcttctgaatttttctgcctgcctttctttcaacaagtacctgatatacatcagtaaacaaagcagacaaaagtccctgcccttggggagtttacgtagtagctgcaagagataataaataaatatattaaagagaccaactgtgtaatctatattatagttatatgtaagctatatataacatatagtgtttagggaaaggataagtattatggataaaagaaaaagtaggggaagagggtagcatgttgcaatattaaacatggtgatcagggtaggctgagtcacgaagatgtgtaatcactgactagaagtttctgagacagccacgtggatgtctgagcaacttcattccagcagagggacagttagtggacaggttgtagggtaaaagtgggtctggcaatttgaagaatagtatggaggctcctcaacttggagtggagtgagtgaggtggggaatcaactcagtgaggttgtagggactagatcgggcaggaccttataggccattgtaaggactttgagccctatgtgaaaggaagctcttacagggttttgagcagaagaattccataatttgatttatattttaacaggatgtaatatagactatggggagaatagattataggaggagaggataaaaggagaaaggtcagataggaggcctccagaatgatccagtggagaaatgatggtagctctgactaggaacagcagaagtaatggtgagaatttagagtctggatatattttaaagctgggccaacaaaatatcctaatggattggatgtagggtaaaagagaaagaagagcaaaggatgactgaaaagtttttttggcctgagtgaaatcagctgagatggagaaggctgcaagagaagcagatttggtgggtttgagggcaaaggtggggctgagttcagaagtttgattatagatgtgataatattgagagctggcaagatcttgtgggtggtagtttgagctccatgtctggagtttgaaagatgattggtctgtgaaagagatataaaactaatagttgttgacatataagtgctatttaaagaaatgagattgcaagagatgaccaagggaagaagtataaatggggaagggagagcatcaagggctgagatctgggacactccaataataaagggtcaaagaggacatgaaccacgagcaagaaggccaggaaagaagcaccagcaaagatggagaaaacccagaagtgccacatctcagaaattacaaaagtttatcaagaagagaagaatggttttctaggctaaatgttattgaaagtcaaataagatgaggactgagaattagtcgattttagtaaagtggaggtcaatggtgattttgataagagccgttttagtggagtggtggggatgaaaccctgattgaagtggatttaagggagatgagaggatataaattagatgctctgaatatgggcaacttttttgagcagttttgctatgaagtgtagtgaagaaatagggcagcagctggaggagaagtaaggtcaagagtttcttttaaaaatagcagctctccagcagataatttatggtgttcaagagaggggagaatttgtgatgtgggcatcagtgagaggatgagagctatgcacaataggaccatggatagtttatctgtgataactggtgggaaggaggcgtatgtatataatggcaggtgtgctgagggtctaataagttcttttcctatgttgtcagctttatctttaatgtgagaagcaaggtcatctctgagaatgagaatggagccacagggagaaagagagagagaaagaaagatatggagaggggaaatatgtttgccaactcacattaaaagggatttgagattcatagtcatgaaactaaagtaggactagttatcatcattgtgtagtttttaattttgtgtagctacatgagtaaagacatacagttggtggtgagttggatttgaacagcagtgtggttttgcaaaggaagtaggaaagagagaaagggaatcaaaagtgcatggaagggagtgatgatagtgattcattttgtgatttggtaaagagggtacaagacatcaagggaaggaggtacagtgaaaagttggtaagatcaatcggttgaaattcccagagggttcaaaaaattgtgggggttagggtaatagaaggaggatctggaaggataagagaggtggtaagagaatggaatgtgtggcactaatattgtggcacatatcttaataacatttatttaattttattatagtaatatcaacacaagatgctgttactggtaatgacaaggtttaggccaaggtacaaaacaagggactataaagggtagaaggcaagatcattgaatgaaaaaattcctagggactgagaggccaagatgtgaaaatgattgagtcaagaattgagtagctttgggaagaatgataagccaggcattaactttactgagaaataagggaacatgatctggcaggtagcaggagagtacaaagataaagggtagaagatgatgtagtataacaacttgagattcaaggctgaaggtgtttggggaagagggaagaagaatggtctgaaggtggatttgagactcaagaaaggtatctactcctctttcagatgcgttggtgccagggctattggagaaaaacagttctaagtgaaagagccacagggaagcatgaccactgggaagatccaggttttccttagagcaaggtgaatggggcaatctgagaagagattgacgacattcagagaattctggagagcccagtggaaggttttagatgttggacaattgtcttcagtggttctctcagacaccaaggttctcctccagagaggataattagcatcagccttcctcttcttaaaattgttatggctatcccgaagaaagtgcagccttgtgagcccaccttttcaagtcctctccaatttagcctctccctacttttccaggcttatctcattttacactgtcattatccatgttattcagcttcaggcatccacaggctttttagtatttctcaagcaggcttttactcttccattttctttgccattgctcaagctcctctctcatcttggaatatcccttcccctaataaatgtctactagcccttctcattcctcaaaatgtaactcaaattccgcttcctccaagaagctttctagatcttatagtcagaattattcccctacttccccgtgcttccacagaacttagaagccttatcaaagtccatctgtttctatggtcttatagttctcccagaaggcaggaactctcctcaattcatctttgtatcttccgtcactcctaacatcatgcgttgtccctagtaggttcttaataaatgattttatgttgtttgtcaaaatctgttctactcagcagatataggttagcattctgaagttatatggcgtaaatcttaactcttctttcatatgacaatccttcagttgtttaagaaactcatccctagctattttccaggtgaaacatttcctagtgtcttcagtgcttccttgaatgacatgatactcaacttctttacctttgtaccctctccactcttagaaacattcttatttcattgctatctctttgaaaatgcagtgcccagaattgagtattccattaaagtcaaacgcaggcagtgtagattcagtctgtcctttcctttaattgatatcctgtgttgatattactataatacaattaaatgaatgttattaagatattcctaatggtgttttatcaacatgggctaattcagcccacattgtgagttaatatttcaagtctcttccctcaccttaaaaacacatcacttggatgagtacggtggctcacgcctgtaatcccagcactttgggaggccgaggcgggtggatcagctgaggtcaggagttcaagaccaggtggagaaaccctctctctactaaaaatacaaaattagccggacgtggtggtgcatgcctgtaatcccagctactcaggaggctgaggcaggagaatcacttgaactcgggaggcggaggttgcggtgtgccaagattgcgccgctgcactgcagcctgggcaacgagcaaaactctgtctcaaaaaaacaaaaacaaaacaaaacaaaaaaacatcactttacttatctacccatcattttatcatagatccttaaaccctacatatgtcgagtattggttgaaaatataaataaagccaatcctctagcctagaattataattaagaaaaaaatatattaagttacaattagaaacttgttatttaaaaaaagtatttttaaaactcatattattctggcaaggtagaatatgatttcagttccattctctttatttttagtgtacttggacaaatgcatcatagttctctgttgggaaattatggaagagctctcaaactgagtttcttaagtgcagtgagtcatagatcttagtagcagcttggacaatttagtcatattgaggcctattaagtcatccatctattttttacaaagttaataatccctgttcccgaagtgttctctaaggcccactcggattggttactaagaacaaaaagagaatttgggagtcttgtagattttctgttccatctgcctgaacaatttcagtatgtttatcctcctttgagtttacaaacttttatgagggcctactatttactaacaaggatttattgggaatttgccctccttggagtattttgaaatggtgcagaactctattaaacatgggtcttaaggcactcagtcatgtccaagagagacaatcagtcagggttctttgttaccaacaagagaaactaatcatttagtccaaacaaagaaggaatttaaatttgaagaatgtggatggaaaacctaaagagccagccttggaaaaggaatcgagaaatcaagaatagctatttgattagaatagaatatcttctatttgactatctggaatgattgaattcttaccggtttttctagttttgcatcatttggctcacgttttgaagatttaggaggacagttctattggctatgcacctttcctttggttggacagacagtgctgagacaaatgataggacagaagacctctctcttcagccttcatagtgggagggtaggactccttgatttcttctgctaccttgactacacacagcgagggagaaggacttccccaaaaggaaatagaggtgatgttaggaaacaactttatgtggaagaatgcccactacagggacatgtgcttaagctgctgtgatagaagtcaaactgtattaagggctggaacacagaaataaataaggttatggcagcataaccttattatgctgaagagaatttagaaagactcaaaacacatatggtctaccaatttgactttgaaggtcaactaggatttcaacagaaggaagaggcatgaccattcagatgcaggaaagagcataatgataggaacggtgcattacactggttctgaaagcaagctttatcgttaggtgtttaaaagctagatatgtcacctgatggctattacagccttagacaaattacttaatttctctgaatcttagtttctacatcagtaaaatgaggaaattaatacctaccttatagtattagggctgccaaattaaatacaatgttcccaattaaatttaaatttcagataaacaagtatttttgaaatacttgtttgaatttttgaatatttgaatattcctaattcaaatatttgaaattcaaatatttgaaaattcctaaatattgcatacgacacacataataaaaaattatatcgtttgaaattcagatttagcaggacatcctgtattgtaatgtattatgtctggcaatcctacatagccttgttatggcaattaaataattggtgtagaatgtccagtttgatttttggcacatacttggtgttcagtaataaatggttgataaataaagaaatcatttttcttgtcaccaacatgataagcaaaattcagaaccctgaaagtacctatgcctcagaatccttgttatctcagttaccacttcatttagcagtttcccagttaacttgtgctagaataccaataagatggtctctcattatgctgtataaatacagaaaccattcatcttcatcttgtatttgtatggtttctctttccttctgattgtttcaattctttctcctgtttatcaatttcattttgaccttatcctttagacactcataattaatgaatattattttctgcttcctttatggaccaaaaatataagtggtaaatggtactaggtttgggactataatttaagactcaagagcatagtaaactgaagcactgattttgatttttttgagtttgaaactataaagcttagtggatatagatcaaattatcccagctaatgactatgccatataaaatagaattggaagctttctgaaatctaaaatacttcttctattgctttttccttatctgttagacccatcatacaatcctagagaagtgtcattaatcacagaatatgtcctttagtctcatttagaatttgtaaaataatgttttgccgatatgtgttattcccaagtaatttctaatacaggttcttttatctcactttttaaaacctatggccctttccacatttatgcatgattattgttccctaagaatctatctagtatttaaatgctaggacataattgattttccaggagagaaacattaggattttcttgtttccaaacagctagaatgattagtactgtctgtatacttaggcattaaatgcatagtttgataataataaaattatagctacaatatattaagccctctaccatattcccaacctcaaaaactgttcaactgttttcattcattatctcatttaattcccataatattctcatgctattttccttatttgatgggtggggaaactaaggcatgaagaagggtaagtaccttgcctaaggttatacagccagtaaatggtgaaggcaagattctagctcaggtattcttattctcttatttaatgtgctattactttcttcttcacacaacttggcagaaacatttctagcaaattatcataaaaaagccttagaaaatttaaattaaaagccctgcagtagctcaaaccttagcgtaagaaaaccatactaaagaagggaccagttaggttctgttgattgcttgtgtaatcgtcttcaaagtttattatttccttcagtgtaagtgatgtccactttgtagcttctctttctggtctactatgctctggacttttgtttttcatcctccattttttgggttctgatataataaaattcattcctatttccctgagtttcaaagatttctttctggaaccaatgtcaaggcctggtctcaaattagggaacagactgtcttctgtttctccctttaaagagcagtaccagaagatgtggggagagggagaggagaggattattaaggagagacttttaaaagaagaaggacagtcaagaaagacttgttcctagttctgccaagagtcaggataaacttatgctttagggaaacaaaaataaggaaaagataaatatatgaccaatctttagaataacgatcataatactgcaaccctacatttacttgatattctgttgtttccaaagggctttcacaaatttttctcctgcatttcatttagtcctcatagcagtctgtgaggtggaattatgcctattttactatggcataggaagtgaagttactagctcaaaagtacaaaattagcaattgacagaccccaactaaaacccaggtatttaatttcttatgtggccgggcgcggtggctcatatacgtaatcctagcactttgggaggctgaggtgggcggatcacctgaggtcaggagttcgagaccagcctggccaacatggggaaatccgtctctactaaaaatacataaattaaccagacattgtagtgcaggcttgtaatcccagctactagggaggctgaggcaggagaatcgcttgaacctgggaggtagaggttgcagtgagccaagatcatgccactgcactccagcccaggtaacagagcaggactctgtcaaaaaaaaaaaaaaaaagaaaaaagaaaaaaaaaaaaaagctgaagcaggagaatcgcttgaatccgggagacagaggtggcagtgagctgagattgtgccactgcactccagcctgggtgacagagcgagactccgtctcaaaaaaaaaacaaaaaaacaaaacttattatgggtgttttttccacggtgtcaactttttatcttgaagatgagcattagttaagagtgaaattttgggggctttctatccccttttctgaaaatagacactttattgagaagtgtggctgaggtttgcttataggatctaaggaacctggctgttctcttgaacagaactgaagcgtggatgagataatcagtcttcctatttgtgaatggatttttggggtggctggaagataaaattgtatggaaaaagcgacaagggctactttggacttctgttttatttctcattgcattgaaggtgaatgtggtgcctttcagaacagttagtgctgtggtttagaaataacactgtaattatccttcatttgaatctcttcctctttaagtgggtttttttagatgtgtgatgtgagtttagtcaataggtgggggtgcttaggaaaacaagctattttggtccttggcaaatgtgggcattggtatctgtgttccttgctatcatttgctgagtaacaacattattttttttctaaaaatatataccacattcttctcttatttgcatttgcttttcattttactgagggacatatacacacacattttgatctataggatgcatttagagggaattttctgaaaaatcattttacaaccttttgagcacagaaagtgaatgaagaagagccataaaaaggcagccacaaagaaaagcaaatggttaatttctggaaaagagcattgcgttttgtggaatttaaaactgcttcttctgcctgaggctatttaaaataattttatattttagaagcttgaagagatttaagtacagcaatgtgccccttatccatagctttgtttttcatcgtttcagttacaataagaattctgagagaaagacagaaattgctctatcattattgttataattgttctattttgttattagttattgttatcaatctcttattgttcctaatttagaaattaagttttatcataggtatgtatgtataggaaaaaaagcatatatatagggttcagtactatccacagtttcagatatccactgggggtcttggaatgtatccgctgaagatagggcgggatgctttaaccatttagctcaggattatacaactataactagtagagctgagatttaaaagtctaagcccttagccatggtggatagtcagttaatagtgagcttttattttgcttgattgtctgagtttgagctgacaggccgatgcacaagaggggcagagtcctagcttttttgaggattgtcatttcgcaagggcaatattccttctcatatttatctcaagcccttcatgtataaagacttattcaagacaaaagggtaaacaacatttagtgaggctgaaaattgcacagtttctgttctgtaacgcctcctaatcctgagtttgtctcttctcctcatctgcaagagccctcgtcatcacaacagacctcagcatctaggagattggaagacaccacagaattctgcctatgtgattcacaaatccttcttgctatttgaagctttgcaattctgacttccaggccctctagggaacttttagtgcagggatgcattataacttaggagatcatgatcttaccaatcctggaaaacatagaagcaattctgctgaaggagagccattactggccgatgcagtagaattattatttccattttagacctgagaaatatctgcctgctgttagccaaatgtggttctcccatcaggacccagtaaagaacttggccattaggactactcagcattaatcatttgagggaatagctttagccttatagtgactagtgtgagtgaatcaatatgtttattcctgctaatatgagccaagctttcttctgtaaaagaatgaacttacaacatcataagatttatggttttacacaatactaataaaatgacatgaatattttttgcacgtatgaagcatcttctattgtgaagcttttttagtttatgccacacacaaaaaaaggattttggtaagtgctacaaataatgttaaaaaaacaagatggaactttttttttcagaaccagtagcatttcctacatgtaaatctatggtttccaatttcatattctccagaagagctgaattcatttcctttctctcttcttcagagacttttcttgaacactggctgatgccaggaaagtctgtaaagacagaatggacctccctcccttcttttttatttttatttttttaagatacaaggactctgttgcccaggctggagtgcagtggcatgatcatagctcacttcagcctcaaactcctgggctcaagtgatccttccgctttagtctcccaagtagacgtgattacaggtatgcaccaatatgcccagctaattttattttatatttttttttagagatggaggtcttgctatattgctcaggtaggtcttgaacttctggtctcaagcagtcctcctggctcagcctcctgcagctctggggttacaggtgtgagccaccacacccagccttcccttctttcttaacaccattctccatctcagtactgtcttaggaacacagaattcacctatggggagttcaatacaaaactcccagtttagaaaatgggttctttggtgcctcttaagtccaaaaatattacatgtgaggatttattttagatatgtagctcaagttttgaaatatcactgctacctattctataaaaaatgctgtgtttgagaatttgtattaagtatacctctcaggacaggaactaccaaataaaaatatttgtagaatataaatagaatgtagacagaagctcagctctagcaacagttattatgaggctatcatagaaaatatcatttgtcctcttaagtctgttttacacactccccatcttttctgtgacatggggagggtaagagctgatttgtcaggctttcctttattttggtttcaatatgaagtaactattccaagtcccaggttacaagatttttaaagtggaattgtttttacttagcctaggccccaaacctggagtaggccctcattttgcagagaatgaatatataaaatttgtagtgaagcacctagatctaacatgatgggccaaattatttatgtataatgtctataatttgtactacagcctccaaaaaattttagtttcccattttttcaatgagaaagataaggcttattattatttaatgagtcaaggtcacataaaagtagcattcaaatccaggttagtttagtgccagtatctcctttttcaatcacttgtgttaatttacatatatgacatatgtctataattgattgaacaaggaaaggaattttaagtgatttatttaaagtaactaaactaaggcaatctaatgaaattactaagaatagtgatttggtgagtgagtggagggcaagtggaaagtggtagtaatgtaacttttacattgttatgtgtcacagcagaaaaaccatatatagtatataaaattggaaaatcatgaaacaatgggacacacacatagaaggatccaacagagactcttaaaagtcctttttccactgaggaagaggacagagattgcaaaaagggtagctattgatttttattgtaagccctttggtactttgatattttgtttattatttgataaaatttaacaagattttactaaaaatcaaaaagttatgatctataatatgtctttcacagtaatctactgataacctatcaagatgctttaaattgtagactaaaaaaaaatcagagcgtcttcttagtttatattcattattgttattcataatgtgaaattgcagtgaaagagcattaactgagcatctaatatgttcaaggccttgttctaggttttataggagataaaagggggatacagtttgatcccaggcttcaatgtgttactgtctagttgaaggtgctctcaatgaggaagaaatctagatatggaaaaactaggaacttaaacattttctttgtctgcttcatactgtgctaggtactctgactcatttttcatagaaaacatatactatagaaaagacaaaatataaagagctatgtgagttcagtggatagaaaaatggtttttacttatcaggatcaagaaatgcttcctgaagcagagaattctaggtgggccttgaaagcaagaagggatttctatggacaaagaatggatgggaaggcattgacatatttgctaatcaagaaacttatgtttgaaactcatttttttgttgctgtttctcttgtataaaagtgctttgatgccctggaagttgaggctgcagtgagctgcgattgcatcattgaactccagtctgggtgacagagtgtgactgtcttaaaaaaaaaaaaaagcctagctgtaagctaggtacagaatgaattttaaaaatattgcttgtccagctaaagactttttattaaatgtaaatgctgttaccaaagttacagaatcacaattaagtattgagtataacttctgtccataaaatgtggggaaacttaaagacaaaatggagatcacatggattttgtagctattcttgatttttttttaattggtcaatgtgtttccacatatttagggatcttcttagcttccctctttaatttatttgtttagtttccttaggattgtacttaattgcatgttaattactgatgcccagtggggctgtattttaaagaatcttcagtttgaatctatagtatctttaccatcttgcctagtttttcaagtctttgtgttctgatccaaaggccaagatatctgtggctatggcaaagaactcagattcttaggtttttagaaattataacaaaaagctatatgaataacaataaataaataaaatcagtagtacgaagtaggcatagtacattttttacattgaagtcatttaatctctctcacttgggcactataagttaaaggtggagattgtcatctttgaagattcattggtacactgatcactctccatttaggaaagcttacaaaagtccttgttttacagctccctctcctttgtagtgttagacttaatgaacggcttattgtcagaagttccagaccattacattatactctatgaaagagtattctgtatttcttctagagcagagacagaaaaatatcttatatttgggggactctatgtgtgatcataatgtttagcatgaagagaatgttgcattttgaagctgtttggtttatacattttaaaaaattacatgaatttagaaaatctgttatattaaattggatatttcacatctatggtttaatatctgcagtctttattttcagtcttaaatcctgaactccaaataattattaatctccacaatcccactcttgaatttttacatgtctttaaagttataaaagtgttttgtgctaagggcagttgcaatggctcacgcctataatcccagcactttggaaggctgaggcaggcagatcacttgtggtcaagagtttaaaatcagcctgtgaaacatggaaataccctttctctatacaaaatacacaaattagccaggcatggtggtgcgcacctgtagcccttggctacttgagaggtgaggtgggagaattgcttgagcctaggaggttgaggttgcagtaagctgtgttcgcaccactgcactccagcctaggtggcaaagtgagactttctctcaaaaaaatatttttattcttattgtgaaaaacataaaaaagataaagtataaaacaaaatctacccatcatttcacagctgagggataacttctgtacctattttgagtattttcttcctgttatatttttctagtcatataaatgggtatgttttttaatatgcagtcatgcaccgcatgatgactttttcatcagtgatggaccacataaaccatggtggtcccattaagattataatggagctgaaaaattcctatcgcctagtgatgttgcaggtgttgtaatgtcatagtgcaatacattactcacgtgtttgtggtgatgccggtgtaaacaaacctactgtgctgccagttgtataaaaatatagcacatacagttatttacagtatataatacttgacaattaaactactatgttactggcttatatactctaccttttattgttgttttaaagtttactccttttactgattaaaaaaaaaagttaactttaagatagcctcaggcaggtcttttaggaggtattccagaagagagcatttatatcatgggaggtgagagctccattcatgttattgcccctaagaccttccagtggaataagtgacattgataatcctgaccttgtataggcctaggctaatgtgtgtgtttgtatcctcattttttacaaaaaaagttttaaaaaagtttttaaatttaaaacatagaaaaatgcttatagaatatggatataaagaaagaaaatatttttatggagctataaaatgtgtttttgttttaggcttagtgttatcacaaaacagtcaaaagttaaaaaaaatctaaaaggttacaaagtaaaaacttaccataagataaatttattattgaagaaagaaacatttttaaataaatttaatgtggcgtaagtatacagtgtttataaagtctaccaatgtgcaatagtattttaggccttcacattcactcaccactcaatgactcattcagagcaactttcattcctgcaagctccattcatggtaaatgccctatacagagagaccattttttatcttttatactcgatttttactgtaccctttctttgtttaggtattcaaataccattgtattacagttactacagtattcagtgcagtaacatgctgtacaggtttgtagcttaggagcaataggctgcaccatgtaacctaggtgtgtggtaggctataccaactatgtttgtgtaagtacactgtatgatctttgcacaatgatgatatctaccaatgcatttctcagaaagtatcccatccttaagtgagacatgactgtacttgggacatgtctctgtgtgtgtgtgtgtgtgtgtgtgtgtgtgtgtgtatgtatgtatgtatgtatgtgtgtatgtatgtatctatctatctatctatctatctatctatctatctatctatctaatctatctgtctatattcttgtattggttttcctcaccttttcattataaacgagcattttcccacatcattaagtattctttgaagacagaatttaatggcctgtatgcttcctttatggtgcttcttttgtgtcttatacttctatactgccctctcacatttaaaaaaattattaaaggtttttggaatctttgttattaaaaattctagttatctagtagtcatagctacttctacctgagtttatgagcccctgcttatgacaaataacaaataaataaattgggcttctatttattagtctatttaggaagtcacttgttttttagcttatgtaatgtgttttgtcttgatctgaagtattagaacacaggatcattttactgggttatgttggatttatttggcaaatccagttctcttatctccaatagcctgtgtttgtgactgcttggatatgggtgattttaaagactagtgaagagcatggattgtgattacatatttacacctcaatagctgtgtgactttgggcaaattactccattgcatcgcaccttcttttcaagattaaagcctaaatgatatcataaagtacatagcccagagccaggctgataattgaatatttttgttatttttctgtcattgttgtaattatgaggtctttggccatcaaatagaacaaagctgactagccttagttgagattgaaaagcatcagaacttttctttacccattagaagtaactggccatggaagaaaaaagcaaataacccattttaattctggaccagcaggaaggcgtctttgtctgtcctgtctaagaaactctcataagtagcttcagactttgcaatgaggcagctgcattagtgcatctgaaaagttcactgctgtggctggaatgttaaatagcagttcttgacagtgaccgaaatgcatacctggggtctcaaggaaaggacttaggacttccttttcgttattcacattgttcaatacctagtctgtctctatataaatgccagtgttgctttaataaattattatggatgatcatagtaatacctgtagctgctatttactgagtgctgactacgtgacaactaaggtttttgtgcattatctcatttaatcctagtggctgctctgtgagtctgttatcatcatccctatttcacaaaggaggaaactaaaatttagagaggttcagcattatctaataagaatttcaacgttggtctctcagactccagaatctgagcttgtagctttgctcttagctctgttgttttggttttataattactgcatagcctcattcattcattcagcctgagaatctactttgttgagaatctacttcatgccagctcctgttctaagtgcttgggttatagcatgcaggcaaagtccctgccctcccaaggcttattttctattaaatataatagaatattaagttaccttcaggtgttttactcctagaataagcgttcctgtgaggctatgagttatcttattcttgagctttaggaacgtaaccgaaattttgtataaggctgagtatacctcctaagcttatgagatttctacagaatttctacaaaatactggaagctagggcatgttccattttatgcatcaggctgtttattttagcattggctttttagccctggcagactcctcaaatcggagacgttcttactgattactttaagaagcttttagaaggtttggaaggtttattgttcgtgataaagctactttttgataccttggtttctttgacttccttaaatgttctataggtgtatggagcagcataaaaactttctttctttagaacatgccaaaaatacatcagacaaacctagaacaagaggcttaattacttcatagaataaattttcaaattcggatacagttgaaaaataaatgatgaatcggggaggtctaattatgagggacctaagtattaataccttgtttccgtaatatcaagaatattaaatccatccttaagaatgaattattataagaagaagatgatatcataaagtgtttgtgttaatgtcacatttaatccatgtggaagctgaaaataattttaaatatccttaggtagaggctatgttatattttttacgtagggaattatcagtaaatactatgaagtgtgtttccttataaaaaagtagttgccttattttgcattggaaatacaagtgaacctttttggtcccataaaatgcaaatggcttgtatatgttcctttttttttttttcttaagtcctttgtctaagaaggaggatcattggcaaaccagctagccattcactttggattttgacatagcttctccttgggaccctaatgacagactctctgataaccagtgcaaactccatgaatatctttcatttctctagaaggaggtgtggatttgcaaggctaccagctggatatgcaaatactacctgacgggccaaagagtgatgtggacttttcagagattcttaatgcaatacaagaaagtaagtttcactcaaattttaaattcgccgtgagagaagaagctattataatacttgggaggggtaataaactagaaaccttagatgtcaagctttaaaaaatattaacaaaatgatgtcttgaaagagatactgtgcaaaataattttgaaactagaagagatagtgaaagaggtttaatttgtgagattaaatcacataatagtggaatttttgaaaaagctataacggaatgatcaattctgtatattgtatttcatgtaataatatttagtaaaccttggagtattgtaaatttttagatttcttgattaatcataatcaaagaaaaacctttaagaaaacaaaatacaattcctctgctcaaatggaagtaataagagggaaatgttagtggagcaaggtgaaatcaggaacttcttctccaaaatgagtatctggagtcattgatgatggactgcatgccagaagtgaaccctcattttctaagcattttgagtaatcaaggtttgctcttcttcgagtattttatttctgttttatagctttcactcagaattttatcagaatcaacacatttactcaagttaaatatttagcattgaggatgggtgatgcggtgtctcatactaagtcattaccattgatatttcattatcagagctctaattctagatgatgaagctcctcttaatatcgaataatttatctcatgttggatttgagggattttgatgtgaagaacattgtataaacaaccattgcaattttttcttacttctagttttgggacattgcattttcttttctttttttattattatactttaagttctagggtacgtgtgaacaacgtacaggtttgatacataggtatacatgtgccatgttggtttgctgcacccatcaactcgtcatttatattagatatgtctcctaatgctatccctcccccagccccccaccctacgacaggccctggtgtgtgatgttccctgccctgtgtccaaatcatctcattgttcatttcccacctatgagtgagaacatgcggtgtttggttttctatccttgtgatcatttgctgagagtgatggtttccagcttcatccatgcccctgcaaagaacatgaactcatccttttttatggctgcatagtattccatggtgtatatgtgccacattttttaaatccagtctatcattgatggacatttgggttggttccaagtctttgctattgtgaatagtgccgcaataaacatacgtgtgcatgtgtctttatagtagcatgatttataatcctttgggtatatgctcagtaatgggattgctgggtcaaatggtatttctagttctacctccttgaggaatcactacactgtcttccacaattgttgaactaatttacactcccaccaacagtgtaaaagcattcctatttcttcacatcctctccagcatctgttgtttcctggctttttaatgatcgccattctaacttgtgttagatggtatctcatggtggttttgatttgcatttctctgatggccagtgatgatgagcattttttcatgtgtctgttggctgtataaatgtcttcttttgagaagtgtctgttcatatcctttgcccactttttgatggggttgtttgttttttttcttgtaaatttatctgagttctttgtagattctggatattagccctttgtcagatgggtagattgtgaaaattttgtcccattctgtaggttgcttattcactctgatggtagtttcttttgctgtgcagaagctctttagtttaattagatcccatttgtcaattttggcgtttgttgccattgcttttgatgttttagtcatgaagtccttgcccatgcctagggacattgcattttcttgttaactttcttatgaataattttatgctttttagttatccccatttatcattataccgtcctcttgaccttatgagatagttattacctccaccttacagatggaacaactgagggtggaagaaattaaatgacaggggaagatgataataatggagaccagactgcaatgatggctgtttgttccttcatttaattccttcatgaatgtgctcagtacaggatttaaacacattgaggtgaaggatcctgaaactgaagattaggctacttttaaaagaaatgtttttagcagagaatataaggggatcagctatttattccggttgaacaatccctttatattacattaatgaataaaagagaaaaaatttccacaagagaataaaaatcagattattagacattggagagaaaataacttttcatggaaagttataaaattatgtaattacttcacttgatttgaaagatgataggttgtacagtgctcaaagagttcaaattttttttcaataaatgataaaagttggcttccatgcaagtgctagaggtgaacttaaatttaaggagtgggggctagaatgaacttgcatcagaatgaactaaaggttagtaaggtactatttttatagtaatttttattaccagatcttagtaaagacgtgtgtatctgatgttaactgttctgtagtttagaagggtgatctttctatgaacaggtagaggagtataaatttatgagtacttaacagaagaaaaaggaaatgttacttgactttaaaatgcaaatccagccctttataagtttatgcattttctattgctttggaactaatttattttcttgttgcaaacaagttttgtgctaattagatttgagaagctgcccacacaggctgggtcatttctggaaggaaagattttgggccattcagtctctatttaggttccaaatatgatcgaaatttttagccagttcatggaaatctccaagcataaaaataggtagcttggtactttaagggactgtagcttagattatcgtttctggaaagctttgcgagaccatcgttaagtgtgtaaagaatatggagttctgcgactggccccagtgtgtgatgttcccctccctgtgtccatatgttctcattgttcaactcccacttataagtgagaacatgcggtgtttggttttctgttcttgtgttagtttgctgaaaatgatggtttccagtgtcatccatgtcctgtcggggggtggggggctagaggagggatagcattaggagaaatacctaatgtagatgacgggttgataggtgcagcaaaccaccatggcacgtgtatacctatgtaacaaacctgcacgttctgcacatgtaccccagaacttaaagtataattaaaaaaaaaagaatacagaattctgaacatcagtataattcctctcctttttgttaagattaacaagatgatggaaaattttcacttttttcttcaaatgttgtgactatttatatatagtatatatatatatatgtatgcatgtatatatgtgtgtatacatacatatacatacatacatatatatacatacatatatatacacacacacatatatatatatatgagaccttcaagatcaagctagaagtgcatatgtgcatgcttacatgtgtgtatttcaaacatttcttgagtgtctggggtaggctggccatgatggtgttttcccaaagtatctcttttcaatcttaaccctaagtaataatagataagattttctccattttaaaggtgaaaaaactgaatatagctccccaaggatatatggttactatgtgatagagtcaatatttaattgtatgttcatccttgttctgctaaatactaaattaaataaaaatgattaggaaaaatgaactactttgcatttttaaagttgtattatattttcacatcttgatgcaagaattttgccaccatgcttctacattgtgaaatacatttacagtattttatcttttagtgtgcataccctaagtatatcctcatctcttctaaagatgtctcagagtggctggccatactcaagtgctttttcagatcctccatattagatgtacagcttataaaaaagaaaagagttattttaaccatccatccatcttgcctgtcatgtgtcaggtactgtgctaggcataataccttaaggcagtggtgaatgtttggtacaaagtctaattcaggaaaaatgaaaacgttttcagatcacgtcttgttttggtgttcaacaggaaaacaacttgattgctttttaggaacaggcatttacatgtgaaagtataacaagggtgtgtttgtgtgtgtgtgtgtgtgtgtgtgtgtttgtttcttttcgttgatgttatttgtcccttcctctctattctcacccttcactctccattccaagatggtagtcaggtaccttgaactcctttgtttcagcagagttttgtgttaactaaagttcctgccttttttttctgaaagcctgagcttccaagactgatgcttgtatggaagaagaaattgcaagagagatgccctgtagagggagccaggcttctggtagggggaatggaaagggagggaatggctatgttgcatgcctgggagactgcaggggagccacctgaactgtcagtcacacagagagttcctggcctgagaaaggaacttaggagtctctgggaagggggcagtctcatcttcctgtttctttgttttatctccagtgccttgaacagagcatggagtgtggtaggtgcttactaatatttgttagtgattgagtgaacgtgtggaatcactggagacttgaaaggtgggcagctcagtagtaaccagtgtgtcttggacacctgactgctctttctaaatgttctgctctttacaaaactcctaggacctttgcacagttctggatacatgaggcaggaaagtgggagtgtcagcaataactgaaattaaattgtccacgaagccggtggaatgggaacttgcagatagatttagtttgatgcaatgataacaacattacagtgcaattcctactcttgagttcatctagtaagattcaaaccctccatccatagtttaaggagtggagtgcctactcaaatcttatgtacagtagcacctattaaaacaaaaataaacaaacaaaaagaaaaacactgcttttttaatcaccaaagttttcaaatccgaacattttaagaggtaagcattttaaaatatttccttctgaaacttgattgagaatcatgtcttaaagctctgcagtccatgaatcaggtgtatgtgtgtgtgtatgtatgtgagcatttattacattagctggctactgtgaagcatgtcattcaaaggttatactgtactttttcattctcactttaaattattttcaatgtccagccctttttagagaccattcatccccctaccatttgttgcccacccctcttgttttgctcctagtttttcctttcatgattcccagcatatctggatatatactgtagggacactcttgaatggcatccataccctgaaacacatgattgtgttgtattccatcaggttctgatgaaggaaagagggcacaagatagtgtttgcagtgagatctgaggagttaaaaggattgtgggatcattgttatcctgcagtctgtttgtgcttgcacgtgtgtctacataatcatatagctgtgcctacattaggggtggtgtatacttttgtggctgaggagactgagtcatttctcagtgacaccgagtgagtcactttgaatctaattctttagccctgatttccaattttatttttaacctgcatggtcatgccatttcagaggagcagatggcagggtatggggtatgggggtgagcggggccgggggggctggcatatattgagcagataatcttgtctggcaattttgtggctgaccttttacctatgttattttatttagtctttaactctctttgccttaatttccacatctgtaaaaggaaaatagtaatagtacatctatgtaaagcctttaacatagtgcctggtacacagtcaggggtgtataagtgttgactgccacctttgtctttattcctcaatcattcattctgtctgggaaattgtatttccatatttagaagataaataaatatttagaaaataaagaaattaaagcttgaataagttaaatatcccaatctaatagctaataagtggaagggctggcatttgaactcaggtctgtctgaatccagagctcatgctctttccaaagaaggtgaaattgtggtcagtagacttggaggctcttttatgcagagcatgaatgacctcactttatgttatggaaaggtcgccaaggctaatgaatgagcaaagattgaattaggcacatagttcttctctaaatgtcattcccagggctgtaagaagtgccatcatcattatttgcctttttatagaagtaaccaaggtgttcaccttttttttacaatgaagtagtagtaagagaagctcttcttagcaaatacgctaaatcagaaacaagttaatgatctcaaccccattgtggagtgctggggttatatacaataccatcatctgtgctgttttataaacattgccattattgagccaggtgatgacaatgacatctttttttattttaatttttaattttggtgggtacatagtaggtgtatatatttatggggtacatgaaatattttgatacaggcatacaatgtttagtaatcacatcagtgtaaatggggtatccaccacctcaaacatccattctttctttgtgttacaaacaatccaattatacttttagttttaaatgtacaataagttattattgactctagttaccctgttgtgctattaaatactagatcttattcattctatctaattatatttttgtacccattaaccatccccacctcccttccgctctactactcttcccagcatatggtaaccaccattctactctctatctccattagttcaattgtttttagtttttagttcccacaaataagaacatgcaaagtttgtctttctgtgcctggctcatttcacttaacataatgacctccagttccatccatattgttgcaaatgacagaatctcatatttttatagctgaatagtactgcattgtgtatatgtaccaccattttctttatctgttcatctgttgatggacacttaggttccttccaaatcttggctattgtgaatagtgctgcagtaaacatgagagtgcagatagctagtatactaatttcctttctttggggtatatacccctaagcagaattgctggatcatatggaagttctatttttaattttttcaggaacctccaaactgtccttcatagtggttgtactgatttacattcccaccagcagtgtatgagggttccctcttctccacatccttgccagcagttgttattgcctgtcttttagataaaagccattttaactgaggtgagccctgatttccaactttattttacaatgaaattatatctcattatgaaatctgaacattttacaatgagatttctcattgtagtttttatttgcatttctctgatgatcagtggtgttgagcaccttttcatgtgcctgtttgccatttctgtgtctccttctgagaaatgtcttattcagacatcttgcccatttttatttggattattagatgtttttcctctagagttgtttgagctccatatatattttggttattaatcccttctcagatggatagtttgcaaatattttctcccattctgtgggttgtctcttcactttgttgattgtttcctttgctgcgcagaagctttttaacttgatgtgatcccatttgtccatttttgctttggttgcctgtgcttgtgaggtattactcaagaaatctttgcccagtccaatgttctggagagtttctctaatgtttccttttagaagtttcttagtgtgaggccttagatttaagtctttaatccattttggtttgatttttgtatatggtgagagataggggtctagtttcattcttctgtgtatggatatccagttttcccagcatcacttattgaagagactgtcctttctccaatgtatgttcttggcaccattgtcaaaaatgaatttactatagatgtatggatttgtttttgggttctctgttctgttccactaatctatgtgtctgtttttatgccagttccatacagaaattagttttaaatgaatattttttttaaatctcatgactttttgtttgtttgcaaaggcatattttaaatctcaataactttctgtggcagaaggaaggttcctgctgtcatatctgtaataactagaaccgcaggttctttagggagatgtcaacacaaccatttaattgttgccagaacacactagcagaagtttctaaacttttgtaaaagcagtaaaatgtatttttccccaatatatgatcaacatataacttcaatatacaaaacagaaactgagttgtttggtataggtaggggtagaaggtgagccttgcccgctcagttgtctctttgtctgctccatggcccctgaaactcctcaaaagggctgtagggttccagagaacagagattgaaaactgctggcctattagaagggagtaaaatcggctaaggaagcattatgtcctttctaattgctttatttatttattttgagtttttaaacttaaacctccttttttcttattggtaaaccaggcagcctttgccttagggatgctgtcaagatacatttgaagaataatgagcatctagagagtcttgggcttgctcgtgtcatatacatgctaaatagtgtttagttcttaaaatcccagcctaaggtgttcaaagctgtattgtgtctttgtatttccgtgaatttttaagacaataatggatctatttgttaaattttagaaagttgtcagagctgtcagactacagatgtaaagtctagctttattcagataaatgttgaaatggcaacaagataattgcttggtggttaaatgacttccattcttgaaagccaaacatgatttaagaacagtaaaatgcttcccacaaaaacaaaagccagctagaaatggtatggatttggggtctgaattgaatgaaaattcatctttgtcacttactagctgcatggccacacttagcatttctgaacctggcttctttataataatacttgtctcataggttgttttgagaatgaaatgagaaaatagacctgaaaatcattaacacacagcaggctgtcagtaaactgtaattcctatctttgtctcctttcccacttccttcatgtttaatctctgtgattctaagagagaagtagacattttcaagccatcttactaaggtaatcagaataagaaaaaactgaaaattgatgtcatcctacaattagcttttatttatcttaaaatgcatattgagtgtctcctacttggtagcccttaagccgaattggagctaccttagctcttcaccttaaagggaccttagtctaaagacatagagatggacttattataaaacaatctggtaagtgttaaaattgagatataaacattttttgcattctaaaatattcccggaggtgttctttttttttttttttaagtgatactttgaggtcagtatgtaatcccttgagaattctgagtatcagatgcaataacttggaacttaggacaaaaatagtataatgaactggcgctctagagaatgaatatagatacttggattatgctgcaaagccctcttctgtcttcttcaatgacctgtaatttcaccttcttttctctgcatctgaaatttatatatctgaaacttctatactgtaatatcaaggtggggttattttgctgcatttggaaaatagagaagtaaagaaaagagcaatgaatcaaagtctttgatttttttgattgtatttcttactgtcttctaggctatttctaaaatacacttgctggtttttttttttcattgcctttatagcattgattcccaaactttgttctcttgcctggaagtgtgagggcttcccactcatgtcatgtccagcacttaactctaaatctttgttcaatgaacaaatggcagaaaataattcattaattagttcgtccatttatttgagtccttgaaatatatttgtgatctcttatccatagggtattaacaatagctaacatctcaaatgattttcactggaggaataattgaaataattgcaaatagttgatttgattagtagatttagtattaccaaagtaaattcaccttttcatcatgtaaagatcaccatgatctgcctgcctgctggtcctctcctgacttttctgctctgcctccatcctgggatgatgtaaaccaagccagctgtcataaatctctgagtttaatgctttactcagactctttagctgatttttcgtctcccaggcaatttaaggtccttgatcctcgttgttcagttataatatgtgagtccttgctgttttgttcccaagtcattttttaggctgagcttctaatctttgcaatagggaatcatttgagtatcccccttgccttcccaaatgcatggtatacacctaccctgaccaatctgtgctgcctaattctgttcacacagcccttcctgggtctgaatgaaatgcagatctattacttgagttgcatggtagttttgcattttctctccttcttgtcattctttttttttttgcatttttttaaaattatattttaagttctagggtacatgtgtacaacgtgcaggtttgatacataggtatacatgtgccatgttggtttgttgcacccatcaactcatcatttacattaggtatttctcctaatgatatccctccccgagccccccatcccacaacaggccccggtgtgtgatgttccccgtcctgtgtccaggtgatatcattgttcagttcccacctatgagtgagagcatgcggtgtttggctttctgtccttgtgatagtttgccaagaatgatggtttccagcttcatccatgtccctgcaaaggacgtgaactcatccttttttatggctgcatagtattccgtggtgtatatgtgccacattttcttaatccagtctatcattgatggacatttgggttggttccaagtttttgctattgcaaatagtgccacaataaacatacatgagcatgtgtctttatagtagcatgatttataatcctttaggtgtatacccagtaatgggattgctggaatggtatttctaattctagatccttaaggaattgccacactgtcttccacaatggttgaactaatttacactcccaccaacaatgtaaaagcattcctatttctccacatcctctccagcatctgttgtttcctgccattctaactggcgtgagatggtatctcattgtggttttgatttgcatttctctgatgaccagtgatgatgagcattttttcatgtgtctgttggctgcctagatgtcttcttttgagaagtgtctgttcatatcctttgcccactttttgatggggttgtttttttcttgtaaatttgtttgaattctttctagattctggttattagccctttgtcagatgggtagattgcaaaatttttctcccattctgtagatttcctgttcactctgatggtagtttcttttgccgtgcagaacctctttagtttaattacatcccatttgtctattttggtttttgttgccattgcttttggtgttttaatcatgaagtccttgcccatgcctttgtcctgaatagtattgcctaggttttcttctagggtttttatggttttaggtctaacatttcaatctttaatccatcttgaattaatttttgtataaggtgtaaggaagggatccagtttcagctttctacatatgactagccagttttcccagcaccatttattaaatagggaatcctttctgcgtttcttgtttttgtcaggtttgtcaaagatcagatggttgtagatgtgtggtgttatttctgaggactctgttccgttccattggtctatattttggttttggtaccagtaccatgctgttttggtacttgtagtatagtttgaagtcaggtagcatgatgccttcagttttgtttttttttgcttaggattgtcttggcaatgtgggctcttttttggttccatatgaactttaaagtagttttttccaattctgtgaagaaagtcattggcagcttgatggggattgcattaaatctataaattaccttgggcagtatggccattttcatgatattgactcttcctatccatgagcatggaatattcttccatttgtttgtgtcctcttttacttcattgagcagtggtttgtagttctccttgaagaggtccttcacatcccttgtaagttgtattcctaggtattttattctctttgtagcaattgtgaatgggagttcagtcacgatttggctctctgtttgtctgttaatggtgtataggaatgcttgtgatttttgcacattgattttgtatcctgaggctttgctgaagttgcttatcagcttaaggagattttgggctgagatgatggggttttctaaatatacagtcatgtcatctgcaaacagggacaatgtgacttcctcatttcctaattgaatatcctttatttctttctcctgcctgattgccctggccagaacttccaatacaatgttgaataggagtggtgagagagggcatccttgtcttgtgctggttttcaaaggaaatgcttccagtttttgcccattcagtatgatattggctgtgggtttgtcataaatagctcttattattttgagatacattccatcaatacctaatttattgagagtttttagcatgaagggctgttgaattttgttgaaggccttttctgcatttattgagataatcatgtgttttttgtcgttgattctgtttatgtgatggattaagtttattgttttgcatatgttgaaccagccttgcctcccatccttcctgtcattcttaatggacttctcagagtatttgactctctttctcatttaatgaacctaacagcaatattctaccaggcagataattatcaaacatttttctatttaggagaagaagtctaaggaaggtgatgggattcattcacaaatgaccctgtttggatgaacagcatctttgtgatgttcgtgcccatggatagaaaggcctcactcccactctgactggacagtgagctctgagagcagggccatgcctgggctctccagtacttcagccccggttcctagctcagctcagtgtctgcccgtggtaggcactgaatatacttattgattaaaatttattttaaaaattggttagtgttggaagttgagagttgcttttttcttcttagagaatcaatgtaagtttgaatcaaagattttattttgtttctaaaacttaccttgtagttatagctgataatatcagaaacagtgatgaaatatggatgaagtgcacatactttttatgcctgtggagtgtttatatggtctacagtcttcttactgaccacgggttcagctggacattctctcacagcagactttctaatctctgctgaagatactgagaggctggcaagtgataaggttggcttagtatcacctattgtctaacagattgccatgactgactgatttccctgagctcaagtggcagtagccccatgacttccagacagtgattctgatgggaaagaaagagctctcttcctttcccaagttagctgctccttctagaatcaaatcccttgggcttttcatgaagagtaggaattctcaacttcagcaccaattaatattctaggctggatcactctgtggtaggggctgtcctgtgcattgtaggatgtatagcggcatccctggcctctactcactgaataccactttcactgtccccctctccccagtaatgacaataaatatatctccaaacaatgtcaaatatggtctgggagacaaaactggtcccagttgagaaccacggacatagagggcattgttgaactgattgtgccagtgccagaaagtaatattgatagaagatgacctgatattttctatccttgggaaaagcctaaggggatacatacatatatcaagagtttctccttagtatgagccagtcacctagacatgaacctcagtgtccttgttccccctttatctcacaccccgtcctaaaccatttctcataacaaccattccaacttgtaaatatctcttctgccttctcatattgataagaccaaaatactcactttaagctcccagagtctagctagaatcgacaaatcagcatttgttgtgggtctgccatgtgtcagtcaccctgctaatatgcacattgatgtaatcctcttcgccaccctgagagagaagtttgctattcctgtctcaccagtgaggaaacagaagcacatatttacacagctaagtggcagagttcagaatagcgagcaggtcctctgacttggttaaacgatacttttatcttattgttcaaatatcatcaacatcgacttgaaatttaatttaatcactgtctgcttgaaaatttaatcacattacttgaaaccatggaatcctggcttgtgaataagaatcatgttaggaaaaccatatgccaagtcccagaaccatagaatgttagaggaaaagggctctcagatatcgttacattgtgaccatcttcaggtcatcattctgtcatttaacaaatatgtgttgaaggcttacctgtgccagagcctctgtacatcagtcaagacagacaaggtccttgccctatggaacttacattgtaataaggtaaacatccaataaacaagtctaataaataaatgaacaaataagataattaaggattgtgttaagtgctggaaatgaaatgaacaatgagaggacaacaattatgggagggagatctttttacatccagtggtcagggaagttgtctttgatcttgacagctcccaaaacactggacatattagtcttcctcaaaaagtgttagttcctctccataagcacctagcacagtacctggcacaatgtaggtgctacaacccttggctgtatgaaaagaccatggttttttttctttgtagccttataggtctaaaatcctataatatattgttttagtttccttttggtgctatagcaaatgactacaagcttagtggcctcaaacaatatgtttattatcttatacttctggaggtcagaagtcccaaaatcaagactctcctctctggaggctccaggggagaatctgcttttttgtcttttctgtcttctaaaagccacccgcgtttcttggctcgtggccgcatcctgtatcctcaaagccagcagcatagcatcttccaatctttctctctgattctggccttcttgcctccctcttcttaagacccttgtaattacatcaggcctacctatatactctaagacaatgtccccattttaagatcctttgtttcacacatctataaaatcctttcggtgataaaaaggtaagatattaacacgttctaggaatcagatcacctttgggggggtcataattcaccctctcgtagttagcaataaatgttaactttattcctatgcccattatattttacagatgaaaaacttggaaagctaaaagtgttgcctaaaatcacatgcttggatatagctttatacctggtcatctcatctacgtagatcatctctattctctctatatccaaactctgctcttttcattagagaattcaccacaagttacgtgtctttgttttcttcagttattgccacaagggcaggaagccaggtcacttttattcaccaaggtgcaatcatcacacagctctatgcctgacacacaatgtgcacatctctaaaatgtttttgaatgaaagaatgaatactgtattacgtgcttgggtaagaagaacccaatccctcatgaattattttgtgcagtggcttctgacaggttataaaccctcagccatttttaaagcatcaaaagaaaaagtgaactgcaatgctggcccataattgaagtggataaaacagaagggactcaacccatatctttcctctgctggtgatgaacttaaatttctggcgtgctgtaaggcactctgcatttgaacgtggtagcctgtacctagaaccgtgatatacagcactttatatattgacatgttattaacgtcaacagtcttttgagagagcttctgaatggctcacttcattatttcaattcaggataagaggaagaaaaaaggccaaaaatctaagtgcatgctttattgttgcattaggttttctctgttctgtcttagagaagtaacaaaggaggaaaaaaatcacagttcttactgaatagttcaagtggcacgtttatgggttcacttggcaagctatacgacacttaaatgaaaaaattaaatttaatttaaaagtataggtcatctccaacccttttccaacctagaagtcttaaatcaaagtaccttatgccaaacaactatgtgaaggaaagcgaaacaaatataacacctcctgctatcatggaagacaaattatatttacattacggatgtactttgctttttattttccttaatcttgcctaatgaatacactgtttggtcaaacatgttttatgtctgacatacttttcttttaggaaataatatgcttgtcactcaaggagttaatgaaatgatgagaaaatatgaacccaaagggagatgttttctcttttagcattgctttcaagatcccagatttttacccaccttataatgtatttactttggttctagtggccaaggatgtcaatattctttttgatgaattagaagctgtcagcagtccttgcaaagatgacgattctcttcttcaccctggaaacctgactagtacttcagatgatgccagcagattggaagccgggggagaggtaagagtatatgatttcttacaaatgtaattcgtgatccaggcaggaacctgtgaagcatgttccaatggactgtttaaagtcataatctcattgaactgtaggctcttgtaaaacaagggacaggttttatattcctttgacatcccccatgtctaagcatatttcaaggatcctaaatctacctatacacaaaacaaagtttcagtttttcttaaacctatcatttttttaaactgtccgtcattttaagatagcctacattcttgagtgtctcccactggtacaaaataaactttacagggatgggcttccttgtatagatcccccagtgggtagaatagtgacctaaaatgcaccagccttcagttgattgtgttgtctgaagtctctctgagtttccatttgcctctgtaatctggaaacttcattgcaactgtaaatagacctatctatttgtgtgccattttggaaaaattagtattttttttggaggcattcccctttgttcaggttgtgtctcaatagagtttaatatttcctttgtacatgtactgggtacaggtaataggcacaccgaatcagagtaatttatttattgcatattcctaaggtttttatattccagagctagttaactgctaaaaggatgacacctggaacagagaaaattgtttactcttgccaagctttgcagacttcaccccacaaacaccatatgcagctatccaagtttctttttctgttttttttttttctgtttgtttcattaaaaaaaaacactcattctgttattatctgtttacacagatactttggaaaccataatgtggcgtaaagaatggactttgaaagggacctcagacagcaacttgtctcatccctgtaacttacagatgaggaaacagtatcagaaatattagggctttgccaaaggtggcacagctcattgttctgcttggagccaatacccctcctaatgtcttggctgaagccatttttgaaggcagatgctaatatgctgaattcacaggacagccttcttgcttggcaaataagtgttaactaaagtgcttattcaggtagactcctgagtgtctcttaatgtaaaatccaaaacatagtgaggattggtcatcaattgaaaatgtctacatcaagacatggtacatggtcattccatttccccagctgagatgtttttttcgattaaggtttgtgcaagaatgtggtttctagcaatggcccttcaggtctggcatgtttaccttcttcataccaccattggaaaagatagaatccacccatccacttggctgggtttatagacacaattttgaaatctattaggctgagaaatttggctccagcccagtgagcccatacttgatggtctctttcaatgttgtacagcaagcccgaagagcctggatgaaaattcaatccactccttttgttctttactttttaatattactgcaaaataatatttgtaacttctatgtaagttacaaagtatgataataaaatgaacacctggaaccaccatctgatttatgaaccagaatgctatttttcaaattatagtgacaaactaattgtagattactaactccagtttttttttaatggaatggaaaattaatattggagtgtatgaaaacagaaagggtaaacaattgttttgtgaaacttgtctcatattttgtatatgtatgtttacatatatgcacacaaaggtaaaatgtttttcttgttgtgggtaaaaaaaaaaaagagaaacactgaactagaatattcctaaaaccacggaagctactttcaatcccatacctctaccctaccagaggtatcatctttctaaattttattgtgttttattctcttgctctaaagacagttttaccacatagattcgtagtcttaacaacttatatttagatttactttattttatgctttgtaaaaaatggtatcatgtggtatgaagtcttctgagacttgctttttttatcagtgttgtctttaagattcatttttattgttagatgcaactatagtttatgcattttcactgctgtataatattccagtgaatgaactgtctataatttatttatctatttattgtctgttcatggacatttgagttgactccaactttaaacatttttctactattataagtaatgttgccatgaatattcatatacatgtctcctacttgccttatcaagaattttttctctaggcttacatgttatgcacatattcagttttgcaagataatgttaatgtgttttccagagtgagcatatcaattttcactctcatctcacctgcaggatatgaaaatccttagttgcatcacattcttggctacacacggtatttttagatgttttacattttgcgcacttaactcaatgcttcttccaatttttattttgtttcctcttgattacatttttcactaatgaatatgtaattgaacacaatgaaaaaaattattattattattattattattattattattattattttgagatggagtctcactctgttgcccaggctgaagtgcagtggcgcgatctgggctcactgcaacctccacctcccaggttcaagcaattcccctgcctcagcctccagagtagctggaactacaggcacacgccaccatgcccagctaatttttgtatttttaatagagacaaggtttcaccatattggccaggctggtctcgaactcctgacctcgtgatccacccgcctcggcctcccaaagtgctgggattacaggcatgagccaccgcacccgaactgaaaaaagttatttagttttaattgttctttaacattactcacttgaacctcaatttgatgaatgacttaaactggtccctttctctttgtgtgcagacagtgccagaaagaaacaaatcaaatggactttactttcgagatggaaagtgtcgaattgactacatccttgtgtacagaaaatccaacccccagactgaaaagagagaagtatttgaaagaaacattagagcagaaggattgcaaatggagaaagaggtaaatagtttgcttggatgagaaaaaaatatatacatatctattcatatgaagaggcaataagaaataagcaagcagtcttaatgttaaccaaacatttcatttggtcagagttttccagtcttcagagtttggggaatgttccaatatttagactttgacagcacagtttgcttttgagataattttaatgccaaatgattccatgaaaatcaaaatattctattccaattaaatggattgtttcaaagtgtgattccttatctaacttcctacgtctgccatttctctgtatatgtaaatggagggttctgttcgcgtggattaaagaaaactttgagtgaaatccagtcactctctctagaggctctttttacatttcaggaaatatcatgagcttgggcatcctcgtacaccagaggagactgcctggccaatttggccaaaagcagctggaacttacaaaaaagattccagttttaagagacattcaggctatttttttcaggtccccaagctcaagagtgccttaccagtgtttggttcttccccttccttccttctctgcatggggagcttcaaggcagaactaagtaaggaatgtacaagaggccagccaggcctctgatagtaatccatgatgggcttatggtgttctcaggaatactgtgcacatttgtagaacttggcccgttaactgaattatgtaactcttctcggcttctccctaaacattgtgcaaagcttctggagcttttcatagtcaataagaacaacacattggtaatttaagatacttctgattctgttcctcaaggctgaggggatagatctttgaagtcagacatccaggtttttctttgtatgatacagttgcagttcgtacaacctgcgagttgtgccaaggtatcaaatattagaagcataatatgcatatacttgttatctgatcttgggacacttcagataaatgggatttttttcagatctgttaggctgacctcagctcttgaatgtttataacacggaagcagcatttttctggaatgtctccaagagaattggaaaaatggtgagatgaatgtggctgtaaggaaacaggttcttattctcaggaaagaagaaccagctttctcaaagaccatcttaattagaggttccctggtacaacaaacagaattaaaaatgttgtttcttccacctttgtggagttccagaaaatctttcctatacaaactgagtgtatagttgataaatcttactctttaagttctaaattgtctcagacaattgcatttttttcttaacattaatagcacattcatatttttctccttaatcatgccttcttcttttattctcattcctaagtggcagaatttttatatgaagaaataaaagatctgaattgctacttaatctaaaataatggaagtcctccctctgacccattctgactctgtcaaaattctgattcccatcaaaactagatagctttgttcaattaatgcaagatttatattttaagcttcataagtattctctacaggcctagggcttcttctgtatagatcttttcaatgttatttcgtgatttattcgttagaacttaaaaagcctaatgcttttccaaatagcgcacattaaagtgatggaaagtgtcctgttgtgtatcctaaagcatcacctgtactgcagtgtttagctaccagaatttgaggaggatcatgctgcctgttgtacagttgtgctgcacagtacagtgtggagcatgctgtgaagaatggactgcttgtacgattttgtctatatacaagatagttttgtttgttggaatttaaaaaaaaaattttaacaggtatttattttaatgtgtactggaaaaaatagcaattggaaaaagggaattatcactatatggcaaaacatcataaaaacttatctaagcatttcccccctccccactttcccccaaaagttcttctctgggcatcaccttccatatttctcctttcctccacaatcttttagacactacaaacagttaggtcttcccctttctggaaccttcttcacaagtgacctctcccgctgcctggctcgagtcttgccctgactttgcataaatggtgcaatttctctctaatgcagcctcccagctctgctttgcatcttcgtggactcagtcagctcagcaagaaaagggcctttgcaggttctcttatagataaattaatttttccctgccataaataattaaaagaaaatatcccttggctgaacagtaaacaaaccttcatcctttattctcataataagtggcagaatttttatatgaagtatctacattgtattattaaatttagaaaccgttggaagtatttttatttaaatcaagttttttataagcagctacagcagaaagacaattttaatggcgatttcagcttccaggagttaattcaaccttttataggacataaaatgaagaacttagttcagggtggaaaagaagaaacaccctagggacccttgtatatctgaaacgtttgacactatgcacattttatgaattattagtatcttcttaattagctgttgtcatgatgtctaacaattatgaaaaacatgtttcacagacagatgcttatgtttccaaatagacaaagacaggctttctagttcagtttaacatccttatctctttaacattgaatttcaagaaacacaactaggataatctttaattcatgataaaagtgaggacatagtcaagtttaatctttcttaaaacctttgctccaggctgattagtcaacacataagtgcttgctttggtaccctgggtctttaatattctgcaattcaactttcataatagcccagagaaagcaattcacaacaaagttcccaaacaaaatatcattgaagtccaggtgatttacttcttagtatctatccacttaaagtgattcccttcttaaaggtaagctcatatttactaattaacattttctatttctgattttttcatttttaattctatgtccattattgatctttggatacctattttgaaatcattgtcctcaataagacatttatcttttcttttgtataactagtaagaggatgagttaactttgaattatttggaatgtgtgagtaacagttgtactaatggagcaccctcccgcttcagaatcatgtgaaacattggggaagacctttatcattacagtccttacaaaactaatataattaggtaaatcatatcatcttgatgatggttatttcattcaaaaaatatttattgcacactcactctatgccaggcattgctttaaggactaggatctcagcagcaacaaataaaacagaaaaaaaaatccctgctttgttggaacttaaacaaaaaatatgtacaacatatacaaatatcagtaagtgctaaagagaaaaaagtaaagcaggaagtgttgagaggggcttgcaattttataaaagtcagcaagagtgggcctcttttccacagaaagagaatagcaagtgcaaagagaacagctccacaggatggagcatgcctggtgtgttcatggaacagtgaggatgccagtatgactggagttcactgagcaaggtgaagaatagtgagaaattacaccaacaaggcagtggaagccttagtgatcactgggggatgttagcttttctctgagtgacataggaagccactggagagatttgagcagaaatataagatctgttttctgttttaataagggcattcgggttgcctggtaagattagactgtgaggggtggaggtggcaagggcagaagcagggagaataattaggagattcgttgcaagaatccaggaaagagatgatggtagcttggtcaagcacatagaagagaggaagatgagaagagtagaaagtagcactgatgggaattgcagacagattgaatgggcagtgtaaaaaagaagagtcacagactatttgtctgacacatggtatttatctaagcagttgggagaagacagttgccacttacagggatgcggaaaagagtaggtcaaattgtagacttgttaagattgagatatcccaatggagatgttgggtaagatagaagagtctgggattcaaggagagatctggactagagatacacatttgaatgagatctccaaaggagtaactgcaaataaaaatgagaagaggtccaaggattgagccatggggaacactagtgttacaatttggatgataaaaaggaggcagcagaagagactaagaaggagtcaccaaggagctagaaggaaaatctagagtgtgtggttcaggagagatggaggaatcaactgtgtcaaatgctgctgatggggtgtgtacgatcaaagctgaaagttaattattggatttagcaatatggcaggtttgggtggtctgggcaagagaagtttcagtggagaagtcaggggtgaaagcttcattaaagtgtcttcaagaaagaatgggaagagaaaatacagagacaacgaatacaaacagttctttcaatatgtttcactgtaaaggaatggagagaaatagaatgataactggagtatgaagtttggtcaataaagagttctttctattttagatgggagaaataaatacatgtttttatgctaatacaaactatatatttgagatggaaaattgatgttgggaaagagtggaggaagaatttttagagaaatgtccttgaagcaataagaaaagaatgaccacaagtatctcccattgcatggactcacctatctgcctctgtgcccacaaatgccacccttccccagtgctaagggtgtcctgtccatactcattggtaaggccaacccttcactttgcttctaagaccccataccttctcagtcccactcaaatacattgcttccaaaagagataaaatgtagtacgctttaaaaactgaaatgcacaaacaatacaatttgtggaagtagtttgtttctgtttgcactcatctctcagaaggagtgaaaaatccaactgcagtaaacacacacacacatgcatgagcacatgtgggtgcacagtcgaggttgaatatcttggatacttctgtgtaatatgatacaaattacattatcaaaatttttatgctcacatttattaatcacttactattataatttccatttaacagatgagaccattggtaacttgccccagacaacataagtagtaagagataaagccattattaaaacctaagcatacttgctctttgcccttatattgtgttgatttctggtatctaaaggtgaatttcagggttaaagaagttaggagaggcagggcatggtggctcatgcctataatcccagcactttgggaggccaaggcgggcggatcacgaggtcaggagattgagaccatcctggctaacatggtgaaaccctgtctttactaaaaatacaacaacaacaaaaaaaattagccggctgtggtggcggacgcctgtagtcccagctactcgggaggctgagctgagatcatgccactgcactgcagcctgggtgacagagcaagacttcgtctcaaaaaaaaaaaaaaaaaaaaaaaaaaaagttaggagacaggctgagaagacaagtagtgttatgaaaaggaaaaggtaaaggaacaaggaaaattgggatgaataatgaagttgggtgctgcccagactgtggttcttatgcctctagtagccatagacttgaatcttggtacataaccacttacaagctgagtggtcatgggcaatttatcagatttttatggatctctgtttccattgttaatcctgaaggtgatataatttatcgtaaatgatgaagattaagtggacctatatatagtgccaatctttgtttttcctaatttttacttttaaatttcatattattgttttacttccagtgtaagttgttcagctaccttctatttatggcaagtgatatttgttttccctttatgactgatataaaagctttttgtaaaatgattatttaaaaaagggagttatttaaagaaatatacaaaattaagatattgtagatggtattacaaatttgacaaaaattgtgaaggtggcccgcgaatgatagcattctgtgttacttagctagtccttgtggtggacagactctaaagtctgtgatgcctgcttccttttcacaccttcccttccccctgagttcaggtgggacctgtggcttatatttaaccaatagaatatggcttttgctatcatagaatatgacaaatttaatgggatgtcactcctgtgattatcttatatggtgtataagatctcatctcagcagactggcgtcagagagaccctccttgctggctttgaagaagtaagctaccatattgtgagacagcctatgaagagggccacctagcaaagaaaggtggggtggcctctaggagctggcatccagctgacgtccagcaacaagcagggatcttagtcctacaaccacaaggagatgaattctgccaataactgagaatcctggaagcaggtctttcttcagttgagccactgatgagactacagccccaggcaagacctacatcatagcctggtgagaccctaaagcagagaacccagctcagctgtgcctgacttccaccctctagaaactgtgagataattaatatgtgtagttgtaagcctccaagcctatagtaatttattatgcaacaatagataattaatacagtgattaaaagtctgggatcacacattctgagtgttcatttggttctaccattacaagctgtgtgcccttgtaaaagttaacttatctgcaaaatgaggctaataatgggatttatctcatgggttattttaattaagtgagatcatttatatcgagtgcttatctctgtgccttttatatggtaagcatttagtaaacttcattattatcatcattactgttatcataacggctaaatacaacgtgttaacacttttattttggaatagttttcaaggtaaactttaagaaaaattttcatccagtttacaaattctttataacgcaaccattaggaatagcaacatcagtgggtcatatattgttactgtgtatgcattaatgagatttataatttaatgctcttggaagaactcggaatacatttggtaacaagtttagcatgatcaaggttcagatgtttatctgcttggagaggatttggttttagattcatctgggtataaagttatagatcaattcagagctaaacaacaatagtaacaacaacaacaaaaactgtatttgattgtccatcccagtgtttctttacccccattcaaaggaaatcttcacaaagatttccccacttaaagagctaatctcatgcagatggctctgttcccttgtagacttcctgcccaaattaccctaatttcatccccatttatatactgcagccacatccagcttgttgctgtagatgctctctcagcatccagaactccgaggatacaagaacgacaacatcctcccttccttcacagttgaaaacatgatgatgagtgtctcaaataaatgagtgtcaggactatgtgcactacccagatttctgtcctctagggctttctggtcagaaaagaaaaaaaaagaaaaagaaaatcagacttttctccacccaataatctccactttactccactcaatcttcttatatgtcacacacttgtattaccaagggtctcaagttaaggtgacaagaaaggagaatttaggacagtcataaccaaagaaggaagaaagcagattttcttctgaacctcagagccctggcgattccttgagtgtctttcaggagctaccaatgtcagtccacacttgtggtggcttttctgttaacttgagtcttaggctggatttccaaagcataagcagaacttgaggtgagaattcttcctcaagttgttgatgggtggggcaatctcaggagaaaggggcatgagaggagcagaagagaacagctaagccaaaagcatggcctcagctggacactaccttcagcctgatcccacaggggaactcggtaatcagcaggtgcagcacagagctggtctacttttcagacacgggcccccacgtcagtcagtcattggctgaggtctgtgaaggtggtgagaggtaggcactgtccgtttggctgaggatcattctgggtaccagcagcatacattaccactggtattgaattagtagtagagatgctgccaaatctgtggtattcagacagcactttttgagatgccagcaaacatgaaattcatgggggtccttgaccaagtgaagagagaacaagtacacattggaatttcttctgttttaatttgtcaagttgttcttctaattttaggatgctatttctcaaaggtaaagattccatgttgctagtgtaatcactttgagggaggacatacatgtggccaacaagcatattaaaagctcaatatcactaatcattagagaaatgtaaattaaaaccacaatgagataccatctcacaccagtcagaatggctattattaatactaaaaagtcaaaaaataacagatgttggcaaagttgtggagaaaagggaatgtttagacactgctggtgggagtgtcagttcaatcactgtggaaagcagtgtggagattcttcaaagagctaaaaacagaactaccattcaacccagcaatcccattactgtgtatatacccaaaggaatataagtcattctaccatatagacacatacacatgtatgttcgctgcagcactgttcacaatagcaaagacatgtaatccacctaaatgctcatcaatggcagattggataaagaaaacatagtacttacacatcatagaatactatgcagctattaaaaagaacaagatcatgttctttgtagggacatggatggagctggaggccattatccttagcaaactaatgcaggaacagaaaaccaaatactgcatgtttttacttataaatgggagctgaacgatgagaacacatggacatatgtctcttcttttttgagagagagactttgtcttactggtttttgcattccaaagacttattacagtgcttagcttgtggaatcctgagtttgctacaaaagattgtggatagctgattttcacagctgagtctgggtaacaacagtcaattcatctccagggtttttcaacatagaccctattggcatttagggctggataattctttgttgtagagggctattctgtgctttacaggatatttggcagcatctctagcctctacccactagatgccagtagcacctccttcaagtaatgacaaccaaatatatctccaagcattgtcacatgtcctggtgtggggggagggaggaatcatccctagctgagaatccctgggtttgacccttgatccaatattatatggtttgttgtagtgtctagggggtagcgcttccattcttttatccatggtcaaccaacttatttcagcactcttaacatcagactcttgaatcagaaaagaggcctatgtatttgaggggaagaatagagtatgtgaagactggctctcaagccagacagctgggatttagatccacttactacttcaccacttactaagtgaataactgtgtaaagcttttaatctctctgtgccttagtttctttgtttgttaagtgccagataattcctatctcaagggctattatgaggataaaatgagttaataaattacaatatgcttaggaaagagtctggacatattgacagctttaacgcatggctgttgttggcattgatggtactgataaagaagggagtgatttcaaccactggtcatcctgttcctgaagctcaagcattcaatcctgtcacctcttgggctgagagtccttgtgtgtctggggaaagctgaggggacctggtagatggcaagagatataacgataagtcccacctcatcaccaggactcagtccacctaccactgccccatatcagtctgtagaatcagggctgtattcttactggttcatcttgttagggcagttttatcaaattgatgatggtttgagagaaggtgttctccctcctttccctccctcccttagtcttactctaatttctgagaccggtttaaagatctaagggcctcattattgcctcaactgcttttgcttatttaggtagacaaagtttaatcaaaacatttctgttgccaggtcaagatgacctgtacaaagttatcttgatttattcaaaggattattccaaatcaacacgtatttcatataactcacgcatattacttcagtcaagacagaccaactttaagggaaaaaaatacccattatacaaggcacagctgaaaaactcaagtcattttatgaactattgtcatcccacaaaaagaaacttatttaatctaaaagatttctcagcagtctaaatttaacttctctgatataaagcacgttttgcataatcatcattatgtgccacatgtgggcattgtattatatttatgaaaggaattgaagtcctttgtgatacttttgctcctgctgtttttgctatgttatgataaattgctgaaaattatgcaaagtatatatcatgaatatgacactaattattcattaatggcatggagagatttaaaagctttgaagcagcctggagaactgtaaatccatttacaatctccagcttgtaacccttacaagtgaaaaatttgaaaaagatgaagtgtaagctgagtattattaattgaacttgacataccttagttgcaaaaatgatgatgcagcactgcctcttgaggcaagggccctggcttagctcacttcctgttgtatcttaggcatattttaagagcagtctgtggtatctaataactccatttccagatgaagtaattcattcattcattcatcaaatgtctgatgaatatctactactattgaaggaagggaggcattaaataaatatatcagatgtaataggtattgtggagaaatatacaggaatactgggaaggagtcactatttcatttcaggagttcaagaaaaatctctatgataatgggtgaactaagcacaaagagaaattggaatttgcatgtctaaacccaactctctaaagcattgcagaattttcccactgctgggtttcctttgttttgtgcattcctatgcaggctggcatgggtgtaggaagagtaagtggagtaactgaatgggggggtatggtagcagggggaatagctggatttggctgtgggatagaggtaaactctggtgtttgcatctaaatgaacagggaaaaaagtcaagtgcacgagcagtgttgggattttggagaggcccgacctagttgcaaacacctccctaacttgtccttttccattaatcagttgaactctcattctgggtgctacctcttcacttttgcctacccagaaacccaaagtttcttctttaaaattcttccctagtacttataattgcctagcccctctttcattcagggttgtgcgggaaagccactctgtgtcctccaggaatgaagtgttcaataaataattttacagcactgtaagaccacttaaaaggttgggcatgaaggtcagggaatccacctcccatcacttcagcctgaagcaccacagcagcaggtcacaggtgccggcgtggaagccactgggatctcactaatgcccttctgcagcacatgattctcaaaacttacctggagctgcttcaaacctcaaatctgcctgtaactacctgcctgagaaacagcctctcctttcccaccttccatctgagcacccatcattgtacactttaacccagaactttatggagaaggggattctgggaaaccagaaccaagttctggtcgcagcttctcagcaatgcagaggactcagaaggaggtgctaaggtgacaacaaacaatatagtgcagccaccagccctcctaacaggttgttccctgtcccttcatttgaggctatgctagccccatctctgtaatacccagatggtttaaaagttgtaaggtctgaaatctaacacctgcctttgagacagaggagcagctatttctgttttttaacatgggcatggctgagtaaatcacccagtcagagttcctcccagaaacccacatctttgttctgatgctaacgttaggcaactgtcttttttcaaagcatagcagaattcactgggacccaatatttaattggatagtcagcagcagccacaagcctgcctatggaaatgtccttgtgtttgtgatgcaggggagggaaaagaaacaaggaaagacaagctaaaaattccttccaccataactgcccacagaggaattaaagaaggttccctttgtcgtgtccagcccctgcagtgagagtatcaatcctcatgcacacgtgtattgagcgtctattatgttccaggcattgtgccaggcactggagaataaaaaataaatgttctagttatctattattgtataacaaacaactccaaaacttgtatgttaaaataatagtcattctttttgctctcaaatctgcaattgagcaggacttggtagggacagcttccgtctgctccataggacatcagtcggagcagcactactagtgtctggaggaccccccttttaaggtggctgactcacatggctggaatgttggtgttggctgtcagctgaaagctcagtcagggttgtgggctgtgggcctcttcacaggctgcctaggctttctcatgacatcgtggctgggttctaggagaacaaggtaaaagtgaacttttacgacctagccctagaagcatttattctgctgtactccactgggaaaggcagaatgaaggggaagggacatagattccacctcttgatggagagtcataaggttctagaagatgtgtgggatgaacagtaatgttggggccatctttggaaaatataagctgccacaatatgctcagcgtatttgaggagctcactaactagcaatgaaggcagatgtgaaacggatagaatacagtttgaaaagttctatggaagccctggggaatttcatactctgcagagatttcaggaaggttaagagaggtgacctgggacttaaaggatgattagatattcaccaagtcagaaagtagaagggcatggcattccagatgggaaacaacataaacgatggcatgatagactttgaattgaggccttagggctcctctgtgcacctctgcttcccagacagagtgtgaatcccatgaggactgcacggatttctccctagtccacagtgcctggctcatcatgtcatcttgactttcacattatatatgctcgcttagcaatttcccatgaacataattgacatcagatacaattgttctagaccttaatgacagagctagaaagatgtgcattttatagtaatttttttccaaaatgttgcaaccaaatatcatttagcctctttacaaccaaatccatcacactgtacttatatttaaataagaatcatctcaatgccaatttctttcaggccaaggattttactaaacaaactgtaccagccattacctacaaacttagccaagatcatgatggtcttcgaagaaggtggtgttactgctcactagagtactttgtttttcagctccattcttctttctctctgttttctacacatgttgaaattaaaaagagttttctagaagaccaggagtagagcaggcagaaaaatgaaactatactacacatgattttccttgaccttagcagtccagcaggcaggaaagaaaagtacatgtggtgagaccttgtgcccattagagtttcagaagtgcattatgtcgcctcttggggactctcttcctcctcagtctgtaggttcctttcttcagccagaatattcttttggattgtgtagcagtaaatcactttggcattcatctgaggctgccttgattcagtttctcagactctaataagaatcttctgaaatctagtcttttatcagtgactcatggataacatcatatagttataaaagggtaacctgttacaggcgttcgctgttcgctgttgcttctgattgttcaaggggatctcccccaactgcacgtatctgtagaaactccagtcaagtgaaaaactgttagtcttgattccttatgtcacataatgttttacttagttgacagaacacagttaagccatcaattaagtactgaattttagtttgtcatttcctttttttctctggtcccatttgtacatagcaaagctgtaccttaatgcctttttaaaattaactctttttaaggaaagggagttctaaataaactcttaaatacttggaactgaaactttctttgaatgatgtcttagtttattttgtgttgccacaacagaatacctgagatggggtaatttatgaagaaaatattatcatttagttcatggttctacaggctggaaaatacaggaagcacagcgccaacacttgctcggcctctggtgagggcttttgtgcttcgtcacatcatggcagaaggtcaaagtggaagtagacacatgcgaagagaggcaaaacctgggaggtgtcctggcttcataacaacctacttttgtgggactaatccattcctgcaggaacaggtgcagtctcaccagagtgagaccaagcaccaagctacccacaaaggcagcaccctcatgatccaaacacctctcacaaagccccacctctccacactaccacactgggggtgacatttcaacatgagttatggtggagacaaacaaaccatatccaaaccatggccagtgggtttaaattgtccaaaaatgtcattggggagtatattgactgtgataataagcctgctgttgaattatcccaaccattttttaatttattatttttatttcttctgacagagtctgctctgttgcccaggctggagtgcagtggcgcgatctcagctcactgcaaactccacctcccaggttcaagcgattctcacacctcagcctcctgagtagctgggattacaggcgtacaccgccaagcccggctactttcctgtactttccagcctgcagaactatgaactaaatgataatattttcttcataaattaccccatctcaggtattctgttgtggcaacacaaaataaactaagacatcatttttatatattttttttagtagagatggggtttcgccatgttggccaggctggtctcaaacccctggcttcaggtgatctgcccacttcagcctcccaaagtgacagaattacaggcatgagccatgcccagccacaaccatttttttaaatcattatttcatgtccctcattacttagctttgattctgtagttcatcatcatgaccactcacaagcacctgaattctctcactcctttattcctttgacttatttgccgggcaaagccccgaccatggttaaactgcatcttgttcatgcccacccctgagtgatttaatgttgctggaaaaaacatgctgactggttcactttacatcatgaccgcagtctcacacaggtaccagagaatgctcagtgagcctggtacttttgcttcgtcctctctataaaaatcaagtaactttcttcctccctcttttcccatttcactctctctctctttgcttctttctttcattgattcaattttaaaatttcaatcattaaaaaatcatatagtgcctggcacaattcaaggcacttgggatacatcagtgaacaaatcagagagcccctacccttgtgaaactcacattctagtgagggaaaccgtgaacaataaacataataaataagtaaataatacagtatgttagaaggtgataaatagagggccaggtgcagtggctcatgtttgtaatcccagcactttgggaggccaaggtggaaggattacttgagtcccaagttgaagactagcctggacaacatggtgaaaccttgtctctacaaaaaatgcaaaaaattagccaggtgtattggtgcatgcctgtagtccgagctacttgggaggctgaggcaggaggattacttgagactgggaggttgaggctgcagtgagccaagattgcgcccctgcgatccagcctgggcaacaagtgagaacctgtctcaaaaaaacaaacaaacaaacaaaaaagaaggtgataaatgacatggcacaagaaaaaccagagcagagtgtgggtatgagagcactaagggaaaaggatagtcattttaaatagggtgttgggtgggggctcactgaaggtgatgtttgaccaagatctcgaataggtgggggagttggcccactgttacttcacactgccctctctctgcccaatcaaccttctcacctgttttctctgcaccctcatccctctcaacccccctccacagacacacacacacagttctgctgataaccttgcctatactctgatagaaaatgaaaatgctcagacaggatcttctgtgactccccaccctcaaccttccctcccaccaccactctgtgtgtgctgtcgcgggagctctcctattattcgctgaatcccctctcacctcaccttctcaaggactttgctcctgtaattgtcttcctctatctctcctgcatcatcatttttcctctctactcagttgttacaaacatgctcccataactcacaagatgaaaaatctcttgacccctatactctcctctaatgaccactccgtttctcttctacacttcacagaaaacttcttgaaagatttgtctagtgtcctgtctccatctcctcacctaccattctgttttcaaacttctcagtttgggctttctccctcaccatttcacagaaaccccttttataaaggtggcctgtgatcaaatccagcagtcatgccgtctctgttatcttactggcctcaccagcagctttcctccacatggtgagtcattccttccttgagaaaaacatgcttctcttggctttggtgacatctcatgctttcctggattgcttccttcttcattggctctttctcaatcccctttgctcaccttctcttctgtttgatcttcaaatattagtcttttaagacttgatcctgggtccccttttcttctgtatctccatcttcctgtgacttttgtccagttccatagctttatatagcttctgcctgtcactcgaggctttgtcatctcagaggctttaggcagcagggtttagtttttgatctcaggatggcagaagtggaggaggaggaatgctctttgctgcgaccagggacccagataacagaagctgcatccagacacctgcctctggggcagggaaacacaaatcacacaccagacttcaaggctctgctcacagctcaatggctagagctcatgatatggctcctgcctacccaagtgggctaaggagctcagatttccctgtgcctgaaggagaggagaaccgatgccagggacacactagtgacccccacagaaaatgttttcaaatgtactttatatatacatgtacatacatattcacacacacgcacacacacacacacaccctataaagtaggtgagggtagttatatcagcattataccaatgaggaagtgatatgagttgaggtataacctatcagatttctctgttattaaaaatcataagagccccatttattgacagttttgtataacctttaggtaaaaacacttgatagactataccgctgtgtgccctgtaacatcctctaattttgatcagcatttcaccaagacataaatataacagactgaggagggatgtcataacccttcccaagtgcacatgtatacctatgtaacaaacctgcacattctgcacatgtatcctggaacttaaagtaaaataaaaaaaaaaaagacagatagtaaaaaaagaaagtatttccaaagttaaattgcttcctcactagcagaagacaccaaattcttctgtcttttctgggtcttgcttatttcatggctgttaatctctgcagcgtactaagggcatagcgattcatgggttactgattgggtcatagctgtgaatggctgtcagtgggttgatgttttgtgataataaaaagtatactgtgatgataaagttgtccccaagttcagtttatctcatataccatctagaagagtagggaaaacattatgatggtctgtaagaagtgaagggacgtttggaattttatagatcagaactgacattgcttacttctaaggagagatttagtactgggattacctacaaagggagtattttctctcccaatagatagtagaccaacctctgttcatactaattacattatttataattagggtcatcattgctttgctgaattttgagttccctgagatcttgaactatgtcttaaccttctttgtatcccgagggtccaattagggcctatgcactaggcaacacagtgcacagtagttaaatcatctttaggtgtttgctgaatgattttatgagtcattgtgttgtgaggcagataaaacatttgcttttcataatagatctaagaaggtgatggaagaaggttgtctatatcagggtgtattaattagcagtatcagatatactcccactgccggtggtcttgtggatagatgtagccatatgactacttctgttcaatgggctgggcacagaagtgttatgtatccttatgaggccctctgagctctgccttccctctggcagagtgacccatcagcatgaaccactaaatcactgcaacgagctgacctgcagtagacatgtagcatgaacaagaaataaactttatcatggcactagccgatagaaataatgtaatttaaaatattcgggagctacatataaaaggtaaaaataaacagatgaatttaataatagttttgcttatccaatagatctaagatatcatttaaacatatgatcaacatacgaattattgagatattttacattctttttttgtatatatgctaagtcttcaaaatctggtgtgtactttccacagtcagcacatctcaatttgaactagttatattttaagtgtttaatggccccagttgcctactgtactgccagtatagctctgctgtttgaagttactgatatttgggggttattagttgctgcaacataacttagcccatcctgactgctacactaaacattgattttccttggataccctgatgaagtaagtcttccagacttgacatggggatcaccagggttggtacaaagtgacaaagagtatgttgcatcaggggattcactttatggcaacatagagaacctctaatgaaatgtgtgaagatttgtgctcagcccctcagcactgaacatctcctaattgtggcctagaggagagtttactttagtttctcataaatttagccacattgaaacctctgtggtaagaggatgaatttttttctgcctgataatagtgttttaacaaggtaatcaataatgtgagaaagctactcgaagtctcgatcacaagatgttcataaattcatttaggaagcattccttctcaatgactgtgtgctcagtaacatgctgggtgctgggaatacaactgtggagaagtgtacagtctcacaaagacagcaatgaaatctataattagagtattcattagctggaatatgacctgcattagttttatatcgcggctgaagagattacttcaaacttcaaggcttcaagcaacctatgtttatgctcccacagtctctgtgggtcaggagtctgggtacagctcaactgtgtcctctaatcaggatccctccaaggccaccccagggtgtctgccaggttgcattcttttctgcagctcaaggtcctctcgcatagttattggcagaatttagttttccttgtggttgtaggtctgaggtcttcattttcttgttggccttcagccagatatagttctcagcttctagagacccctcagagaccctcacacaacacagtggcttatttcttcaaagcgagcaggagaatctctctgacctctaggctcttttttaaggactcatctaatgcattcggcccaatccacgctgcaatggaaggagcccagccatgaggctgttgcagtattcaagaagagagatgatggttgctcaaaggagggtggtggcagtagagatggagagaagtggatagattagagagaagtttaaaaggtagaatcaataagacttggtgatttgttggatatgacataaggaaaaaagaagttaaagatggctcctggacttgagctactaagaggatgattgtgccatttcctggtctggggacactgagaagaagagcaattttgccagtgaagcagatccattatagacattgatgtgtctgatctgccagtgagacaccaggtaccaggtgccacaatgaccactggctacactgatctggagctcagaagagaggtgtgggccaaagatatgagtcttggagatatcagctaataggtgacatctaaacccattacaagggatgagatcatctagggaggacaggtagaatgagactagagcctggatgaagtcctcagggacctccacttaaaggtctactaagggggagggagtggcaatttcacacacaccaatttcttgttgctgttactaatgtcactttcagggaatgaatattgtaatcatttaggaacatatagtacttcaagaggcttctctccaccaggacactgtgtgtgtgtgtctgtgtgtgtgtgtgtctgtgtgtgtgtgtgtatgtgttgcagagaggaaattgcatccgaatcagctgaagagcatttgtaaactacactcacaaattccaatgtgtccctaagggaaaagaataacagatgcaaaaaatttctttttagagacacgtgccctcattttttagagaaaactggagctcataaaagtacaagtcatttgcccagtgctacacagttggctagatgatagccccactgagaggagttaaaggagccctttaaccctcgaggaatgtacacttatccatcagtttcacaggctagattccagaaacatcaaggaattctagtgtcagctattgggggttacccaaatgtcccccaagcattcagtacctgtgagtggaagaaagaaattctcacttattgaaccagtactatacaaccatgacagctccagaatgatgctgcaaggcagatattattttcctcattttacaaatgaagaaactgaggcttatgaattgagtaatgtgcccacagatggcagaaccaagcttgaaatttgctcttactactggccttacattaatttttaggatgttaaagccaactgtatacattgtgcattgactgtaatatataattaagcattccttcaaaaaaaaattacagtggaattgagttcatgagcaaatacatagtgtgagcctctcagctttcttcttgtgaaacagcagttctgaagccagactgcattgatgagaaccaggctccattccttacttgagtaaacttagccaaggtaccagacttctttgtgctttagttcctcatttgcaataaattagaataataataataccggggttgctgtgaaaattgaatgatttaatgtatgcaaaagctttgaaacaccacctaacgtgtagtggcactatgtagctggtcccgtctctatcattactattcatttgcattcactatgattttttttaatccaagaggcttatctgagtttccaattagaaattaatatctcctcctagccccagaattttagagttttgctttgtcctcttaacagtatagttatgagaaagtgatgcccagatagttacctaaggggatacagagcagatgcaagtggctaacctgatttgatccttcacgctcagtaaattgaaacgtcaagcatatttatgcctcagggcctttgtcttctactcttctcactgactggaatgctctctccctgtgtaatagaacagcctccctgagtaatttcttcaggtctctgttcaaatgtaaccttatcaaaaggcttgtccacaccactctatctaaaatagcatctccttcccaccattactttctattttcttactctatttttcttcaaagcacatcatcagaagtattacacgtctatttattgagggtctgtctccccattagagcttgagttccgcaagagcagggatttggtctgttttgttcacagctgtattcccagcacctaggacaggccctggaacatcacaggccatcagtaaagatttgcagaatagatgagtggatgtgtgagtgaatgctaagttacagttcacacaatgggattcatggctatctgcaaagaccaccatgatttacaggtgcattgtcacctacacaactttgggacaaactggacagctccagcccctcactgcagttaagagtactaccatctgtccagttccccaggccaaataacctcttcatcattctaggcacgggatttttttttcaccctccttatttgttcagtcccaagttctttcaaacctacctccactagatctcaagtccgtctatttctcctttcgttctggttctaaccaccatcttgtctcacctggctactagaataactttcttattgaacttcccactcctatgcttcctgtggaccattctctgcaaaacatgcagcacgcacttttggaaacaagtgatccctgcctgtaactcattagtggcttcctattggccttggaaaataaatccaaacttcttaccacattgtacctggcctggcatgatcattcccagccctcttctctaatcctatcttaggtaactctctccacctcacactttacaatgttcaatcaccccagccttttagttcccggaacaatctctgggcctttgttcttgctgtttcttctgcttggaatgcttctcacttgactcttcctatgcctaacaccgtctcatctttcagatttcaggataaaagtcacctaatcacagatcaaccagcaaatcttaatcaggtgcctccagttcttttctgccacagaactatattcttttcctttttaaatacttttcataattttacatcatgcttatttgttgtctgatgtctgtctcccactctagattgtaaatcctatctactgtggtatatccatcacctggaagagtccctgacacagagtagccacttaatgaacatttttgggtgttattgaatgaatgtcacagacgaacctgcaggaaaccctgaagatactgagggaaaaaagacaggaattgggtgcttggatctcaggatttctggtggttcgggcttgtcatcaaagactgataaatccttccaaaatactggtttcttatttattaccttctcaggttataatttgagtgagtaggaatgctgtgttcttttcaccataccaccaatatgatgtggcccctcttggagataacaacaagcatatttttagatttactatgagcaccttaacggcattatgccatttaatacgattcaataagatatgcattgctatcatttcctattttacatttgaacaaactgaggcacagagaagttaaatagcttgttcaagatcacagggctggtaagaggtagataaatgaatataaatatgtgaaatccaacctcacagtccgaattgctaacctctgaggcacagatgcccacatggcattgtacctatactcccatagtggcctctaccagccctttaaatatcatgtttatcctggacacacttgctttgtatctctggcccagacttctaccctgagctccagactcatttgtctaactacccacaagacatcttctcctgggcatgtcaaacttaacttttccaaaactgagtttatgatctacctctgtacccccatcccccatgcccaaacctggtctgtctctatttcctcttctcaataaatggcaacaggaatcatgagatgtggagatgtgtgtgtttatactatatatatacacacacatgtatatatatacacacacacacatatatatatacacatatatatacacacacacatatacacacatgtatatatatatacacacacacatacacacacacacacacacacatacatatatatatgcatacacactcctttgagagatggactgcttggattagatagtggcatggcatttctcctgccttactgttgcaaggactgtgactgttacataccaaggcatggaccaaaatttattaaatagaaggttttcagtatgttcttgctgaacaaaagaaaaaaaaattttgtgtgtgaatcttatctctttttactccaggtaatttcccatgatactcgttaattttctcagtcatttttctaagaatattttcccaaacttctctaagtggtaatttttctctccccaaggttttattcccaggaatttgtattgcagtatattaatgaaacaactctatgtttcataaaaatcattttcatttcttttcactttggctcttgtgcacttggatttatgtggcaaggaatacttaataataaggaaagacctatctagaaacagcggtgtaatcatttggcagtagagaaaagaatgatttatgggccatataattagcaatcatctgtttctcatttatttctcagggctgaagttcagaaggcattcagtaacaagcagtaggtaatgccttctcagttcttccttgaaaaactgaatataaataataagccccatacactatattttcccttaagtatgtaaagaggacacacacacacacacacacacacacacacacacacagaggactcatagatattcatcgccattcaagagaattcaggtaatattttttctcaagataatcaaaaaaacctttaatagccccaaataaaatcacagttcattagtaacttaagtttgctttacatgaaggaaagcctctttatttttgttgctttgttttctaaaatatgaaattcttttaagatgaatttgtataaactgataaagcaacaattcagtctatgcatcttaaatgcatttgcaaagccatggatttatttaaacttcagaagttatcaggtataattcaaaaggaagttaaaaggtgagggtatggaatcagctctgtctggggtaaacattcagtttggctgtgggtgagccacttgtcacctctctttctcctcctctaagaaactgaaggaaaaccactctcacagggttcatatgggaataagatggggtaacatgtgaatgtgctttgacaattgcaaaacatgaaaaataataaataaataatattgttattatttaaataataagtgatttttatccagctgaataaatcaaaacagctatccttttatgcataaaatggttgagatcccacgtcagaattttagttgattcagtatgtgttcagataatgaacttagcttttctacatatagaaatgtatttatattgttctctgagtggaatattttaatatatttttaatgtttacatacatttatgaaaagtcttcaaatgattattttcccactagattgtttattttctgtaagacctaacacttacagtaaatctatggagagagtatactctaagcgctatattctgctctaaatcatttgtttaattcagtgactctatcacatttccatatagtgtcttcggtgttgcccaattttactctttctctcataggaagatgagtgaatatagaaccttataggaaagctaagtgaatttaaagaaatcccattatcatgattaaaatttccaacttaggaagccacaaagccttcccagatctgaagtatatcttcatataaagaaaaagaactatttttaggaaatacagtctttcttctgctttataacttggaaaactgtactatgtattgaaaagcaagcggcaatcttttctgaagtccaacaaatgctcagctgaaaagctgtgagaccatttcagatccccaaggcatcattgcgtccacaggcatgaaatggggcaggactgactgtgtgtgtgtgatgtttctgtatgttctctatgggcatcgcagcctgtgagctcattcacatacccctaactacttagctctgatctaagcagctgtgccgggaggactgaccataataggttactcaacagaagaaaacagtgtttacaaagagacaaagcattggccatcaaattttcagttgttactggtttgtccactccctggacaggcacctcatttgcagtaacctgcagtgttcactctaagagtcacttcattgacagtcacttcctgcttcacaggaatcacaatatccacctaggccaggtctaacggcccacatttcactaatcatgttcatggattagataaatattgtgtgtgtggtccctccatgccaagcactgtgctaggcccaaaagatccaactatgaataacagaaatattccttgttctcaggagggttatactcagggcactacttgtcccaagccagaagataaaacctcatttcagcctgaactgccagaaagttagacttttcagaccaatattagagagtgcctcccactactgatgggccctggccttcctacccttaggaaattcagcatcacaccagtctctgagaacactgcagttgatgccagtttgattttcataatatcttgatgagttgatttgtgtagagtatttataacccttgaatgtttataattcaggtcaaaaagactctgaattaaagtatcataaatgaattacaactttacatccatctgcaatttgaaaacaatttcccggagtgcaaatttaccccagctagaggaaaaagttgagcttctatttttgtcagttgtgcaaaaacaacaagaagaaacaacaaaggattgttatacaatactagtataaggaaagtctagccacaaagcacaaagtcctaacatatctgtcaacattcctaaactataaaaacttaaatgccatgcagtccagatcaatcctatatgagaaagatggggataagtaattggccactttactaatttaaactagcttggctcatattttctcactttccttctacaactgatccctccttgtggaaagtgacttccaaagagaaatctcctaattggtttttcatgtccttttgtccagaggcatagaccaaaatctgttggatggttactggggtgtgaagtcctaattttacttccctatgttctgggttgataaaaagccctgaaggaggcaaaggtctttgtccaaagaacacagctctttcaaaaagctttgccagtcacccacccagattgcaatctcacatcttttggctcccttcatctccaccaccaccaacttttgcttttgcctggatgactgagaacattccttcttctccctcatcatttattctctatgaaacagccacagtgacctttgacaacctaaatcaaagtggtttcccagtgttcctagaataaagtgcgctgcacgtcctgtcttctgctcactttctcagcctcttctgatgccactcttccctccttagtacgccttagccctttgctcttctttctctccctcaacataccaggaagcttcccagctcagggcctttgcacccagagcgctcatcccatgctctttccccagctggtgccttctcctccttaggtctcagctcacatgtcacttccacagaggagactttccttgaccccttgtccagatgagtatgtagccccctcccataactgtttctgtcattactttatcttcagaacactcaatattatctgagtcttccctccctcccttcctccctccctccctccctctccttccttccttccttccttccttccttccttccttccttccttccttccttccttccttccttctttctttcgacagagactccctcttgttgcccagattagagtgcagtggcacaatctcagctcactgcaacctccacctttcgggttcaagcgattctcccgcctcagcctccccagtacctggggttacaggcacctgccaccatgcctagctaatgtttgtatttttagtagagacggggtttcaccatgttgtccagtctggtctcgaactcctgacctcaggtgatctgcctcagcctcccaaactgctgggattaaaggcgtgagccaccacgcctggcctatccttgcttttcaacttgtttttgcctatcttctttaacatttttgtagaatgtaaatgttattcatacctcccttgtttacagctgggtctccagctgacatgagtgccacacacacagtgggatgtttgttaaatgaatacttgcacttgtaagggtctggcctattggtgaggaatgccccaaatcataaactctgtccaggtccatgcattctaagttccaactcaacttaaactgtgggagccttgaatatacttttcaatttagtttcttttttctgtttcagtcctctctaataaatagtgacattatctttgtgaagttgcatgccccatgggaagtccttggaagatatgcagaacaaatgaatgtaagaatgcctttcaggtaggtggaaatgtattttattccactctctctgctgcttcactgtaaatctaatgttctcctctctcagaacaaataaaactgaaatgcagattggaaggccattagaggagggaatctttcaaatgtttaggatatgcaaataagccttcatggccaataatgatttcatggctttttgtgaaaaattctggctaatttagttcttagcaggtagatatttccagtgcctgtaataaagaagcattttccaagtggcatttttatttccaaagtgccatttttagaagtcctgtgtactgctgctttgaacagccagaccacaggcagcagttgcacaggggcatgttttcatgttctttactgactagtctcttccagaaaaacattaaaatgtatttctgtagatacaagtgcaagaaatttcatgacagtgtgatcttctttttaaaaaaaaaacaaaaaaaaccactttttttaattttaaaaagtcataaatactttgcaaacacgaatattgatatttgttccaaggggaatagaaaatactttgtattccttagttatttaaaaggattaatttaccttcatttcacaatgaatatttttattttccctatggattatggaaaagtgatctgcatttgctatacagaaataaaatattaaacctcaaattagaaatgccaagatatgtgggtcttttgtaatggaatctgctaaaaagatggatggatgtagtcccaaggacagttctgaggggactcgaagaataacgtacttttggtttgcaatttgccagtaagaccacattaggtgacagaaatgaggcaaattggtaccaactctacagtctgtctcttaatgagctgtggaaagttgtggagacaaagaacatttatagagacagagagaagggttagggactcatttagagaaaggcaatttccattcacaggcttgtaatgtatctccctggtgcatcttatcttctttgttcattggcctgtatgtcctaataccaagtcaaaatagaggctatgatttctagcatctgttttcctggaggcaaaattctcaaaatggataataaatatagttctgatcttatgatttatttttgtatttaactgttaaaaagaaaatctgagaactcaaggattaaaaaaaggaatacatatatatatccactagggagagataaggaatgtcaatttagattccactgaaaatttttatactataatagttaaagccaaatatgtatcaatgatataataagtgtctaatgtggattaataccatattatacctaagaaccgaaagagaaagaaagaaaaccctacaaaatatgtctagatagaaatttatacacccctctccagtataaataaatctcataaaaccttctgccagaacacacttctgtaacaaagaacccagggagatgatagaaacttgagcaatggtaatgcaaagccaattctcttactacctgcaaaggattttgtatctgaagggcctggccacatcatgaataacacttctgcatgcctactacacagcagaaatgtgctgcctccaagcagcattaatactgttttaatgcagcattgagagaatgtgaaccaagcaatgaaatgaaaatgaacatgaacaattatcttctttttagatataggaattcctgcaggacaattttagaagaaaatattgttaatgtgtgacactaattgacctcattaatattgatgtaggtttacctactaaacatggcttcacttgttgtaacctgatggattaaaaacttttgctattattgtgtccacagtttcagacaaataactctagtctaaggagatacatgcatttccaaaggaggaattctcctactacatcatttcaacaaaatgtacaaacatcattttagctgaattttaatacgcaaagaatcttacctgtattcataattttctgtagattcataattttctgtacttctgaatcccaagtttagtctccatggatttttatccctataatgtttaaaaggaaatataggaatagatttcttatgagaaattacagtaaaacctgcttcttaaatacttatatgtccatggatattttttataactaatagaccttactttttagagaaatttttaggtttatagaaaattgagaagatactagtgttccaatataccccttctcccccagcctacagtttctttattattaacattttgcattagcgtgatatatttgttaaagttggtggaccaatattgataaattcttattaactaaagtccatagtttactctagggttgactctgtgtgtgtggttctgtgggttttgacaaaggcatatcatgtatccaccattgcaggatcatgcagagtagctgcactgccctaaaagtctcctgtgtttcatcaccttccttctcccccgacctgtacctctggcaaccactgatctttttattgtctctatagttttgcctgtgttttaaagctttcacaaatacgcaaaaaaattggtgatatataaacttaccatttacagaagtcagagagttcagtaacagttcgggatatacataaaaagcacctgtttcattattattccattcagtttcggttgaagcctgaaatatggaaagtgaggttgcattttaataaagaatctaatacatgtattctccattcaaactacaccaagaattttcatttttaacatttttaaaagatagatatatagcaatctgacagaataagactgatttttgtatagtttccagaattccttgattttacttatttaattcatctaaagccagggccagtggttagccagtgtgccccggtgtggttatgtacagctgggtgttgatgctgacaagtgagtgtccttcccatactggttgtgaaatacatatatatatatttatttatatttatattactcctgtctataccatgagagacgtgtcttgtgtaaacttaaaatgctatataaatattagttaatataatagcgtgcccactaaattatgtatgttgccctctgatccatctttgcattttcctggggaaaaaagctgacctcagctgaagctgtgcaaataccaatcactccaaattatcatactgcacatgctttgtaggcaaggagcaaccattaaaaaaaaattatggtaatgggtagaggaagaaatatcaatggaaactgtttcataagatttcatgactcaaaaacgcatgccctgtgttcccactgtatttctcactgttaatctctttttagttttttcttcttcacctcttacaggcttctatcttcaatctcctttccttccttgctagttcaaactgtaactgacgatgggttttcttctcgactggcttcatttttgctgttcttccaggagaaaaatctattacctgccccgccgttacaagttcatgagcaggttagtagcacgctctgtcctgacagtgtttgtctttctgttggcccgtgtgctccaacaatgacaaggagctataagctggggaagatgagcctgtgtcacatgggaaagttggctgccatgcacattttaaaatcagctgtgtctgattagcctgaggagaaaaaaagatgaaaacgtccctctccgcgtcttcccagtaacttcttcccacttggggggattgccattcatctgcaagtgtgctggggctattgctttttagcccattcttttttttttttttaatttcaatagtttttgggaaacaggtggattttggttacgtggataagttatttagtggtgatttctgagattttggtgcacccatcacctgagcaatgtatactgtacccaatgtgcaggctttcatccctcgccccctctttttagcccattctattagataaattatcaaaaatcccaatatctttggcctagatgttctcccttcccttccctttctttttcttttttctttttctttctttctttcttttttttttttgagacagagtcttgctctgtcacccaggctggagtgcagtggtaccatctccgctaaccgcaacctccgcctcctgggttcaagcgattctcctgcctccaagcgattctcctgcctcaacctcttgagtagctgggatcacaggcatctaccaccacgcccagctaatttctgtatttttagtagagagagggtttcaccgtgttggccaggctagtctcgaactcctgacctcaggcgatccgcccacctcggcctcccaaagtgctgagattacagggtgagccaccacgcctggccaatgttatttttttctacaaaaattcctccctccactatatgtaatttgaaagcttgaagtgcagatagtcatccttagctgctggctacttgacttcatgagtggggtcctcctatgttagtaatattttgttaataacatatgcagatgtatagcctcactcaggtgcccttcctaccctcttttctgccaaaaaaaaaaaaagaaaaaaaaaacccaccagatgaagattgcatctactatactttgtatcctccgaaagcttgtttttccttgttttttgaggagctagggagaaggggaatgcatcaatgatgatgtcctctaatttgattctgttgtgatcattggagaatctaatttcaaaatcttaattgatcttatgttttcattcaccctgagctgagctgagctgatggttaaactgggaaactagtaaatttctctgaaaatcctagttagttcaactctatgaaatttagaattcaggttccctctgtttatatgctatgttgagtgataaataaaagagtagttggtacattatggtgggtttactcaaatgcatgtttactcagtgaagtacagtgtgagaactgacctccaaagaagtgaaaatgttgtttctcaaaaattgcctgcgagcaagcttattggcagttctttcattaagcagttgacatgacatttggattcaccatgatttagattgctaccttgtcacactgtaatcatctgtacaatcctgatataacagtttagcctatattaatagttctcaaactccagccagcatcagaatcaccttgttaaggcacagatttctaggcctcaaccccagagtgtcttgttcagtagatctgcagtggggatggggaattttcacttctaatggattcccagctgcagctaatgctgctggtcacgggacgatgttttggaaaccattggtctgtatgataggccaagctccatcttctcattaaaatacggatttgactgactatgggacgggaaaacaaaaaccaatatcaaagaaaacctgaaggaaacacagcaaggtgaagagaggtttctcccaactttgagggctaagtggaaatatcaagtttgtacatgatactgtttcagtattctagattctaaaaagaatgtagggttgggagaagtcttattcttgtttggaattgccaagtcagcaaagtcagtatgtgtggaacagagcacattggggtcataaaacctatgttggcactggatgactttgggcaggttacttcacttctctgagcctaagtttttcacatttataaaatgatattaacttctcccctgtatggtttatgtgaggtttagtgcctagtatgtagctgatgtgcacaaatagtatctattaatacttattacatgtaataattaatacatgtaataattaataattacatgtaataattatgtctttgcagaagggtatccttctattctttctgtcgtgcttctgaatttgttatccatctgtaagtctctcctttcttctatcctctagcaactagtccactaactgttctgagtttatctgccaagtagtcattttctccatttatattctctatacaggcattggctctacttcccacacagtcacctaatttaaaacctaagggtccaggtgtggtggcacacacctgtagtcccagatacttgggagtctgaggcagtgggatcacttgagtcaaggtgttcaagcctagcttgggcaacatagtgaggccccatctctaaaaatgtaaataaaaaaaacctaagggtcattttggatgttttgcttgctcatctagtcagtctctcaaattctgcgggtgcagatgaatatttctaaaagtctatatattactcttcattcccactgccattgacttaggctgagctcccatcacctcttgcctaaacatcagtttatcttcctgcctcctttctgaccccttccaaactctcttctattcatctcctgagtagcaaatctgattattgtcacttggtggctaccatagagtgatcacaataaggttaaaagcattagcttaattacagccctttataaactgtcctcgcccatcgcttccctcccaccactctttgctccatccatattgagctcatcgtttccaaacatatgttatgctcacgtgggtttatgtgcttttgcgtatagtggtccttctggaagatcctttcctttattgttcaccaaggtgaggtctactcagtcctcaaaactcagtccacatttttgccttttgcccaggtcaaatgatctcttttctgcttttccattagaatcctatggccccatcaccctgtgctgtaatctatgatgtaggtgtctagctctctacctgggtggtatttgaaggcaaggatgactcattcaattctatatttccagcaccaagcacataggagatggagtgaatgaacaaatgaatctccacatgcgtgtatgaggattggagtagggagaaaggaaatcacgaagaaaagaagcatagaaaaaccaggtctgcctaaagtttcagacacagccttggggtgaaaacatttgctcaaacagtgggggtgggatggacaataagggcttaaaagaaaacagtgataaaaggaactatagaatctcaaggttttatgggatattaaatgccatcaagtccaaccattcatcagatacttaaacttctgctttctggtcagccagtctatgtttgaacatctctggagatagtaaactccctggcccatctgtgggcagctgtgactgttacaaagttcttctttaaaataagctataatctctatctctttagttttcactctttgattggagttctgccccctggatggataaaaaaataatctagagcaaaaaggcaaagcatgtgagaaatattctgaaatataggcaaaagggcttagcacttagcagctatttggaaattcagagttgaggagaatgaggttctgacacctaagggctagggaaaatattgttggaggtaaaagaagactggaaatcgagaggagatacaggtgtggtgaggaagttgactttttaaaattgattctgtattataactcaacagtagatttcttaggtgttggtgtcttaaaggcctttggaactgatggcaaagcagctgaagagagtggtaatgctagagaatccagtgtgggagtcagcatgaccttagcgaggggagtgtatggaatatcccaggaggagatgtaaagggtgaagagaagagcgcctgtggcagttcctttgaaaatctgcattaatgggatgggggagacctgaggagaatgaaaaagaacaattagagaagtagaaggagaatgaagagagggtggtgtcaaaggcaccaagaatgagattccacaaggagggctgtgcttcagcttctgatgatcaatcagagatgagaatcaattttggatatttagaagtttcagtaatctctgtgacagcagtctccatggagtgatggttctcaaacatgtgtcaggatcatctggagggcttttaaaaacacggatcactgggcgcatccccagtgtgtctgatttggtaggtctgaggtggggctcgataatttgcacttccatcaagatcccaagtgatacctgtgctgatgttactgatcctggaccacatgttgagaaccatcactatagagtggaggataatggaaaccaaattacagccagtggtggaaggatgagggctggatgaatcagaggcaatgagggttcactgctactttgataagtttcatggtagaggaaggagaaagaggggacaggatttaaaacaggagccaagaggaggaaggcagaggagactatgaccttgtgacccatcacatgttctccatgtgtgcagaggagaggctttgagtgaataagagcttgagaaataaactcttctttcttttatttatttttttttttgagatggagtctcactgtgttgcccaggctggagtgcagaggcacgatctcggctcactgcaagctccgcctcccgggttcacgccattctcctgcctcagcctcccgagtagctgggactacaggcgcccaccaccacgcccagctgacttttttttttttttttttgtatttttagtagaggcagggtttcactgtgttacccaggatggtctcgatctcttgacctcgtgatcctcccaccttggcctcccaaagtgctgggattacaggcgtgagccaccacgcccggccgagaaatccttctttctaaagctgaaggaatggcttacaaaacactagtctttgggctggaaacattggtgctacttctagcgcacacatcacaactacagaagaatttaggcattggaaggtactggaagactctgggccaagctaaaggaaaaagaaatcccaacgaaggtagttgattcagaatggcctctcaaaataggcttcattgcataccacatagaattaagtctttgatatcactgggatgtgtgactttctgaagcccagtgtatggtgtacatttaaaatccacgttgtcagaaaatgttgcatctaccttaactcttcatttcacatcagaacagactgatttagatgatggagagtgtctttttctttgtagccagctctgatattctaaattgaaggccacatatacaacttgccatctagtagtacatcaataatgcaacactgacctccaatatcctaaaattcccgtcgtatgaaatcttgatatttaagttagcttggagtttcatttatataagtgatattgaattttattaatccatgaaagcatctctgaaacaaacctattccctaagaataaatgaattaatatctctaaggtttctgagcaggcagagaaataaagcacttcttcataatatctttattttaaaaaatcacttgactctcataaagcatactcatgtagttcagacatggatttttggagttaatgctctttttatccatgtacttggtctattaaatgctgctttctttcttatctttggacaggcttatagccattataaattgcctatccaataaaaaggaggaatttatcatcttttggctgccctttttttttgccttcataaaatattgcaaatatagtctgtggaagatatgattacaaaataacaaatctgattattatgggtggcttgtaggtggagtctcattactactccttccttccaccccccatatgcattctgcctgacttgatcctgggtgaggcttgacagtgtgaatgctggactgtattgcattatacattcaatgcagtcacaacttatcagatgagcatacaggcaaaaggacaaaatggcttgtgtattttcatcctcgttttaaaaaactaatacatgtaaatgttccaaagcctttggagtcttctataaggtatttaggctatgctccaaatagtacccctgtgacctaaaagaataacattagctttctaagatctctaaattctatccaggcagaggcttgtaaatctggagacttggctctaagaaaatgaaaaacaaattcatgcctctgctgtctattatcattccaagagggtgtcatttactgtaatgtagagctgtgtgctactgaaagaaagaaaaggagggaaggaaggaaggaaggaaggaagaaaggaagggagggagggaggaaggaagggaaaagaaaagaaaagagaaaagaaaagaaaagaaagctcatctgtaggttccctctaggcatatcatcgctgataatgtaatctgttagaaacatgatgctattattataatattctttactggggaaaagtaggtgtcttcaaagtaggcctgcttcatttaattcagtctgattaggttatcattagtgtacagtccctcctgggttgttagtggctcaagggaaatgacctttcttctacttcctcaggctatgcccacagcatgcaggttggcattctgtacattgtaggcagtttataaaggtctcctgacaggttagcatgttgggagcaagatcctttgcacatatgtggccttttccttaatcatcatctctcctaagttgggtaagattatctcccctttagagctgagggaactgagggtcaaagagatcaaatagaaccttcccaagaccaaacttgggaagccatcgcagagctggcaagtttgtacccatttgcttatactgtattgtcagctcttcccaggtacccggaatctcacctatcatgaatcagcatgaaggaaacctgagcttaccatcagaacaactttctgtaaaaataactcacattgtagtccagatattaacttgacaagttagggccagaaatgcccaagtgtctgatccattttccctttattgatttgcctgtgtagtgtgtaagagggcttttgctcagtaaatagcaaaaatggaacaaagtgacaacatacccaaccaaaatcaatgctaaatcattaagccaatgttttctcttttctattccctattggtggaggcttcattaagtaaagtctatactaaagtccactcctatactgaagagacaaatggggtgctttctggttagttggtttccagactttaacatatctaagtaaatttcagggttaactatttagggatgtttattaggtgggaacacagacatcaatctactagggagattcacagattttgaacttttattgggaaaagagcaatctatgtagaagttcatcattattgtcaccataattttcttcgtcctagaaactatcactcaatcgagccctttgtgcatccaaggcattgtgtaagcacttgatatccatgatcatgtttaatccttaccattgccttgttctatggattctgttggctcatagaggtttaattacttgcccagcaaggtctataaaactggaatgtgaatcatcagcttccagctgactccaaagtccatcattgtatactaaaggttatctaacattgtatactaaaggttatcattaattcaagtttgaattaatcacataagtgacataatcaagatattatcacccaaatcaccaacaacctgtagtatctaaagaatatctggctgatcatcattttagagatgagagcactaaggttaggtgaggataaagggcttgtcccaggccacactgatgtatgaccacagaatcaagagtccaacttgaatcttatgctttccagcctagtggcttttgcattatgtgcttctgtcttgcatgattgaagggggccctaagtgaagtctgagtgtggcaaagtttggagacaggaatgtgtttgtggaagagcagactaggggagcactcactcattatcctgccacagagagatagactcttgttcccagagccacctaactgggaggtgagaacagcatgtggaatggcagccttaacagtgggagcctggctagctgttgccaggtcttgaggagaggatcagaccgagagtgttttaagaggtgtattcatttcctattgctgtcctaacgcattgcgacgaatttaacagcataagactacacaaatgtattagctcacaattctgtaagtcagaggtccaggaagaggaggctcaactggtttgtctgttcagggtttcccaaggctgcaatcaaggtgttggtcaccctgggcttttatctggagactctggggaaaatctgcttctgggttcatttaggttgctggcacaattcagttcatgtaatcataggactgagatctccatttctttattggctgaaagtcttcctcagcttctagaggctgcctgcattccttgcctcctagctcttttcatcttcaaagccagcaatggtgggtcaagtgcttctcaaactttgaatctctctgattctccttctgccacatccctcctgctagagaaagttctgctttcaaaggtctcatgtggttaacttgagcccatctgagtaattcaggatgctccccctatcttaaggtctgtaaccttccttacatctccaaagtcccttttgccatgtaacataacatattcacaggttctggtgtgtacatctttgtgggggcaactctggtaaccagaggaagacacaaactgctgaccatgtttgagtgtttggtttagtcgtagtgaagtgcacacagcatgcacagccgtgtgtaatggaacctggacaacatgccttgtccacctgcttctgctcaggctcctcagtgaaggccagttcacaccctccagcccccatgcccaaccagtgtctcggggattttatttatttatttatgacacggagtcttactctatctcccaggctgaagtacaatggtgcgatctcggctcactgcaacctctacctcccaggttcaagtgattttcctgcctcaacctcctaagtagctgggattacaggtgcacaccaccatgcctggctaatatttgtatttttagtagagatggggtttcactatgttggccaggctggtctcacgcctgtaatcccagcactttgggaggccaaggcaggcagatcacggggattttatttttaagatgttcttttgaatgtgtttcttccaccacagttttttaaaaagcccagttcctttgctttccatcacttttatgttagtcctgtgtggtccttaagaaattattaataatgcttgctatctgtctggcagcttctccaaagcatttcatactcaccatgttttatgagcccactaaccactctgtaaggtcagtaagatgataatgatgataatgatgattattgttactattacctctattttataaccttggaaaagaaggctctgaagggtaaataacttgtggaaggtcatacagctgaggcgcaagagagccaccccagttacaaatctcagcttccttttaccatgccaagcagcatcctcttgcctccttcttgcttcctctttttcacatatttcaattaattaatcattttaattaccctgttctactctcttttcatcatctccacatttcaattaaattgtggtgccacaggctggctgctgaaagctgccatttcactcctatagagtagttatgcctgattttttttttttacagctttatttgtttttatccatgctgagcactgtacccagctggattcaattcatagtcatcgcacacagagcccagattctgtgggaatgtgaattttacaaagtgtgatctgattagtcctgcagactggagatgtgtgggaggtaaaagctctataataaaaaacctttgggccaatggcctctttcttgaatgagttttaaggcaatcaaatgaaataaagccaagagccatggggaaggccaccatcttagctgaggaagtctaatttatgtgtccatataaggactaaatcattgagcatagactagtgatagatgctggtgaaacacaattaactttgaattaaaaagcaaaaaacagaaatgttaagcggcaagctggttgctcaatatttttatttttggaaaaaagagaaaaacagtaataatagccagcatttcctgtataccagacagttctaaagactttatatatgtattaataagttcatcatcacaactctacgaattgggtatcattatcatgcccattttatagataaggaaactgaggctcagcaaagttaaatcacttgcccaaggttttgctgttaatattaacagagccaggatttgaatctaggcattccagccccatagttcatgttgtcaaccactgtgtcatgctgcttctctaaagcccatcatctcactatattttaagtatatttcttttggggcggagggttctcttggggaggagggtcctagagccactgtgagattcttttcagtttgaccctttgggagttctgaagaaggacagccaccaccaagcagagttgggatcatggtgaggctggaacaatgctgagaataaaggagatagtgaaagagaagtttaccattattttttagtttggaattgattggttatataaataatattatcttcagctgagagtttcactgtgatggttaattttatatgttcaacctggctgggctaaaggatgcccagatagctggtaaaacattattttggggtgcatctgtgataatgtttccagaagagattagcattcaaatcagtagacttagtaaagaagctgatcctccccagtgcaggtgggtgccatccaacccattgagtggaactagaagatggaggaatagtgaatttgctgctgcttgagctgggacatctctcttcttctgcccttagacatcagtgctcctggttctctggccttcagacttggatcaggatttgcacggttagctcataagattctggagagcaagaagtcccgcaatctgcagtttttaagaaggaggcctaggaaacctgatggtgtaagtcccatttccagtgtaaaggcctgagaactaggaaggccaatgtccaagggcaggagaagatggatgttccatctcaagcagacagcaaattcaccctgcctccacttttttgtcctattcaggtcctcaatggattagatggtgcccacctgtgttggtgaggaccaacttctttactaagtctacaaactcaaacactgatctcttcaggaaacaaccccacagacacacctcaaaataatgtttaccagctatctggacatcccttaacttagccaagttgacacagtaaattagccataacattcactgaaaagaatacattgccatgtaaatatattgttttaattaggaaaaaaataaagcatgaccaaattccacgtgttttcagttaataaatttagaaggtattttttccagtagtatagacacttgaggtagtgctatcattttaaagtttggtgtggtttttgcgccttctggtgtttttctgtgaacagtgattgggaactgttcacttggaagccagatgttttcatcagcagaagtcagtggaaccgagggaccagggagatagccagagagaaaactgtagctgaaaaccacttttaggatactgttgttttcattgacttggcttcattagagtgacacatgtgtgtcacgatgccctagcaccatgagaaccatggagcctgcttaaaaagagatcaatgaaagccaaaaatccggctgcctgctgagaggctgctcaggggaggtgggagaggcaggaagcaaatcatggcatggagctctctgcacaactcccaggatgtgctgccagcaccccctcccgaaagttaattacagctagagctcttctctgacctcagatgttttccaaacacaaaatgaattttttagaacctacagaatgtaagttaagatctctgctgcttgcttaagggactgttggaatccttttcagagctttccagccttgttaggactgcttggtcatttattattggcatgtgggtggacatctaactcacagctgctatttcacaaacagtaataatattgaggccacttggtgaaatcaaaacaacactagagttctggctgtcttctttccatctataaaacaaggatatcctgagtgcagtgagagggcctggaatgtgtggtatgatagttgtggctctgcggagaccttcctcctgtgtttcagggcattgctgacatgctgtaccctttggtcttgccttccatgtaccacaggatcgataaacaaataagcaggtttcggagatggttacctaagaagccaatgaggctggacaaggagacactgccagacctggaggagaatgactgctacactgcccctttcagccagcaaaggatccatcagtgagtgttccatgttaaagccccatctcactaaggatgtgcagctgtggtagagcctcaccctgcacgcctttgattcctgggcatgaggaaggaacagcatagtgcccttctcccctaaaagtcttgtgagtgttcatatcccttttatttcagtcaggggaagataactgctgtaaccaacaatccctgcatctcagtggcttaagatgatacaatgcttgctcatgtgtgtgttgggtaaatgatcttctccacagaaaggcagtgacccaggctctgtcattctcattgctctgccaactccctgtgcacggagccccctgcaggctcatctgcatctagccagcagacaggaggagtggcctacaccttttcccattgaaaagagggttttttgttttccggtttttgttttatcttggttcacttctcagttcccctttcttcagcagttcactgggttgccttaggaaaagccacatcacctggcagcccacttgctgagtcatctgtcagattgtctcagaatggttatttgtcacttttgacatggggggaggaaaaacaagttggctaagtcactgagcctgtgaggaactgcaaaaatgaaagagaatttactctgaagcttctgagatgacaagaaatgatggctggatgcagggcagggcaggcaggaggacagaaaagcctgccgtgtgctggagactgtaaacaataggagaaacacagcctctcagtggaggcagagatcaggtcagccccacctcccttgcaacaagatcaggaattccaggccctcttgctccagcagtagtgacagcctccataaaaatgacttacctggagggaagaaaagggtgatggatttaaaaaaaaaaaaaaaaaggttgctgattttgtgagaaagtaaaccaggctgagtgctgtggctcacatctgtaatacctgcactttgggaggcagaggcaggcagatcacgaggtcaagagtttgagaccagcctgaccaacatggtgaaaccccgtctctactaaaaacacaaaaattagctgggcatggtggtgcacacctgtaatcccagctactcaggaggctgaggcaggagaatcacttgaacctgggaggcggaggttgcagtgagccaagattgtgccattgcactccagcctgggtgacagagtgagactctgtctcagaaaaaaaaaaaaaaaagaaagaaaaacaaaaaacgaaggtaagccaaatggcagttttcaagaagttgcagggagtgccaggtggggacatatttcagcaacagaaaaacggttaaagtctgtggagctctgcagggcaaaggggaaaagaaaaatcaaagaatagatgttctgaatcaaaaatgtgtaacagtaagagcagtctaatgcaggggaagcaactctgtacgcctctgaaatagccgagctgatccccacaggtcagattaaagccaacccagctgcagtatgtgaacatttgaaagggtcattgaagcaaacatggaattcacagactggcctcaaaatcttagttcgatcctcaagagaaagtgggaactggaagggacataatgttaattcagagatcagggtgttttcttaagagaaaaagacagaaaaaagctgatacgttcccattcttaatttaaacccctaccatgtctctcttgttcatcttggaagttttttagacaatgagttgtttccctaattcttccggaatgatgtctggtttacaggcaggttttccctgtgcttctacctgtttatgatagagttcctagcacagtgcagaagggtatcaccaattttggatgatggatggatggatacattgataggttgctgggtgggtgggtggatggatggatggatggatggatggatggatggatggatacatggataggtcactggatggatggatagatggatggatggatggatggatggatggatggatggatggatggatacatggataagtcactggatggatgagtggatacatggatacatcaccagatggatggatgggtggatagatggatggatatatggatggatggatggatggatggatggatggatggatggatggatggatagatggatggatagtgtatatggataggtcactgaatggatggttgggtatacacatggataggtcaccagatggatggatggatggatgggtggatggatggatggatggatggatagtgtacctggataggtcactgaatgaatggatgggtatatacatggataggtcaccagatggatggatggatggatggatggatggatggatggatggatggatggacagatggatgaatagatacatggatgggtataggagtggttgtgtaggtgtataaatgaatagaggaataaatgaagtaagtggtatacactctgggattttatttcacttcaaagggaggatatatgagatataggtaaatggaagaaaaaaatgaatgaatatatggatagatggatggataaattagtgaagtatgtgatgtgtgctctggtattttgtttcacttcaaagggttataggtgtatggaagaggagggtttcccacctcctcttttcatgctgtttatattctacagtgttcttgctttagaacaatacttctcagcgtgattcttaaagtcagaagcccttggatacccagtagaatttctagggactagaactgagaatcatatttttggaagtatttaaaaatatataataaatgagggatgattagattagggatatttagccaactctctcacatatttgagaagcccttttgacatgctttggtattaatttgtcaaataattgatttattcaatagtcactaatttagtgttcacttcttgccaggcactgtctgggtacagagggtataaagataaacaatactcagtttggaccctggtgtagtaaagatgcagactattttaaataattgtaaacagtatgatgggtgtgacttaagagggggaatactcaattctccagatttggagggaggttggtaagtgatgaggattgatcacaagagaatgcttgatatgggtcttgaaggataagacttgcccaagtggataaggggcgaaaggcatcccaagaggagacagtaacgtgtgtataaatgaacgaaggcgtgaaataggatggagtgttttgaggaaccacaagtagccttctctgagtaagagcataggtttgtgaggaggacctagtgttgtttgaaaaaagagagtgatcaatggaagatgagatatcaagacaggagaaccaaggaagaaaaagcagaggacagctggaatgaatcaaaccgaagaaccagacctcagtgggaccaagagaatagaggcaattttatcgtgtaaataagaggtgaaaaattaaataagtgtcttgaatattatgagtggtgaggatttatttctctttgaaaattgccatgtcacatagatagcatccctcgggtgtataaaagtatgacttgaagaatgctggctgtcaaattggaaacaattgttgggtacaatcagaaaagaattccctaaggatgttttgagagtgacattaatggatttaaattaatcagaagtagctggttaataagctctgggaattatagcatgatattcctggctttccaaatatagtccaaaatcccatgtgacttcttagttttccagaatgtttcatattgtgtttttcttggaatacaagctaataatagaaatgtaagtgtgttcgttagggggtgaggtgggaggagggcatgaaaatagtaaaaaaaaaaaaaaaaaaaaagagaaaaacattgaaagtttaataagtgtttcatcagagacatttcccactgaaaaacctttcgagattttccaacctccacccccaattctggttgagatgtactcatctatgttttagtaatatttttcttttccttaaccaatattaccacccattttaattactttctccaagtctagagactccttgaaagactatgcctttctcactcatttttgaatcccatagtaagtgcttaataatgattttttaaatgaaaaaataaatgaatagatagaaacaaaagtaggagaatcatgtaagtaaagaataaagctgatgtgaagtcagctgactgcacactcatctcaaaccaaatccaagataccttcttttcaaatgtagactacctccattgttccctgtctcagtaaacagcactaatatttgtccagttgctgaaactggagtctggaagctattctagacacctctctcatctctgcttcttacaagttatacatctccacggattgatgattttacatcctaaatatctctatacttcagactttgtcactgtatttcacttgaaattcagaaataatataacaggtctccctggttttactcttgtcaccaccaatccattctctcaggtgcatactgcatggtgtcttcaaaatgtgcatctaatcatgtcacttcattctctttaaaaactttagacaccaaaattattactatgacttacaagctcttaaatgcctacctgcactgccatcccctctccagcctcatctgcctttcttgcctcccactcttcatttgttgtgatccagacacatgcagcctctcctctctcagctctttggatatactctgccccaggacatttgcatatgttgtttcctctcctggaattctcttccgattctttccttcttcatgtagtatgctgttattcatcctccagaactcagctccaaagactcctgctatggaagcctcccctgaccctctccttccccactaatccttccaaagattgggtctctgttctatactgttgtagttaatgtttcctagataacatttttttaacaattgaaatgctataattatttgagtagcatatgattaatgcctgtctctctaggtaaatggtatactctgtggagccataggccatatctgtttttgcccatgattgtatctccaatacctaacacaatacctagcataaaattggcacacaatgctggtcttctaaatgaaggagtgaggattgaagtcagaaagacagcacagaataatctaattgtaaacctttattctttaactgcactgtacaaaaatattaaagttgagaatctattaaaaaacaaatacctgccagccacagtgtctcacccctgtaatcccagcactttgggaggctgaggtgggaggatcacttgagctcaggaattcaagaccagcctaggcaacagagtgacacccatctttacaaaaatttaaaactagcagggcgtggtggtgcatgcctgtagtcccagctacttgggaggttgagctgggaggatcatttgagcccaggaggttgaggctgcagtgagttatgattgtgccaccatactccagcctgggcaacagaatgagaccctatctctcaaagcaaacaaacaagcaaacaaacagcctagcattccatttgaaaatatatctgtatttaaggaggaagaaagcaaacctgtgggtgtacaagtcaacatacaaatgctacttggtcactttatatgagcttaccaaggtgggcctacaggtagaaaaattcttattgtatgccagacactatttaagaactttaatacaatagtttgagggctgaggtattattattatcaccaatttacggatgaggaaagtgaggaacaaaatggtcaaagaacctgctataggtcgtacacctaggcgaggctacctgtctaaacaactcccaaatatcagcagtagaacagcatagaagtttacttgttcacagcactatctagtgtgggtcactctgggggaaggaggcatatgtctctgattcatgtagtcattcaggtacctaggctactgttatcttgttattctgccatcccctaaatcccttacagacaaggaaaaagagagatgagtgattttttaggaaatttttatgggccaggcctaagagtggtatatagcactttcacacacatttcgtagtctagagcttagtcatgtagtaatgctgggataactagtctacctgtgtgcccagaagaaaaaaagaagcagatttgccgaataaataatcgcagtctgtctgagtgatagagcaggaattcaggttcgaacaggaaggctctaggtctcacccttataagcattacgctctattgtgagatttctcagcctcagcactaatggcactggggctgaataactccttgttgtagggaagagtcctgtgcagtgtaggatagtaagcagcatctttagccactagatgctagtagcattccccaaccctttagttgtaagagaatcaaaaatgtttccagacactgccaaatttcccctggtggtagtggtgggatgggtacaaaatcacatccctttcctccagccttgaaaaccatggttctactgtctttcatcacatgacaccctttaggcagggccacccattctctgtgataaattaaactctatttgaatctaatgactatgacagccaagtccatttaagaattaatttatctctcttcacctctgtgcctgtgaatgttgccctgcttaagtatcattgcccttcattcttaaaatggcattagcgatgacacccttgaggcaattactttctaaggtcaatacccataataaaggttttctgctggtagacagaaaaaaggaaatatgcaagaagagtcgtgttactttttataatagatatacaggacattctttcaggaaatagatcaattctgattgtctttcagaaaaatgtgctagatatagacagaaaaatgttctcccctgcattttctgtgtttttattattaccattattttatttttgtaaacacccataaaaattgaggttaaattaaataccagttcttaagagaagaatatgaaatttatgctatgctacgtgcacatatgtttaaatatatattcactcatccacgtattccataccagttgttgctctgggtgcttggagatcaacagtaaacagaaaggcaaaaattcctgccctcctggagcttacattgtagctgggtgtaactggtaataaattataaaccagcagttgtcagtgaggggtaatttgacaacgtctagaaaaatttttggttgtcacaagttaggagtggagattgcgactagtgtctaacgtgtagaggccagggatgctgctgaacatcctgtaatgcacccaacagctccccacaacaaaaaattatccagcctcaaaagtcactattagtgtgctgaggtaaacattttttgaagtcaatttaaaagcaagtgaaaaggggataaatgctatgggaacagagaaaaagagggtggggtgaggggaatggggaggactgcatgggggtgggggtgcaggttgtatttccaaaagacagtgtttcagttcttcaaggcaggcctcctacagaaggtgtgattggaaaaaatcttgcaggaggtgagaagggcagagagagttccaagaggggaacagaaaacaaaaccaaggccctaatctgggagaagctctgattgtgtttggggaagagaacaaagaccttgtggctggagcagaaataccaaggagaacaacaatagtgatgagttagaggcgtgggagggagcctgatcctgtaaggcctgtgggcttttacagaggaatgacgtggtctgacttaacttttgacagtgtcattctgactgctctggcaactgcagtcatccgtgtgaagcatgatgtatttatattttttcaagtttctatcttttcaaaatcaataatgaaaatacatgccacatataactcagcattgacccatttctttgcaaagcttttgtgttgtacacaaaatgttttaactcatgtactgtgcatgtatgaaacagatattattgaaagaccccttgaaataaagtctgcctttaaaaggcacagattttatgtgaaataaaatcacatggctttagactcctactttcatctcctactagaccgtgagctacctgaggacaggagctatgtgcctgggagcaaggggcacccagggaatgtttgtgagaccaaagagaacaggaaaggagcaaggcagaattggcattgttaccgctgggggacagagccagggctctggagccagcttctctgatcttgatgcagcatctaaaaactgtagaatatttagaagagaagtgaaaaatgcggtcaaccacaatggtcaattgtggtttccatgtccaacttgaactttcccttgacttgattcagttttggctttagttctgctaactgataatctatcttctctatcaaacattttacggccattaaattctgttatcaggattcacatctgatactaagatatttaattcatgcatcacactttttaattatgtgtgatgtgtagtatacaaaatgggcattataaaaagaccacctgacacaaaatttgctttcacgcctttttctgcttctatgctgtgagctagggcataagaaaaaagtctagagaataacaaaatgacatagttctttgtgcctaagaaaaagcgctaacaatggaaatgttggtgctggggtcatggagggtttgtaagaatgggaaaatgttggctgggtgcagtggctcatgcctgtaatcccagcactttgggagaccgtagcaggtggatcacctgaggtcaggagtttgagaccagcctgccaacatggtgaaaccctgtctctactaaaaatacaaaaaattagctgggcgtggtgatggatgcctgtaatcccagctactcgggaagctgaggcaggagaatcacttgaacctgggaggcggaggttgcagtgagccgagattgtgccactgcactccagcctgggcaacaagagtgaaactccgtctcaaaaggcagtggggcagggagaagaatgggaaattgttgctggagggacagtgagtgggagattctctgagattctctgtaacatccctttgattgtcttcttatcttttgactgttctcagcagaaaaggcagcaagttaaagccagtagtgatcagccaatcaaacagtggtagcaccaatggcaacaataaaaatgatagcaaccactgtttactaaacaactccttcattccagggttacaccataggtatattacaagtctgtgagggtaagggtagaataatgatggtcagagaggctgagtgacttgctcatggttgctctggtcactgttagatgagtgaacagaaagaagtgtcttttcagctgggtgtggtggctcacgcctgtaatcccagcactttgggaggccgaggcaggcggatcacgaggtcagcagtttgagaccagcctggccaacatggtgaaaccctgcctctactaaaaatacaaaaattagctaggcgtggttgcgcgtgcctttaatcccagctactctggaggctgaggtaggagaatagcttgaaccctggaggcggaggttgcagtgagccgagatcccaccactgcaccccagcctgggacagagcgagactctgtctcaaaaaaaaaaaaaaaaaaaagtgtcttttctccacagtgctgccacctcctgtaggtgccacataaatggagcctaaatacaatttttcaactgccttaccctagggataagcctgtgcatgtgaagacatctgatttcctttggaatttattgttaaagcattcgagatgcattaaacagacatgaaataaaatggtaaaaatataaatgaatattctgaaccaaggagaatataagttaaagtaggcattcaagttcagggaaaaagtaggctcagatttgcaggcctcagtggcctatgtatctgtaatggttgacgaataaactagaaaattggcctttacaccaaaggggccaagcggaagggagaaacgtagtaactcatgtgattctgattgtcagagacgaagaaaaccaataccataggtaatgggttgctttttgactctgaaataaaattcttgcacagggtcattggagtggacagtgaaatagtgatatggtggacagtatccctggtaacctctttatcacaggtgccttgcaggacttttctgaaggctgtttctggtagtcccatcagcatggttctgaagacttaactgctcatggccataactttctgtgagagtttaggcaaggtatccagcaaaatactgcagtatacctgtgatggttaatactgactgtaaacttgattggattgaaggatgcaaagtgttgatcctgggtgtgtctgtgaggccaaaatagattaacatttgagtcagtgggctggggaaggcagacccacccttaatctgggtgggcaccaccaaatcagctgacagtgaacataaagcaggcagaaaaaacgtgaagaggcgagactggcctagtctcctagcctacatctccctcccgtgctggatgcttcctgcccttgaacgtgagactccaagttcttaagtcttgggactcagactggctctccttgctcctcggcttgcaggcagcctattgtgggaccttgtgatcatgtgagttaatacttaataaactcccctttatctatctatctatctatctatctatctatctatccatcctattagttctgtccctctagagaaccctgactaatacaacacccaaactaatctagttgtctttgttgtttgaactgtattctttaaaaactaaatttgaaaactgatcaaaaagcaaataacatcacattctagttgaaaatggttccatgtttgagaaacaatagaagctaaccagtgggtacacatctctatacgtcaatgcataaagcccttcgtcattttatatcttatcacaagagctaggcctacaggctgcccatcagccatgattgtatggccacctaaacatctgaccccacagaaagctctctcacactagccagctatggaaactcaggttgtcaatattagagtcagtcattccaggaggcccctctcaaaactcaatttcagaaaaggtcatttcaatagaaccatatgaaatttattataggaatatgatagctaacattcatatagtgcttagtgggttccaagtacttcacggttataaactcatttagtcctgtgagtaaggtatcgtcattatccccatttttacagaggaggaacctggggcacagaagggttaagtaacttatccaatgtcaaacagttggtaagaggtagggcctggatttcaaggccaagcattctggccccagtcttatctttttaacattgcatgttagttttctatggctgctataacaaattatcactgacttaactgtttaaaacaacaaaatttatcatcttacaattctgaaggctagggtgcaacatgggtgacactgagctaattaaggtatgtcaaggctgcactcctttctggaggagaatctatttctttgccttttctaatttctggaagctactacattccttagcccatggcttcttcctttatctttaaagccagcaacggtagttgagtccttctcacatcacatcactctgactttgcttctgtcttcacatctttttcttctctgactcttttgctttcctcttccatttttagggacccttgtgattatattgtacctatctaaataatccaggtaatctccctgtcttaaggtcagctgattagcaactttaattccatctgcatcattaattcctctttgccatattgcttaacattctgaggatgaggatgtggatatctttggagggccataatattgcctatcacagctgtacaaatttgccaatccaaaaagtgccaagggttgggacagaggacaggaaagttttgatgggaaaaaagaaggaaagaaaagagagagggagagaggaaggtggcaataggatttggggacattaaatgaaatgacatatgtaaaagacttagggcctggcgcgatggctcacacctgtaaccccagcaatttgggaggccaatgcaggcagattgcttgcagccaggagtttgagaccagcctggccaacattgtgaaaccccctctctactaaaaaaaaaaaaaaactttagccaggcatggtggtgcaagactgtagtcccagctactcaggaggatgaggcaggagaatcacttggaccagggaggcagaagttgcagtgagccgagatcatgccactgcactccagtctgggcaacagagcgagactccatcttaaaaaaaaaaaaaaaaaggcttagtccagtacctggcagatagaaagcactcaacaaatcaacaaatgatagttatcattatcattattaccacaaaccagcagtatactgagaatcctttggagaatctgcaaagttgcagttggtgtgtaatgggaaagtttgaggtgacagagactgattttgcaaaggctcataactgacctgaactggaattgctttgcttttaagccaaatgttactcagtgttccagatactttgccatttaacattttatgtgtcagtaacatatgactacttgcttttaaactctcagcatagatatcggaagatagtgattcttctaacctgtgccttttactgtatttttgtttcaaagaactgaagagttttttttattgttttcatcgatctgaaatctttagagaatccttcaggcagaggtaccaagattgatttacgtaggattaaggttcttttagtgcctcaatgacttaaagcagtctctgaacacttattttattgcagttacttattcggcattaggatcctcaatattcaggttgtttgtattgatccttagagtcaggggaaacatatctatgttctggaaagtcttaaactgaaatgaaaatgaaaaaagccacgcatcttgagatttgtgcttctcaagatcatacagctccttttaagtaggacataatttaatgactttaaagggacaaagaggtcacctaatcaggtgggaaaagcatacctctgggtatctggaggcccagtagttagttgggtctgttatcttaatatttgtgagaacatctgtgaataagtcacttggaaatattttattacatttatctatctgtaaatacatagtttgtttttctgcttatcagttcattcatttaacaaacactttcaatgcctattatgtgccacatattgtactataatagaaaaatatatacaatatgttgatgtatatttatgtgtgcatgtatatttatgtgtgcatgtatatttttatttaaaattttaacttcagtatgttaagttcgatagtcaagaggctattttcctcatcagaatggtaaaaggcaatttaaaacacctataggaaagggaaagagttgtcaaatttacgtacagtaaaataaggaggggttaacctaagaggaaggaagggaactaggatcccatctgttgctatagtatacgtatgtagtcacactgtgcattaagtcttaggaaacaacagtggtgagaggagacaaggaagagcagaggtgaggaaaacctagtgcttcacaggcaggtagacactctggtgccccattggtcagtattctgtgccaggctgtgcactgcacgccctccacattatcttttttgacccttgcaaaaaccctgaaacataattttacagaaggaggcgcagaaactcagaaacattaaatactttaagccagggttacccagtaacaaatagacttggagttagaacccaaatctgtctcattgcaaacccatgctccttccataatacaacctgacatatattgactgcccactagacaccgggctacctgggaggctactggtattgttatttccgtttagagaaatggaacacggaggagtaagtcacctacctgagttgcacagttggtcaaagtaggaaaacaccctgagcagctgggggagggtcatttctgggcctgcttctgactcacatccaggagtggcactggggagaaggagttgttaaacctgtaaactgtgaagatggtagtttattcaaataaccactaattcaagaccacgtcttagaaatgtctttgtctgtggggaaaaacctgattcttctcacttcccactttcctcacccctgatacaacacccacaccatcagtttggtgtttcccattctagatgagtgatttcaccactgtgtgttgaccaaccttgacgctcccatcttcctcgctgcccaccatcaccaccaaatcctttcggcccttctcctcctttctaaccccactgccattgccttagtggaagcagccacttagatgaacaattacgacagtctcttcacctctgtctttcctcactcccaaatctgtctatcccactcatgtcacaggacatttgcaaggctgctggcactggttcctacagtacctgtgcacagttagaagaaggacatccttcctctaggaatattcgtagcgcatggattggcaagcagagtatggacagggtcaacccttcatcatgcccttggctgtgcacctgcaggagtgaataatgcacagtagtgccacgtgtagtaacattgcttccttgcttaacagcttttaatgattccccagggcctttgggataaagcttaaatttcttcacatggcatacaaaactgcctttttagcttcttcccttctccccccagccttttgggctggtgctcctgcagcatgggaatggaagtgaccctaaatattccatgactatttttcctcttcccaaggtgtgctctctttcctctcactctttggtaatatcctgttcttccctcagtaacgagttcaggtgtcatcttctttatgaaacatcttatgtctcatgtctcatgcagacagcattagacttctgggcccattagcctctgtaaatgctttaattatggcactgactattatatcacagttacttgttttcatgactgtgttctacacaaagcccaattcagcagccaaaagtaattagaagggagctccagactaagtttctcaaaggacataaagggaaaccatatcctcagcatccatttattatcatcctttcctctccttccttagtcaaaggtcatcctcctactgttgacaaaagcattcctcctctgccctagcctatacggtttttctttcctcttcctatgttgctctcctccccacaaacctcagccctctctcctattgctttcttatatggattgccacagcttctccatcaggaaaaaagaaaacactcatcttcttcaggcgaagccataaattacaggattatcattgttaggttagagactgtgtcagccaggttctgctgggttctgatacaacaaaccctcaaatctcagtggcctgcacaaaggtttatttatagctcacataacatgttagcaacgggtcaactgaggctttgcctcacatgattcctttatcatgggatctggactgaagaagcagtctgtaagacatgcattctcatagcagagggaaaaagtaatggcacaaccacacattgacttttgaaatttctgctcagatgtggcatatatcacatatcctcacactctgtgtgccaaaacaagccttatgaccaagcatagtatcaatgtggtagggaattatatgctttctccaggcagggagaatgtcagtaacatggtaatgagtagagatatattttcaaagcagcaaattgggactaataagacagtatgctcaggaatacctcgtattaatattgttttgttttgtcacattcgcatggcacatcagtctgtgagcttacggggctcagatgatgtctcatacttttttttatgatttacacgtaattgcacatatttatataggaggaataagttctggtgatctattgtatagtaggatgactagaattaacaatcatgtattgtatatttcaaaatatctagaagagaagtttttgaatattctcattagaaggaaatggtaaatgttttgttctgaacacctagcatatttttagaaaaggaattttccatgcaagttaacaaagacctgggcagaagagagatctctgtagggtagaaatcacacttgaaactggaatatttgaaaattccaaatcaaaaatctatctttatacttgggtgatattcctatcagattaccaagcaggataggtagatggctgcttctgtggtgtgtagtttctcagagaaggaggtctcctctccaaagaatgtttctttctctagatccctatactacttaggttccattcaggaaaactgaaacctggcagttatttttttaaaaaaaggatactgtgggggaagtgaagaactatagtgtcgcaaaggaaacactgaagtcaagcagatgataactgcaggaagtgaagcagctactgcctctagagttgggggagcaaaatgaagaggttggggttatcggaaccaagatgctcagagaggccctgtggagctgagcctcggactcctggggaggagattctgcccttgtggtgctgggccctcaaggatatggggcaacggagtgagcctagtttggggagtgttgcttttcagctggaaactggaaccagctgccattgtgaggtcagaggatcattgctgacaggaacaggcaggcaaacaagaaggaccaaggtcctttcacctgttctcccttccagtctccctctcatgccctgtactgacagagcatatcagagagacagacagcaatgcagaaatgtagtttgcagagtctctattctggcattgtattatagaaaagagtaaggaaggggaaatcagagataacttaatagacagcacactccctaatacctggaattttacaatttgaactttaatcctttggctaaagtcatcctcaattaaaataaaaatgtcccttggaaagatgaaaattttaatgtccttctttattgacaccccattatgaatagtttattgaaaataagaagaggaagcaagagatacagatgaggtattttggccgtagcaggggcagatagagaatgccacaaagatggtggagggccaaaaaagagcaatgaaaacagggggatcatggaagataaattttaccaacttccagattttgcagatgcttggcagagtttctaggactttgctgctcccagcaatataaatgaacagcagggacagagatggatctgtccatttggtcaacattcagaacaactcagctcatataaaaatgagacccatgactaagatcagactaagatggagggagccatggttgagtcactgaataataaacttatgcagggacaattgcctaagtaattcaagcaaaaccttactattgactgaattacagtagtgccctaattagtggaacgctgagagcttagcttattctaaattggatttttctggtctgaggattaattaggaaatatttccagacttgttttatagattaaaaaaaatgatttcctctttattctggctcacttttgaatagcaaataaaactaatctctaataaatttgaatattgcattgttttcatttttgagtgtctatctcagttgagtctgcatcaagtaccagttctgtggcaagaactgtgtagagctggacaaagatgaatgaatcattttctgaccttaaggattaatggttgagctcactcaagctctggttggaaacacagggcctgggtgcccaatcccagctctgtaacttgtaaggtatgtgattctgagcttcaacctcttcatctgtaaattggaaataataaaaaatagccatataatattgtgaaaattaacaacacagtatatcagtgcttatggtatatgttcgataaaggtattttatttttgttgataattttgatggaaccttatatataaatagataattttagtatatgtgaattctataaatgctgattttcatgatccagtcttaaaggtagatagtttaagattggtgggaagttttcccaattctaggatattacttttttctcttacttttttcttctcttttctatagcatcctttctcctttcttttcccctatcatttcctcttcctgcctcctcctcttcttccagaattatccagattgctatccacctctccatttctcttggttgtgtatacctagccaatatcaaaggtactgtttggcctactgtgccttaccaataggttttcaacctctggctcaattaatgcatatccttttgttagataactgactctttaaaatatttattgatgcaaccaataaataaaaagaaaaaggctattccccagcctttttctactgtgatactttacttatgcaacatgctccctcatgttttcctgttcctgcagaaagcacgttagaatacctgggagtaaaatgatcctattataaaggtaccttaaatccattctgatttatttttttaatcattcccaagttttggcattctaatcatcattactgtcaaatacacacctcaccattttgtcttattaggatgttgtgacacatgggtgaataagaccccaaaatttgactattgcttctttcttaagacctgtcctattggacatgcacccttagtcctagtaatgctcttcctaaagtaggtacttcctcaaaacacttgcacatgtgcattttgcagaacgttcattagagcattgtttataataataaaactttataaatagcctaagtatccactagcaagacaatgagccagtaaactgtactgtcccatacagtagacttctgagcagcagggaacatgatggactagagctccttgtatgaacatcatgaacctcaatgctgagcaagcaaagcaacttgcaggagagtaattatagcatgataccatttctataaagttctaaaatatgcaatactgtatttttaggaatacctgcatgttgtggattataaaacattcctgatagtggttacctctaggggaggagaatacaattaaaaaggaggacacagagaaacttcaattatatttgcaaacttttgattcttaagtttgttagtgggtatataggtgtttgatgtcgttcaccagtgcatttttgtatgtttaaacatattttattaaaagaaaaagatgttcacaagatcttatttcaaaatagcaggaacttatacactgggggcctgtttgaaccatgagagtcagtaatcttataaaaagtgacaaatagtgggccaggcaccatggttcatgactgtaatcccagcactttaggaggccgaggtgggtgtatcacttgaggtcaagagttcgagagcagcctggccaacgtggcgaaaccctgtctctactaaaaatacaaaaattagctgggtgtgatggcatgcgcctgtaggcctagctacttgggagactgaagcagaattgcttaaatccgagaggcagaggttgcagtgagcggagattgcaccacggccctccagcctgggggagagagtaagactccatctcaaaaacatttaaatgaaaatttttaagtgacaaatagatgataataaaaatcatgaaactaccatttatgagcatcatgtgtatgtaaccacactgcatgcagtatctcttaatcctcaaacatcctctgaagtgggtgttatggttgtccccatttgaaagataagaattctaaggcttagagatgttacttttctaaattcaaacagttagtgcttggcagaaccaagattctaacccaggtttgttttttctttaaccaacaaagtagatattattgtattccttcaagatgttgtcattccaaccaataagatataacctagctatattatttgggggggaaaagagtgacccagaactcagagttttgtttttgtttcatttggagataaggtcttgctctgtcacacgggctggagcacagctgcgtgatcatagcttactgcagccttgaaatcctgggctcaagcagtcctcccatctcagcctcccaggtagctaggactacaagtgtgtgccagcacactcagcttgagtttctaaaaaaaaatattgcgagctgcccacatgtttacaatatcttgggctcacaaaaggtaaattctatctatgaggcgacttccctcaaaagtctaccttcaagctggaacatcagtatttgtcagtctaatctagtgcataaaatactgagccctaaaagcaataagaatcattgtgaagattctgactttatttcaatgtggatgttttatttttgaaaataattcaattttttaaaatgttagttatctttgacaaatatgttattccaaagggttccttccttccttcctttcctaccaccttataaattaaattaaaattagacatgtatacattttaaatagccctacaaggtttgttttgaaaaacagcaatcccatgcttcaaccctttatatttgcccctcccaagaagcagcccctttcaactcttttacctgtttattttggcaattaatgcctcatatctaaataaactattttattattactttgctgtttttcagttatagcagaatctattacttcccccatagagaataagaatttgctgtttgtttcttccctacaattcttactacagtagatacctattcttatcctttcaacgtagttatattacaatttaattacattatcataatgtagatcactatttacataatgactatacaaatgctacccagagctaggtcatatagtacaatatgaatcattttccttttttgcgctatttttgcttgaactggagtaactcattctcttgatttttaattttcaaaattttctatgtacctattactaattccatcttacattctgccagttatttggcagagtttacctaaattgtctaaatttcaagatgttcagatgcatcatacgtaatcaatttcatcttcctgagaaaattactctggagccttctgacaagttccaatctgaactcttgccttccgctcctgttataaattatcatcttggtatcttcctttaccaaggatatcctaggattctctttgtctttcacttttgtggcatcttctgtttcctgtgtatcatttcttacactttttttattgtaccctcattttgcattctctagtgacttcctaataagattacgtggatgatattatttttgcgatcatgcatactgttatgggtcaaattgtgaccttctgaaattcacatgttaatatcctaacccccaatatctcagaatgtggccttaggtggtgatagggtctttaaacaggtaattatgttaaaatgaagttattaggatgggccctaatccattatgactggtgctgttatataagagaaaattaaaacacagacatacacacagagaagatcatgtgaagacatatagagaaaacagctatctacaagtcaaggagagaaaatttagaagaaaaaactctgctgacagcttgatcttggactttcagcctccagaactgtgagaaaacaaatttctgttttttgagccactcagggtatggtactttgttatgacagcccaagcaatgaagtatatgttcattatactgcactcattatgatagttgggctaggtatagaattctgtataaaaccaaaatctgtttttctcacaatttttaagttcttgatcttttaacttctaaaattaatattcaatattcctgctgagaacttcaaaaacattccaattcctaattctctgtgcgtaacctttctcctctatggaaccttatataattgtctctttggcctcagtgttctataatatcataggaatgtatcttgatgtggttctatgtttacttatattactggatgctcagtgaaccctttcaacctgtatagtcttgtctttcggttcagaaaaattttcttgaataattcttgaatgttttagctgatttattccttttttgtctttctggaattcctatttttcagttattggacttcctgggctgatcctctaatgtccttatcttcctctttttttgataatctatatatttttgctctgggagaattcttcaagttattttctggaccttcaccccacttctttaggtcactgtgtgccccagttctaagattttctgggatttcgtagtataaatattattgttcttgggttttccccagaactggtttagcattcagttttttctggttttctaagtctattattacatagatctgtctgcttggcacattccaacattttgatgctgttgttttgtgctatctttgttctatgagtgttcttactgttatttaaacatacacacccactatgcatgttactatcattttcatgggattttgagagagacagaaaaattgtatgcaaatgtttaattttccatctttacttggaagctcaagagcaaatgtttcttaatttgtatttaacacttagataacgaagatgatatcatgaagtacaattagaaatggccatttgaataaggaaaatgactcacagtcctttacatttcagtaacctgtcatcctgatctaaaaaaagaaactttaaaatctttaccaaatagtcagaactttcaatgttatatatttggcctgacaatcttctcatctttttgctcataaaatgtctactcaagattagaagttagatattgtgctgcagttgcctaaggcccagaaaacgctcaaaataggccttgtcacataaaaaattaattggttgctttgttcctacttagattttcattaatttgaggacataatataagtgacagttaactgtatcacctttgcttctccttgttaaaaaagaaatacctatttaaaagtctaattaagaaagtttcctgaaatatttatttttaaggcattaaccttcccttattatattatggaataacacaactttaaacatcagaaaagactggtatgttggttatctattgctacataacaatctactacaaaatttactgacttaaacattttatttgcttattattcttttgttttagcaatttgtgctagattcagctgggaagttcttccactgctttcacctggagtcaacatgtggctgcagttgtccctttgctcaatgagctggacagtccaaaatggtctctgtcattcacatagctgggggatgctgccagctcttggctgcatttctgtctccacatggctcatcttcaaagaggctcgtttgggcttctttaccctggcagccttggggcagcattccaagtgggcaagaatggaagctgcagaacctatgccaaaaaatcatggaaattacttctgctgtatactgtagattaaagccattcacaaatccagctcagtctacctcttgatagaaggagcaagaaattcacatcccaaaggagtgtatatacagacataggaggaatcatggccttttttctttttttttttttttttgcaatctaccacagactgctgtctggctgaaacttattcacattttttccatatagaaaatattctcattcccattccaggatctccatgggtctcatcccaatattgcatcaggttcacagtcttagatctcatgctctgcatcaggtgagttgaggatgaaaacccttggctacaactcctcaggtgtacactctttgtgagccagagacctgtgaatgaaaaagacaagttacctgctccctacaattccaacacatggtgatggaacagaggcagaataattacaataggtactgccattcaacatggggaacaacaagaagactgtagcagtcacttgttcacattaatctgaaacccagctggtcacatgcttcaggctccttcactccagggtcaaaaaacctaccttgattagttatctgtttctgtttcctactttgccacatgccttaaatttttagattcacagaggtcaataatgtgactataattctaaaataattgtacaaaaccatctgtaggtagttaagtgcttcttgacaaagttaccccttcctcctgaagtttttaaccatgcagattttcatacctttgagaatacttgtttgtttgacccacctcagaaatttcataatatatgtaaaaaaaaaatggaaaaaccatcttccttgcctttacttccccaaaagtagtaccacatacaaagcatcattataaaatgatactgattttgagaatcttcaaattacaaaaaaagttaaaatttatctataatataacctgacagtttctggaacacccagtggttctctatgggaatcacatgatttacttatttacttggggcctagagtagagcatgagacagaccaagccctgccctcacagagcttgcagtctgtagggggagaggggcagacaacaaaaatgtagacacatccccacctcatcccagctctatttttaaaaattttagggagtaaaacataagagaataaaacagggtaatggaggagagagaatgagtgacagagtgagagagagagattattggggcaggagagtgactatcttagctaggatgatgaagaggtgacatttaatttgagaacaaaatgttgggaagaaacaagttgtgcaagaatctaagaaaagcatgatcaaaagccctgggcagtaacagtctgggtttgtttgttcagggtcagaaaacaaattcaatgttgcttgtttacaatgagcaaagggaagaaaggagataaggtcattggtatgggcaggaaccatgaaggactgtgtggaaaggtgaagtcattgaagagttttaactggaaaagcataagatcttattcattttttttaaaaaatcattgtggttgctgtgtagaggatggacaaaagagacagtgaaattagatagtacagttaggaagctattgtagtagtcctagaaacaactttgcagtaggagggtgagaaagggtcagattcaggataatatttgggaagaggagcccagagaccttgatggattggatgttgggcataagagagagggtcaaggatgcatctcaagtttgtgacttgtgaaattgggtgcacttcagttccttttttttccacttttattttaggttcaagggtacatctggagaaaagggaactctcatacactgctggtgggaatgtaaattagttcagccattgtataaaacagtttggtgatttctccaagcatttaaaacataactaccatttgacccagcagtgcccttttttaagatggaaaagcctaggggaagaacaggtttttcctttataagggtccagatcaaaagttctgttttggaaatatttggtttgagttttttcttagacatcaagcgagatgtcaaacaggcagttgaatgtgggagttcagtcatttaccagcaagccttgatgacttgcctcatcaatactttatagtctcactttgtgactatctaaccctatccttgggcaactaagacatggggaccctcatttcctgacaagtagagactcaatgaattacccaaggacacacaactaaagtggaagagcagggcttgaaccaggtcttctggcaacctacacatagtcctgtagggcactgctaacccctcctctactctcctgcttattgtaatcaaggggagatgcagggttttaagataccattctggaggcagtgggtgtgccacatcctcaaagtgtcacccatgacttaggcaattgtttatccatgctgttcatatagtatccaccagccacatgtagctacttaaatttaatttttaatcaattaaaattaaactaagttaaaattcactttcttagttttactagtcacagttcaagtgctcaatagttacatgagtaccatattggatagcacagataaagaacattttcatgatctcagaaatttctattaaacagtgctggagtctagattaatctaatgttcccttcagttatattaatttgtgaagaaagtgtagtcttatcctaaaagctgtgatctaagaggaaagtttaggaaaaaaagaaagttacctgctttaaaattagcatattttataataagctgattttagatccagcattaatgagcacctttccccagctcacacccttgaatatttgtgtgtttctcatgttatctatgaaggtgtaggttcctctgaggagagaaactaggtttttttcacctttgcattcccctctcaaaatatataaatatacaacgcccatgcccatatatacacaccctcaatacatattgctttgcacagaacaaacataatatttacttgttaaatgacccagcatatcacagcattttacaacactactgtggacagttggccacaggaagaacctatcaatcagagcaaataaactccaggaggtctgtaactaaaacccgattgcgcagcgtatttatttctcatttctcccttcctagcaaaaggaatattgggacctcaatcttccaccaccccgggtgaaaacgaggttgctcactaccctagaaagcataaaggtcgagcctagaggagagtcagtgggaagttcaggccctggtctgcccattacttcatgagcaggccagcaaggtcttcctcatggggtgtgatggagatatgcagaaagcccttcacacacatgcacacaggcagacctgggcccctcacagttcccttcacaaacgcaggagaaaatttggagcaaaacagatgttttctgaattcctccttgccacttgctgtttgtgtgactttgggcaaattacattagcccgtcaaagtagcaggataaggagatgtgtggatataggccttgatcacagagttgatgctacacccattcagcagtttattcccctcttcaccgaatttcagggggaatgtgagagcaaacctagaacagaaatgtgctttccttttaagttttctttttaaaaatattttcaaatgttttttaagaggcagaatctcactctatcacccagactggagtgttgtgttcatagctcactataccctctaactcctgggcctaagggattgccctgcctcagcctcctgagtagctgggactataggttcacaccaccacacccagctaatttttttttttgtagagatggggtctcactatgttgccctggtcttgaacttctggcttcaagcggtcctcctgcatttgcctcccaaagtgctgggattgcaggcatcagctactgcacccagccaaaaattgcagttttttaaaaaatgtgtaatagtacttacacatggtaaaaatttcctaagtatgtacaatgaagttttcctcctgtctatccagccacccagttctccccagaggcaaccaatgttttccgaggtgtatgtgtcctcccatagtcattctgtgcatgcacaagcaaatatgcctatcaacatattcatatgcatgtacttcctaatatgtgcacattttcctctgacacaaatagctgtgtgactgttttgaaccttttctccttgtcctgtcttggagatttttttagatctacaccaagggcccttaatctatttacaggtgcagaatattccactgtagagttgtaccataattttcttatcctatcccccactgattaataatttaggttatttccaggcttttgctattataacccatgccataatgaacattgttgtacatctgtcactttgcacacgggtaagtatatttgtagaatacatttctaaaaaaagaaatccctagattagatggtatgtagtgaagatatatgcgtagttttgatagacctgaccaaatggcccttaaagagtttgtatgtttgctctccccctagcagtgcatgggagtggatatgagtttacaagccaatgtgaagccctggtcagagactgagccccaagcctcatgtttgccagagttgcttagcttacattgtgtgcatgaggggatgggggatatgtgtgtgtatgagagagagagagagacttcatttggagaaagctgtggctaactgtgagaaccatgatatggggaatcatcactgttccttctcataatcctccagtttgaaagaatgacccagaaaatgaaagtgttccacaccccgcaggaagatccttagacatgcagtgtggaggcagtagttcagctgatagctagaagagatggcaagagcaagagcagaggccaaggtataaggagatgagatttagtttcatagcccctgtgttaggttatttgcattgctataaaggaatacctgagactgggtagcttataaagaaacgaggtctattttggccacagttatataaacctgtacaggaagcatggcaccagaatctgctcctggtgaggacttaggaagcttccaattgtggtggaaggtgaagagagagcaagcatgtcagatggcaagagtgggagcaagggcaaggtggggcagggggaagtggggagccacactcttttaaacaaccagctcttacataaactaccagagtgagaactcactcattaccatgggcgtaacaccaagacattcatgagagatccacccccatgaaccaaacacctcccaccagaccccacctctaacactggggattccatttcaaaattagatttagaggggacaaacatccaaactatatcagccaccaacattagctagtgttcttcagatggtcagctcatttgatccaactttaagtgtttatcatgtgctaagccctttacctgtgctggaaatacagagatgagcatggccggtttctgccctcaagaagctcacccaaggaagtgggccatgtgggcggacagctttcatggaatgtaatagaaactacagcaatgatgacagctaactctgagaacatcttcaatgccagccagtgggctcagcactgcgtgtcatctcacttaattgtacaatagccctgtgaaggtgattacagtgttatccccatttcacagatgaggaaaccaagacccagaaaagttgagggatagccctaaaaccacatcataggtggcactactggagtatatgctgaggtctgtctgactgcagagtattgagataaatcagagtgttcagcatactcagagctaaaagtcgctcctcctcctccatcagtggttctttgcttccttctctctttatagcatcacattagttgttctcacgctgctaataaagacacacccaagactgggtaatttataaaggaaaggaggtttaatggactcacagttccaaatggctgaggaggccttgcaatcatggtggaagatgaaggaggagcaaaggcacatcttacgtgttggcaggcaggagagatcatgtgcaggggaactgccctgtataacaccatcagatctcatgagacttactcactatcacaagaacagcactggaaaaactcacccccatgattcgattacctcccaccaggtccctcccatgacacatggggattatgggaactatgattcaagaagagtgtggggacacagctaaaccatatcaagcaccacactgcatttcagagtgagggcatggaagtcaagccagggcctctggggaagatatggcctgagctgagatttggaaacaaatgaataaaaacctggaaacaagagcaatctggacagaggaactctcagctgacctccaggagactcagcctccaggcctcaggaagtagctggcagacagaggcaagcgagcaaacagagtcaccacaggggtagcctttggagccagactgcctgagttcaaatgctggttcagcccttttttagctcagtgacgttgggtgcatcacttaacctctctgattcttcacctgtaaaatgtggctaataagtactacttcccttatgggttgaaatagggattgaataagttcatgtattgagactgtttagaatagtgtctggcacatgccctgtgtgtgtattcctctacagaacctccaggctccaggtacagcctagatgtaaggaaaagaaaaacaaaaatttgaagcttgtctgtggtgcttattatagagaacatttacatgtgctcagaaaatgtaatgtgatgctataaaaagggaaggaagcagaaaaccatttaatggaggagggacatgggcttttggccttcaattttcttgtcaagcatagttgtgcttctcagctttcagttatcatctagaattgtgaggcaaaatgtgctttttatttattgtctatttctttatgacatctttacttggtgttaaaatataatggcctgtctcaaatcaggtgaaaaagcagaggaagataaaatacaaagaaacacattcagtgagactctcggttttctcctcttcctctttgatgctgtaaaatgttttcagagataaatgtcagataaatgctgcagcatcctcatttacccacacagcgtttatcgctcatccaccaactcaaattacctttctccaagagcggtattcagtaagagaatccaagagaagtaaaagtgagagaaaaatacttcggtaaatcagttctcatgatttactttttgtctccatattccctggcctttctttcctttatctgttatcccaaagtcacatttccagccctgtttccaaaccaaaccccatgcttggactactctttctcgaggccaattttttctcttcctctcattatttgaacaactcctgagaattcatttccttgaagaaaaacatttagcaaattccacatcataaattaccatgaccctcacatacctgtgtaccagccactcaccggatccctgggctacagaagtgatgattcagccctttgtcctgaatgagctcatggtcttacatggaaggaaaggcatgcagaaggaggttgaccttgcctttctctggcatacactcacattcatttccttgatgctcttgcttccccactatactgtaagcttctcaaggacaaggattttatctgttttgtttaccactgtataatttgtaccttaaaagagtatcctcagtaaacatttgacgaacaaatgaaaaaaaaatgacaatatggaatgatcagtaaattgatgtgcttgcaaaataagaaatagcacaaaggaaggagtaactgaatgctttgggggacagaagtgtagttggaggggtggggagacttgctggaggaggtgacttctgagctgagtgttggggaaaatgcctacatttatatgcctttgcatgatgtccagcttataggaggtgcccaaggaaagtttgcagggttgataaactttataatttatgaaggagttacatatacagtatctctaatattctaccattttttgcattcgtaaaaaggggaaacatggccatttcatgctggattatgtaaacctggaagctctatctgctacctagaaaacctcttagtagggtacaagcacctactggaaagccgtgtgtgtgtgtgtgcgcacacacacatacacacacatacctgcacatgcacccttgacaaagtagagactggctagggcacttgctgggaggcaaatcaatcttaagtgtgtgctttagaagaaagatcctattcacgaaagaacatggaaaaggtaaggacagaggtgatttccagagactggcctctcacctcacctgtgagccagaccacagctcattacctaactcctatatccaccacccaagccagttttatatcttaaaatttctgaaaatccattgattatgccatgggagagcctgaggtaggagagaagaggagagaaaaacaaaatgaatttttagttgaattaatataatgagcttactgagaaaaaacaagatacaagacctagacttgctattagtttatttttaggtttcttaactttgtttagctccagctccttcctagcatgaacgatgttgatgctgaaaaccaaaactactcatacctatgagcctactatcctggtgtgatctctggctccctcaggctgttccagacacaccctgtctatgactgactgaagacatctgcatctgagcaacaccaaattataacaaaaattagatccttcacctccgattaattctcaacttgtatttttaatatatgtatgcagcttcatcatacacaacaaagaaacgttcttcaacaatgccacaagaagtagaatcgtgcatcacattttacaaagaataaaatatgaagaaggaaaaaacaagattggtaagtagtatgttagtataacaaactacatttggcatttgggaattacagacttcttcccttggttttattaagtttgtatcaattctagcaatgcttgtcacttataaaacccctaactaatcctttgatgaataattcacaagtgtaaaatcttcgtcgcatccttaaatatcttctttaaatagcatgttgtctcatttgtctaagatcatggagaaattctctcattttagaaaatgttgtgtgccaggcactgaactagatgttggggagatatgcatagttctgatctggagcttgtgttcaagaaattaaaagcagacaataaaccaataagtaaatacaataacatgaagaaattaaactggatgatgatacagagataggctggtaaaaggtgggagtgagttcaagctgagatttgatgatgagggcaagcttcactgagaagctgaaatttgaactgagacctgaatgctggggaaccagtgtgggaagatcgaggggtagggtgttcccatgcagagggagctgtaagcacggagatgagctgtcccacaaaagcaacttctccagtcatctcctccattaaatagcctctaccatatatattttaggcatttttatgagaatgtgtccatattatattacacatttcctgccttattaaacagattattatatatcaggaagggttgggtggctttgttcttatctctttttccagcaagttttttatcaatagttttaataatgacctatatcagtcagggtctaatcaggagacaaaggcacaagtaaattgaacagagaaagttttatataaataattaactgtgacaggggattggagtaatggagggttggctagtcaagggtaagaataactctaaagaatacaggaatagcagatgttaggagcagctaccacctctgagaagactcctcgctacaatgctaagctgcagatcctgctggaagaggtacagccatggcagtgcagtttgctgggggctctagaaatctgccctctggagtactgggggaagctgcctcgagtggctccaaggaagtcattctttgggagttgctacatcagcagcactactctgtgaagccccccaaggggatactgaaaatctgcctttgaggagtaccatgtgtttccagccaccacgcactgcaggagctgggtactgtagaagtatgtgctacagaagcctgctgagatatcatactggtatcaggaagagaaaccccttcctcctccagtgtccctcccagtgtcttctgctggcaaagcttaacattgaatcagctgacaaaggagaaatagttacaatagttacattattgcaaagcaggcaatgaaggtgcatttggagctgaggggaaataagttaatatctggtgcatagcccagatgacctgctcatcaagctttcgggtagggtgaaactagaaggttgcattaaatgacaagactcagtagctggcactcagccaaatccagcaagatgacatttaataattttgcgttgaccatttctaatgtgtattttcttttcctttcagtcttttaaaaaatatttactaattcagtgaaaatgttatttaaacatacatttggttattaatgagatttgagatttttcaaatgcttattttattcatttacatttgttcgaatagaaaaggaagtacataaaattttacattaatatcactgtaaaaaattaaaaaaataatttttaaggtaaagtcttacagtcaaattcagcaaaacaactaccttggtacagtgtgggagaaatgttgctcaacatcataagaggaacagatttgagagttgagctgaatgcaagcttggtgtgagtcactagcataatgactctgccaaaaaaaaaaaaaaaaaaacacctactttgatcccaagctgcataaattaaaatataacatggagaaatagatagctttctagtccagatctgattacaactggaatattatgttttgtgagagtcaatgtatgggggtatggtgaagtcaaacctgatttaggtctttcttaactttgatggattttagttaaacacattcccatttctctgcattagtcatccttccttgaaacacattccttcaataaagtcctctgtgaccattccagcttgaatgaattcttctctcttctgaattcctatggcaactatttttggagtctatttgatagttagtcatatacaactcttcttttgttgtcttgaactacattcaataacattatgaaaatctaccacataaagagaaccactcataacatttgcgtactgaataatttaaatgttaccttagttacttttatatcttaatttcttattcattcatatggtttttagaaacaaacttaggatgtgctatgcatcctttttacgaacttttttcagttaacattgtaccataaacatactagaaagcaagtgagtgaaagtgaagttattattgcagtagctgttctgaatcacttcataaaatgcaaataactccaaatggcatcttcactaataatggtattatcatttgcagtacaacttatgactcttttttttttgttgagacggagtctcggactgtcacccaggctggagtgcaatggcaagatctcagctcactgcaatctctgcctcccaggttcaagtgattctcctgcctcagcctcctgagtaactgggattacaggtgcccgccaccatgcccggctaattttttgtatttttagtggagacggggtttcactatgttggccaggctgatctcaaactcctgatcttgtgatccgcctgcctcggcctctcaaaacgactctttatgagacactagtgtattaagaatctgcagctgaatgctgctcatctggataataagatccttaactgtaaataaactgccttatttatctttatatcatcactgcctagcacagtgcctggcatatagtaggagttcaataaaggcgtgctgaactgaaaagcttttaaattattgtgcctaattttgcgtctcaaaatgtgggatgcttttataagcaaaagaaggacagagacagtgatttttaaatgttctgaagaagcacaggaagtgtagtattgttgctagtcagaaagggtctttataaaagtttctttcatttgatgaaataaggagttttctattcaaagacctccatgtgttgaaaattggtaataggccaggcacattggctcatgcctggaatcccagaactttgggaggctgaggcaggaggattgcttgagcccaagagtctgaaaccagcctgagcataatggtgaaaccccatctctacaaaaaatacaaaaagttacccaggcgtggtggtcagtacctatagtcccagccatcaggaggctgagatgggaggattacttctgggaggtcaaggcggcagtgagctgagattgtgccactgctctccagcctgggcaacagaacaggagtctgtcacaacaaagaaaaagaaaataataaaagaaaattggtaatgatgaactggaatcatatctaattagaaataaccaatcagatagtaaattattaagccacaaccaagcattatgctgaaaaacatggagcaaaactactaatggcctgtagattcaatatttcattatcatctttggttttgtaaataaaagaaataatatgttagaagaaattttaatttcttgatagaactaatgtttatccagtattattttctgcctgaaactctttctgaaagtggcatcttgcatgagccaacatcgattagaaataacatgaaaatactgatttgtagacatgattcataaggatattttagtggaatgtaaactgccactatgtacatttttcaacttcactctgaatttatttcaactgtaaaaatcaaacctggtgaaacccactttcaaaatagagccatttaatagctcaacaaagatttatttaacaatgtgggtgcatacaataaatcttgaaattgatttgtatttttgaatttggtgcttagaggagaaattagtaaagtgaaaaagatttcaaatattggctactttctcactttgcaggactttgataaattatgataaacttataaaagttatcatctgaggccaggcacggtggctcatgcctataatcccagcactttgggaggccaaggcaggtggatcagttgaggtcaggagttcgagatcagcctgaccaacgtggtaaaactccatctctactaaaaatacaaaaattagctgagcatggtggcactcacctgtaatcccagctacttgggaagctgaggcacgagaattgcttgaacccgggaggcagaggttgcagtgagccgagatcgcaccactgcattccagcctgggcaacagagtgagactctgtctcaaaaaaaaaaaaagttatcatgtgagtctcttattaggtccttatgaatcctattttttctaacatctgggatgtttgaaagttattgatgagatatgtagaattcccaatagagactccagggaatcaaagctttctacatagtaattcattacaaaggtatttattgagggcctctggtgcgctagacaaactataaagccttgtgatatttggatttcaaatgtttttcttagatatttagtattaatgtgaagcatcttaaaacatattaatgtgttactatgattaaaagcatctaaatattgattgatcctccatcaatgaaaagtgaatcagtgcatgtgccattttccagttaggctaaacctctagattctggtaaggatctaaagcataggtagcattcctctcaagccacttgagaaattatgataatctcctttgaggtgtattttaggaagtagcagaaatcttgatctgaaaggagctttaaagatcaacatgttaaacttccacttctggccaagatggagcaacaggcacaagatttactctcccacctgaaacaatcacaaaagaaaaaacagacaaaatgtatgaaacaactattttcaagacactgaatattgggcaacccaaaacaaggatctctgagagacagaaaacaaatgaaatgagccctgctgggccctatcttaccaccttgacatagtttctagacagcaccatgaaaagtgagaatgtaggcaggacctgaaagactctctaagttgagaagttgttgctaggagttgggaaacaaaggcagcgagagttcacagaaagaagtaccggaaggcagcgagagttcacagaaggaagtaccagaaagcagagaactgcacagggctagaaccttgaagatctgtagagggtctccctcaagtattcagcaagtgctgatcagtgcatacatgtccggagaatacccaaggccagagaaagaaccatccaaaagaatttccagtaagactggaacacctcataattcacagagcagtgaggagaatactcagaaaagtctttcctcctgcaaacataaagaaaatttagcaaataaagtttaacaatgtataacaagggtaatacatcatgaccaagtagaatttatcctggactgcaaggttggcttagtatatgaaaatcaatcaatataattcaccatagtagcaaactaaaaaagaaaaaccatatgttcatatttatgaacatgggaaaagcatttcacaaagttcaacatccattacagataaaaactcagcaaactactaatagaaattatcttcctcaacctcataaaatacatctatgaaatgcttatagttaaaattatgcttaatgataaaagactgaatattttcctcccaagataatgaacgggacaagtatgtctgcacttgccacttgtattcattttactatccagtgcaataaaataaaaagaattaaaactgtcctaattatcagatgacatgatcacctataaagaaactcacaatggaatccattaaaagggactaataggtgaatgtagctaggttgcaaaaaatgagattgatataaaaactcaattgtatttctctcaatctgcaacaaacagtgagaaactgagattttaaaaaccaaatcacttataattagcccccaaatatgaaatattaaatacttaaggataaatcaaacaaaagatacttaagaattgtacactgaaaactacaaaacattgctgagataaatttaagaagacccaataaatggagacatatactatgtttatgagtcagaagactcaatattgttaagaggtcagtcttaacaaattgatctatagattcagcacaatccagtcaaattcccagaaggtgttttgtgtgtgtatatgtgaaaattgacaaatgaattcaaaaattcatagggaaatgaaaggacctagaatagccaaaacaactctgaaaaagaacaaaaagtcaagtctttgacttgagacaaagggtcgaagtcaattcagtgggtaaagaattgacttttcaacatatgatactgaattcaaacccatatgcaaaaaaatgaatttaggaaaactcgtatacaaaagttaactcaaatggattatagttcaaagtgtaaaatttaaaaccataaaaattctaggagaaaatagaaaatctttgttaccttgggttaaccaagggtttcttaaataaaagcataattcataaaagaagaaaaaaatggataacctagacttcaaaattaaaacttcccttttcaaatgatgttttcaagagaatgaaaagaagggtggggccaagatggctgactagaaacagaagtgatcagaggctcccatcaaaaagaaccatcattaatgtgtgaatccttcattggcaaccaaggtatcttctcatcagaactgactaggtggctagacttgatccacagagaggaaggaagagcagtgtggtgcggcagcccgtctgagagccacacggggcaggggagcccccactccccagccaagggaggcagtgagtgagtgtggtacccagcgtgggaaaccgtgcttttttccatgggactgtgcaacccacggattagaagatcccactcaggaacccacgccactgggacctagaatgccaaccccagagctgcacagattctcaacaacctctcagctggaatctgcctaaccctgcagagctcctgcggggaggggtgaccagtgccacagctgctgctgcctgctgcctaagccatttgagctccttgggggaggggcagcagccagcactgggactcataactgcctgataagctaagctctctgtgggggaaaggatggcatccatctctataactccaggccatgcttttcccctgctggagccagggaggctggatggcttggtccccaagagtggtcccccacagctcaacacactggctgtggcagactgcaacaagagcgcctcttcaggcactgacatatccttcctcacttcctatatggtggggcttccctacaggaactccaataactccagccagagactcagggacagaacctggatctccctgggccttatcccctagtgggaggagtggctgcagtctctgcagaccagcagacttagcccagaatgccacccagcaaggcacactccctccaccaagagacagtgaaaatgcttcattaaatgggtcccatttcccttgtcacccaaataggtaagaccttccaacaggggttgtcagataccctatacaggagtgatcctactggcatcaggttggagcccctccgggttagagatcccagaagaaggagcaggcacccatctttgccttctccagcctgcttgagtgacatctccaggtgcgggagcgaaccagataaatagggcctaaagtgaacccccagcaaaccacagcagccctacagaggagggacctgaccagtgaaagaaaaacaaacagaaagcaacaacaacagcatcaataacaaaagaagtcctcacaaaaaccccatccagtggtcagctgcctcaaagatcgaaactagacaaactcacaaagatgagaaagaatcaatgaaaaaatgctgaaaacccaaaaggacagagtttctcttcccctccaaatgattgcaatgactctctggcaagggcataattgggtgaaggatgagatggacaaattgacataagtaggcttcagaagatgggtaacaaaaaactccactgagctctaggagcatgttctaacccaatgcaaagaagctaagaaccttgaaaaaaggttacaggagctgataactagagagagtttagaggggaacataaatgacccgatggagctgaaaaacacagcacaagaactttgtgaagcatacacaagtatcagtagctgaattgaccaagaggaagaaaggatatcagagtttgaagaccacctcactgaaataaggcatgcagacaagattagagaaaaaagaataaaaaggaacaaacaaaacctccaagaaatatgggacttcataaaaagaccaaacctacaattgattggagtaccacctgaagcagacgtgaagaatggaaacaaactggaaaacaaacttcaggatattatccaggagaatttccctaacctaggaagacaggccaatatgcaaattcagaaaatacagagaacaccactaaagtactccacaagaagatcaaccccaagaaacataatcatcagattgtccaaggccaaaattaaggaaaaagtgttaagggcagccagagaggaaggtcaggtcacctgcaaagaaaagcccatcagactaacaatgcacctctcagcagaaactccacaagtcagaagagattgggggccagtattcaacattcttaaagaaaataattttcaacacagaattttatatccagccaaactaagcatcataagcgaaagagaaataaaatcctttccagacaagcaaatgctgagggattttgttacccccacgctggccttgcaagagctcctgaaagaagcactaaatatgcaaaggaaaaactggtactagccactgcaaaaatacaccaaaatataaagaccaatgacactatgaagaaactgcatcaactagtatgcaaaataaccagatagcatcatgatgacaggatcgaattcacacataacaatactaaccttacatgtaaatgggcaaaatgccccaattaaaagacagacaggaaattggataaagactaaagacccattggtgtgctgtattcaggagacccatctcatgtgcaaagacccccataggctcaaaataaaggatggaggaaaatttaccaagcaaatggaaagcaaaaaaaatgcaggggttgcaaacctcatctctgacaaaacagactttaaaccaatgaagatcaaaaaagacaaggtcattaaataatgataaagagaacaattcaacaagaagaactaactgttggctgggcatggtggctcaaacctataatcccagcactttgggaggatgaggtgggtggatcacgaggtcaggaaatcaagaccatcctggccaacatggtgaaaccccatctctactaaaaatacaaaaattagctgggtatggtggcatgtccctgtaatcccagctactcgggaggctgaggcaggagaattgcttgagcccgggagacagagattgcagtgagcctagatcacaccactgaactccaacctcgtgaaagagcaagtctccgtctaaaaaaaaaaaaaaagagctaactattctaaatttatatgcacccaatacagaagcacccagattcataaaacaagttcttagagacctacaaagagacttagactcccatacaataatagtgggagactttaacactccaccatcaatattagacagatcaacaaggcagaaaattaacaaggatattcaggacttgaactcagctctggatcaagtggacctaatagacatctacagaactctccaccccaaatcaatagaatatacattctcagtgctacatggcacttattctaaaattgaccacataattggaagtaaaacactcctcagcaaatgcaaaaaaactgaaatgataacaaacagtctctcagactacagtgcaatcaaattagaactcaggattaagaaacttattaaaaaccacacaattacatggaaattgaacaactcgctcctgaatgactcctggttaaataatgaaattaaggcagaaataaagaagttctttgaaaccaatgagaacaaagagacaacataccagaatctctgggatacagctaaagcagtgttaagagggaaatgtatagcactaaattgcccacatcagaaagctagaaagatctcaaattgatacactaacatcacaattaaaagagctagagaggcaagagcaaactaatccaaaagctagcaggagacaagcaataactaagatcagagcaaaattgaaggagatagagacacaaaaaccctccaaaaccaggaactgtttttttgaaaaaaataagaaataccactagctagactaataaagaagaaaagagagaagaatcccataaaaaatgataaaggggagatcaccactgacctcacagaaatacaaactactaacacctctatgcaaataaactagaaaatctagaagaaatggataaattcctggacgcagacactctcccaaggctcaaccaggaagaagttgaatccctgaatagaccagtaacaagttctgaaattgaggcagtaattagtagcctacccaccaaaaaaagcccaggaccagacaggttcacagccgaattctaccagaggtacaaagagaagctggtaccattccttctgaaactattccaaacaatagaaaaagagggactcctccctaactcattttatgaggccagatcatcctgataccaaaacctagcagagacacaacaaaaaatagagaatttcaggccaatattcctgatgaatatcgatgcgaaaatcctcaataaaatactggcaaaccgaatacagcagcacatcaaaaagcttagccaccacaatcaagtcagcttcacacctgggatgcaaggctggttcaacatacataaatcaataaatgtaatccctcacataaacggaaccaaagacaaaaagcacgtgattatctcaatagatgcagaaaaggccttcaataaaattcaacagcccttcatgctaaaaactctcaataaactaggtgtcgattgaacatatctcaaaataataaaaactatgacaaacccacagccaatattatattgaatgggcaaaagctggaaacattccctttgaaaaccagtacaagacaaggatgccctctctcaccactcttactcatcatagtattggaagttctggccaggacaatcaggcaagagaaagaaataaagtgtattcaaataggaagagtagaagtcaaactctctctgtttgcagatgacatgattgtatatatagaaaactccatgatctcagccaaaaatttccttaagctgacaagcaacttcagcaaagtctcaggatacaaaatgaatgtgaaaaaatcacaggcattcctttacatcaacagtagacaagcagagagccaaatcatgaattaattcccactcacaatcactacaaagagaataaaatgcctaggaatacagctaacaagggatgtgaaagacttcttcaaggataactacaaaccactgctcaaggaaatcagagaggacacaaacaaatggaaaaacattccatcctcatggacaggaaaaatcaatattgtaaaaatgttcatactgcccaaagtaatttatagattcaatgctattcccatcaaactaccattgacattcttcacagaattagaaaaagctactttaaatttcatatggaatcaaagaagaccgcatacagccaagacaatcgtaaccaaaaagaacaagctggaggcatcatgctacctgacttcaaactatactacaaggctgcagtaaccaaaacagcatgataatggtaccaaaacagacacatagaccaatggaacagaacagagacctcagaaataacaccacacatctacaaccatccgatcttcagcaaacctgacagaaacaagcaatggggaaaggatctcctattcaataaatggtgctgggaaaacgggctagccatatgcagaaaattgaaactggaccgcttgcttacgtcttatacaaaaattaactcaaagcaatggcaacaaaagccacaattaaaaaatgggatctaattaaactaaagagcttctgcacagcaaaagaaactaccatcagagtgaacaggcaacccacaaagtgggagaaaattttctcaacctactcatctgacagagggctaatatccagaatctacaatgaactcaaacaaatttacaaggaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataagacacatgcacacgtatgtttattgcggcactattcacaatagcaaagacttggaaccaacctaaatgtccaacagtggtagactgggttaagaaaatgtggcacatatacaccatggaatactatgcagccataaaaaatgatgagttcatgtcctttgtagggacatgaatgaaattggaaatcatcattctcagtaaactatcgcaagaacaaaaaaccaaacaccgcatattctcactcataggtgggaattgaacaatgagaacacatggactcaggaaggggaacatcacactctggggactgttgtggggtgggggaaggggggagggatagcattgggagatacacctaatgctagatgacgagctagtgggtgcagcacaccagcatgtcacatgtatatatatgtaactgacctgcacaatgtgcacatgtaccctaaaacttaaagtataataataataataataaaaattaactcaagatggattaaagacttaaatgtaaaaccccaaaccataaaaaccctagaagaaaacctaggcaataccattcaggacataggcatgggcaaagtcttcatgacaaaaacgccaaaagcaattgcaagaaaagccaaaactgacaaatgagttctaattaaactaaagagcttctgcacagcaaaagaaactatcatcagagtgaacagacaatctacagagcgggagaaattttttgcaatctagccatctgacagaaatcgaatatccagaatttacaagcaacttaaagaaatttacaagagaaaaaacaaccccatgaaaaagtgggcaaaggatataaacagagacttctcaaaagaagacatacatgcagccaacaaacatatgaagaaagctcaacatcactgattattagagaaatgcaaatcaaaaccgtaatgagataccatctaacaccagtcagaatggcgattatttaaaagtcaagaaacaatagatgctggtgaggctgtggagaaataggaacacttttacactgttcttgggagtgtaaattaccccagccattgtggaagacagtgtggggattcctcaagtatctagaaccagaaataccatttgacccagcaatcccattactgggtgtatacctaaaggaatataaagcattctactgtaaagacacatgcacacatatgtttactgcagcactgttcacaatagcaaagttgtggaacctactcaaatgcccatcaatgatagagtggataaagaaaatgtggtacatatccactatggaatattatacatccataaaaaggaatgagattatgtcctatgcagggacatgtatgaagctggataccatcatcctcagcaaactaagacaggaacagaaaaccaaacactgcatgccctcactcataagcaggaattgaacaatgagaacctatggacacagggatggaaacaacacacaataggcctgttggggagtaggagggtgaggggatggaagttagaggacaggtcaataggagcagcaaaccaccatggcacacgtatacctatgtaacaaacctgcacatctgcacatgtatcccaaaacttaaatacataaatagaatgataagagaagccacacattaggagaaaaaagttttcaaaaaatatggctagtaaaggacatctatatcttgcctctagaatacataaagaacactcaaaactcagtgaatccaaaaatcttattgagcataagatatgaacagacatttcacaagagaagatatacagatggcaaacagcacacaagatgattttaaatattattcattaaaaaatgagaattaaacacgatgagatatcacaacacacccatgagagtggctaaaatttaaaagactgaccataccatgtggaggaccttgaactctcatatgctgctgatggaaatgtaaaattgtacaaccacttaagaaaacagtgtggcagtttttcaaaaagttaaatgttcatctactatatgatctagtggaatcacttctaggtatttgctaagaaagttaaagcatatattgatgcaaagttttgtatatggatgttcataacagcttaatttgtaatagcccccaaactataaaggacccaaatgtctatcatcaggagaatagataaacaaattattacatgtgatggaatactactcagcaataaaaagaaatgagctactgatatttgcaacaacatgaatgaatctcaaattatgttgagtgatgaaaaagagtaaatgttatatgattccatttatataaaactctggaaatttcaaactaattgatagtgacagaaagcagatcagtgtttgccctggagatagcacggggaagggtggcagattagaatgtggcatgataaaactttggaggcaatggatatgtttagattcttagtcgtactgatggtcttatgagtatatacttatgtcgaaacatctaattaaacaacttatgctgtctattgtatgattgttatacctcagtaaagctgtttttaaaaagatctgcgcatcccttcccattttatggatgaggaaattgagtcctgaggacaagagaacttttccaaagtcataccactagtccaatgcagaggcattaggtttgtccataatgaagcttctgaatgaaaatagaagagctcctggtgtaattccagggagctgaaggccattatcctaggtgaattaatgcagtaatagaaaaaccaaacaccacatgttctcacttataagtgggagttaaacattgagtacacatggacaaagaagggaacaggagacactggggcctacttgagggtggagggtgagaggaggatgaggattggaaaactacctgtcagtactatgctcattacctgggtgacataataattacaccaaatcccccaacacacaatttacccatgtcacaaacctgcacgtgtactccctgaacctaaaataaaagttagaaggaaaaaaatgttaaaagttaaaatgggcagagaaactgaatagacatttttccatataaaacacacaaatggccaacaggtatatgaaaaggtgctcaatatcactaatcatcagagatatgcaaatcaaaaccacggtgaagtatcatctcacacccgttagaatggctcttatcaaaaagtggtaagtgttggcaagtgtgtggagaaaaggaaacacttgtgcgctgttagtaggaatgtaaattggttcagctgtgatgaaaaacaatatagaggttctttaaaaaataaaaaatgaactaccgtatgatacagcaatcctacttttgggtacatatcccaaggaattgaaatcagtatcttgaagagatatctgcacgtccatgttcattgcagcattatttacaatagccaagatatgaaaacaacccaagtgtcccctgatggaagaatggataaaggaattgtggtacatatatacaatggaatattgttcaaccataaaaaagaagaaaatcctgccatttgcaacatggatgaacttggaaggcatcatgctaggtgaaataaaccagacacagaaagacaaatactgcatgatctcacttatgtgtagaatcttaaaaagccaaactcttagaaacagagagtagaatagtggttgccaggccctggggatggggaacatggggaggtgttgatcaaagagtataaagtttcatttataaaatgaatgagttctggggatctaatgtacagcatgggtggagatagatgtgttaattaatgtgattgtggtaatcattacataatgtatatgcatatcaagtcatcacattataaactttgaatagattcgatctttatttgacggtcaaatattttaatttttttagtgaatttcccagcccttgatcccaatttcacggcagcagagctttttttctaactcttggtgcccctaagagggttgatagcctagattgtttcctccaaaaagcaccacacttatatttgttttgaacattgtgagtattcaaactctgtattaattcaaatggacttatttgctgttttaggtctgaatcgtttgcttaccaatggctcctatgaagctgcgtttcccctgcatgaggtattgtgctgtctttaatctttatctttctttcaatcgtttgttactaaagtcagcttctagagatagtcaataattgaatttgttgacatttgctcagaatgaatttaatttgttcaatgggtaattagggagggtctacttcaattgttatatctcttcctcagcatagacttatttctatatatcttttcatgtaattgcgagaatacttaaatcaatagtcatgcagcatgaattcataggaatggcttagagactttaagtcttaaaattaaaaaggcattgacaatttgcatgaggcaccaaatccacaagaagaatgttcttgaaatatatagtctttgcaacaaataaatgtatagctattgcttaaaagagtgggaggaagccatcttgaaaagtctctggtaaccaacgggtgacaaataaaaattaataatgttgtactcatcattgttcacctaagatgtataaatactgtgactctatttcctacatagtctccatcatataaattactttcgcaagtgtaactgattaccccagctctactttccacagaattatttaatccagaattcccctacacctgggtttttaggaacataatccctcatgattattgagaaattattgtcattttcatggtgtggcacccctactgtggtcactatatggcacagagaatacaaagataaatgtcatagcctctgtcctctgggacctcacaaagtagccaatgtgcagcaactgttagctgatgttcagtacagcctgttggaaacaatggtaataatttgtcaatagactttggaagacggttccaactctccgtaaatggcaagtctttccaaaacatacttttttttggcttacagtggtacttctcttaattttaaacactaagagggtgcaaaagatgaggtagatttttcagaactttatttattaagaaaaccagaagctgccatctgaaactctgtttagactgccaggaaatgtgtttggaatgctccatttactatgacagaagcaaacattttgacacaaaggtttgctagagccatacgcaggtgtttctgaactctaaagacatactgttccccaaaacatcatgtggcttcatcatgtcattgttagttggcattgcccagaaaagggttttgtgagaactgcatcctccctgctctcagccccagctcatggtatgggctgtgtctgatatggtaagtggcagaagcgtctgtgcaggggagtgggtgggtgggcatgggagtgtctgaggagatgcagctacaaagccccacagagtgactcatgcctttcacaatgactttcctatctcagtaaagccctgtattctatgagaagttccaaattggtaatagcagcagcaatcattgcatcattgcttttctgactttttactctcagtttaacttgattatattatttaacctcagaggcaaaaaggcagaaggtcagatattgctgctcttgtttcacgttaaagatttagatagaggtttagagaaaggtgaaacctccttaagtcacacaatgagttggtggttgatctgagactcacctgagtttctttctcctagccctgtgttctttccattaagaaaggacttcttatcaggtgtggtggctcaggcctgtaaccccagcactttgggaggccaaggtggaagtattgcttgagttcaggagttcgagaccagcctgggcaacatattgagacattgtctctagcaaaaataaataaataaataaataagaaagggcttctccacttaatatgaataattagcttgcctccagaaagtaccgtttctctttgtgaaactatcattgccacaaactaacctcagaaaaacatgcacttctctggccctttgtctcctcacttcttcaatgaggaggttgaattaaatttgaattacaagaattctgaagtgacttccagcttttacattctagaattttcttgtcgataacattgtgacaaggttacaactatggctgtttaccaactatcctatcttgaaagaagtgggaagagaggccaggcacagtggctcacacctgtaatcccagcacattgggaggccgagggggacagatcgcttgagtctaggaattcgagactagcctgggcaatatggcaaaaccccatctctacaaaaaatacaaaagttagccgtgcatggtggcacatgcctatggtcccagctacttgggaggctgaggtgggaggattgcttgagcctgggagtcggaggttgcagtgagctgagattgcgccactgcactccagcctgggcaacagagtgaaacccagtctcaaaaaataaacaaataaataaataaaaagaagtagggaagagaactaataagccttgggcatggcccctgggccagacactttattcattcaaaccacataagaaaccaaatgggacaaatattagttccactatggattaggaaaccaaagctcagagcatttagggaacttgcccaggatcttctagctgaaaagtagcagaattgaatttgaactcagttcaaaccttcctgattatagcaagcacgtgcattttactagatatcagcagtagcaagacaatgtccagaataactcatcaaactgcctgccctttaatagagaggattcatttctttctcataccactcctatcacaacacctgctgtaagacacttacattaccatcagcatttccttgtgacttttgtgagtactacctcactggcagtggtgtttttatcccagggaagttatagaagtaaaaactccattcgaacccatggagcagaaaaccaccgacatctactctatgagtgctgggcctcctggggcgtgtggtataaataccaacctttggatcttgtaaggtgagtttttaatcagctgcaaatataaagcttgcacagaatgattagggcagactgtcagctgggacaagctcccaatgaagcaaaaagagcctgaagtgtacagctctcactcatatctggcttcttcacaagaggaaactcatctgaggacatcagctgttcttggtaaacctaccatcgctctgatgaggatggaatttcccccaaaaagagtcttagagaggggcccaggaatgggcatgtgagatcagccaggcctgtcacaagacttcgtaagaagcgagtcacccatgtgagtcttattgacaaaccatcttgtacaaaggtaacactgcttacatatattactgacaaagtaaaatatttactactgttagcaaataggacaaatggagtactgtcattccaatacatttcaggcttagttttcattcagaactaataacctttaaagattgttttaatctgcagatcaaaaagtatatcagcttttaacctatgataattgtgaagtggaaatgtatgtttttttattattattatactttaagttctgggttacatgtgcagaacatgcagttttgttacataggtatacatgtgccatggtggtttgctgcacccatcaacccgtcacctactttaggtatttctcctaatgttatccctcccctagccccccaccccccataggccctggtgtgtgatgttcccctccctgtgtccatgtgttctcattgttcaactcccacttatgagtgagaacatgtggtgtttggttttctgatcttatgatagtttgccgagaatgatggtttccagcttcatccatgtccctgcaaaggacatgaactcatcctttttttggctgcatagtatcccatggtgtatgtgtgtgtaaatatatgtgtgtgtttttttttaactatctatatcttcccaaccttctgccttggcagcattattctctgacatctctatttatttagaggctggttattaagattgggtaataacaacccacatttcctggattccttattaaagagaaagtcatgtctcatttcctagactagctagatgtgttgtttcacttaaataccagggccataaaataaaatgagcccagaggggaggacaaacaaaagacaatgcactttatatttgagcccttatcaccaagtgttccaagggcattgatgaattgtgatccattccttgtgttggtaacagataatccagataatcttagtgaatggaaaatattttctgagataagatcattttcctttggtcagactcagtgtatgataaacagtggggggaaaaacaaaagtaaattctcttcccagcctcggtgccatgttacaggattacattgattagaaatcacagataattgctgtaggcagcacatttcccattcatgacagtattttgattaagattttgcggttttggttagtcaatgcatattaattaactgtctattgtgtatctagtactgtgctaagtactattggcaaagccaaacagacgccaaatggtctctggctctgaaaaactcagttttcctcagcaacacaggccctgcatacttgaaacatcgagaaaagaaaatacaaggccatgcataattaggtaaaatgtgtgacagaggccataagttttacagtaattcagaaaaatggaaagaacggatgtggcagcacccctgtggaagtctctggagagctgagccctgaagaacagtggcatttatgttgggcaaataaagggggatgaaaagcacaaccaagccttgagtagaatgaaagttgtggagcatctagggaatgtcatctcttagacagttcctatcctataggttttacttccaccatatctctcgaatcgggccccacctcagcatctccactgccttcacttgttacctggactatgacagctgtgtgcctggttggtctccctttgcccactccggccccttccagtccattctgtcttctcagaataagcttgtatacaaccatgttattttatggaagggctaattctagttctgctatagagtagtagtagaagaaatgtaagcccagatcctagatttgatgggatgttcttttatcttggcttaccttgcttgcagtttacctcgtaaggccgctacaaagtaaaatgactatacgaagtttcataatgcttaactttacacactgcactgtaatttgcaaggccgttgtgtctttaacaggcggtactttggagagaagattgggttatattttgcctggttgggctggtacaccggcatgctcttcccagctgccttcattggattgtttgtctttttgtatggcgtcaccactctggatcacagccaagtcaggtacggggagctcttggatgagtttgcctttgtttagtacttagaggtggctgtttgcactttgggggtattcacagattgtggagacatttagcttttcactcaaacttcctaccctctcatggaaaaactcaaagtttcagttcactaggacctctccatccattgtccttgctgccatggtcttcagataccatgcaagtaaaagttaccttttcagacatacaagccactatatatccacagaacaagccgccttcattcactggctataagtgctctctttttttactttttcactttttttcttagctgatactgcaaaatagtgaactaacaattctctcttatgaattctgtgtttttacaacttgagccagaaagacatctcaccagcttgctagtatcttgggagcggttcagtgtcgatgaccattatcttggttgtctcaccagaatataggtcaaggtactcacagagatcttgttgcaaggctggacaatgatcttaaattgtaaatatgccttttaaatgtgattgcaaaaataaaagtgagtgattaagccttccacctacgaaaacattttactttctggtgaaattgttaatgtgttagttaaatatagttttcccccaggatagggctagaatctctagtcatttatgttttgttttccatattagttttaacttatcatacacatagagatcaagataagtatctttatatatcttcttactcccttaattcagtatgaaattgcttcagacctttgaaaagtgaaggacatttctataatttgggatataacaatcaatgtttggcttcatgtattttcctgagtttaacttattaatacataaagataaggaacagcctcataagtaggtttaccaaattatttaaatgggcaagaacttgtttacattaataacagataaagctaagatgcttctaagggcaaacatttaacctactggatcttatttactagttgaacattctggtgaagttagaaaaaaatgttccatgtcatcaaaaagcagtcctttctgttctcttttccagtaaagaagtctgccaagctacagatatcatcatgtgtcctgtgtgtgataaatactgtccattcatgaggctgtcagacagctgtgtatatgccaaggtaatttcaaactgtagcattttagatgaattgaatttaacatacaccttcctgagggatggtgggtaactctattctgtcatttccagtctttgattttcaagtgaatgttgtaggatagacttatctccatcattcagtattctaattcccatatctttgttaattgtccatgtatttggaaggcatggctctagacatcatccatggagctgcagcatggcacagtgtgaggagcacggtgctggagtcagagaaagttaggtccaaattttgactctgctgtttaccatttctctatctgggaataagatatttaacttctttgagtctcagttttctcatctgcaaaatggagaccatgatgcttgtttcacacggagttaaggtgtatactgagcatagtgcttggtaaatagacctcagtaaatgacagctatcatcatttgcctcctcttcatcatcattattgtcaaaatgacctccaattaaggctagctcagccacttacctctttagccctgaaatgtgccccctttctaagaaactcttttttcatagaaagaagctcagtcttctgagctttcttgtctctaaaatacaggaaatatgtgtcctctctgtcctaccctattggcatgacgtgaggactaaagaagagaatatatgtgaaagtgctatgagaaaaaaaatacatgacaccactatttctattatgtgttattgcatacctctttctcgtgatatgccttactttatttcttagacatattcctcacattcctagagttttttgatacttaggtggtggtgtccataacacaaaacaatagctgaagtttgagtttgcgaagacttttccaagagctactgccttttggcttgcccagattcagatataaatggcattggcagattttatccagcttttgtaatcactgaagcctggatctatctaattactctcttggcattgcagagttttgttcattttaaacaagggaacatttgataggcaacccaggatcccgcctatctataatgtctttagtactgcaggtggccggtctgtgtaggaggagcccagactgcagcagtgagcagtggttttagaaagatttgagctcttatgttgcaagggacaaaaaaagcacaaaatgctctgagccctatctttaggaaacactcagatagacctgagtggataaggataaatttaacagagtgactttaggacatagagatttggtgagcatcaagagctttgtcagtaatataattttgtttaaaggtcagatataagcctgaatgactcaggttttaaaattctgcttctggggaaaccccaaaatcagaagccaatttttttttttaatgtggaaagatatgcttgagtaaaattctctttttaggagatccttaataattcttttaaagaatcgtcatgaatagtttatgagtgctcagattttataggggcttattttgggagttattctccctaacttaagacctagaacaataataattataatagttacagctataataatagctagacaatctacattgattatttctaattctcacagcaacttcaagataggtgttattatttccattttattcagagactcaaagaggtaaaaattactcatgcatggtcatgcagcaataagtagctgggccttggtttattgcactgcaaaacatgccttctttaccactgtgccctgctgagccacaagatgtttagattctgaatttaacatttggccttgcctagaaacttagtaaaatgaaagataaaaagccttagaatgacagaattggagttatacagggtttcctttagaaatatttattagagatgtcagagtgatttcatgggactgtggatacacagaaatattaaatcagattggcgctgggatctagtccaatcagtggctgttctgctgatagggatgctgtatccttgactcttgtgtttgcaagaatcagaaacccaactcctactggcttagtcagaaagtgatgtaatggtacattttgccagaacagatactggggtggctcacgctgtgggatcatgagggcctcacagcctggaactgttcctccagggaccccggtggccctgcccacatgatcattctgtagactagttctctgtacaatagaaaagatggctaccagctgccttggctccaggcttacgttttccttcccttgtctccttaagtggatttttgtgcttattttaaactcctggtctgctgccacactgtgtctatgggaatcttctttggaggggaggggttgttgtcttccccatatatttcattattttggcctgttgggtacttgtcctctggaggcgtcagccactttgagtaagggtcagaggccaaggccaagtttgtcagtcctagtgagttacagagaggacagcgtgccccaggcacgactgagtgctactgctctatcagaggacttttctggtcagtttcatttttaaacctgcttagaacaaagcagaattgggcactttcccttgattgtaatctgccaatgctggggtttaagaggaggtggactatggagtgaatgccccagggcagctatccaggtagcacctgcttttcacccatgtctaacagagcaggactttgagcattccctgatattgctccaggaataccagcacctgtggtgtggcctgcttagctgatttctgagggaggggaaactaattgtccaatggccatttgagggagagaggctagagtagagcttatgtatttctctaacctgtgctctcactctacctggtatctacaacctacctctccccacacaccaccaccatcacacacataccagttcaagataacctcccatctcccctgaggtttctcagggtctttgttttttgtttttgtgttttgttagttcctggaatctactaccttgcttctccaggactgattttggcagaaggtgtcatcagcttaagctaactgactatctcattgggaaccggagcccctataaccttacccctcctcattcatatattgtcaaattgataactgcagcagaaagctgtctgtctccaaatgtttgtgtatcagccccagggcagtattctgattggttctattttgagccatgtgtcccttgggaccagcaggagttacctggagaaaggagaatggaagacagatgatctgggtagccaaaacaatgataactgcagtccattccagaatggacactgatggtgcaagctacactttctagcaactctcagtaaatactctgatagaggctgggcgcggtggctcacgcctgtaatcccagcactttaggaggccgaggcaggcggatcacctgaggtcaggagtttgagaccagcctggccaacatggtgaaaccccatctctacaaaaatacaaaaattagctgggcatgatggcgggtgcctgtaatcgcagctacttgggaggctgagacaggaaaatcacttgaacccaggaggtggaggttgcagtgagccgagattgcgccattgcactccagcctgggtgacagagtcagaatccatctcaaaaacaaacaaacaaacaaacaacaacaaactctgatagatagcacagtccagtcaaataccgctagaaccttcaaggttggtttgatactgagtgcccaatatacagcttaacattccctctggcatatgaaatagattagcttcagacatttgtctcacagtaggtatttgagtgctgcccatctctcctctattcaaagaaagagaaacttctggaataatctgaaatacttcacgttctgatataacatgaaaaacctctttatatttggtgcattctcgaaggaacaataaagtatactttataggtagctataaagtacccccaaaaaaggttattctttatgaacctatcagtcatcatttcaatttgtcatggacattggtattatttatactagaggcaggaatgagcttggcagttttgcagtaaaaatggatatttttgctttcttctgtggtgtttgcaatagaatatattattctagcaataaagtattgctagttgtctttgtgttatgtgcagtaggtaaatatagtgattacccaaggctttaataagggtagagttggatttagttaatggttctgctcttttttataaggctgaaatccagagggcagcccagaaaatgtttgctcaaaactgcataaacaaaatagccatgttttcaaagtgaataaatgaggcattaaaaacagtgcttgggaagttgaaaacctttaaagcagcactaacaataccttcctggtcctaaatataactatatccatacacatatgtacgtgtataagagttttgttgtgcacaaaaggggattcttagtagcactattggggatgctgataaatgttcaactagatgataaccacataaagagaacaaattgtatcctctatatatgaactaccttgcaattagaggaagccttttcttatttatggttcaaaaggaatattccccctacccaaaacaaagcctgtaaaactcattatataatcacagctatttttacagaacttgaaaaaatttgaattggaatatcatatatgagaaattaactcagcaccgattcttattattcacaggtaacccacctttttgacaatggagccactgtcttctttgctgttttcatggcagtctggggtaagtgttctataaccataaaacttgagttttcctcatatgccctatgatatattcctttagaagtttcactttggatgtgaaagaaagaagcttgagtaaatggaattagctttcctattagtagaaagttggtaaataatttattgggtttattttaaacgatattgtagaagagagacatgtctgatttctcttaaaccttcaacaatgtcattagcactctgttattagagtagaatttactttctgttggacacagaaataaagcttatggtacaactttagtttaggtcaggggagaactgaaacaccatctcagtatatataggactttctattgtaagtggctaatgtgtgagtacccacctttagctttcttctagctctgtacaaaattacccctaaaaacaaggtctattcacaggactgatttgagctttttgatataatttcaagctaacagccccatcacacaaggtgtgatggaaacagtcaaatatttggaagtaacaggacttgattgaaatctcaactccctttacacactaggctgtgtgatttttggcaagttatttaacctacctctttgtaaaatgggttaatatataatagtcaaataattataaagcttcaatttaatgatatagaaaaacatctcacaaattcatggaaagcagttaatggcagttacctttggaaaggaagattcatggaagagtaagtgaacaacgaggagagacaaactttatgctatatatttttagtctggtttgaattttttacaattatacttttctcctataactttaattgccaaaatctgaattttgatgtaacaaaattctactacctttagacttaggctcatcttgttcattatgtctgctatgaatattggaatcttccccatctttcaggccccagctgaaatgtcatctgctccagccaaaagatgtctttctcctttgaatttccatggcattttgttcttagggcacttaaaattattttcacagataacttgtcttgcctagtagatttatggtccttgaggaccattatgattatcagagatctcatattttttttttttttgagatagatggaatcagtaagtttctgttggatggatgggtgggtcaatggatagataggtggatggatggatggatggatggatggaaggaaagaaggaaaaagagaagaagaaagaaaaagaaattaccaaaagtatttatttatgatacagtgaatgtatttaagaggtcttttttgataagtggaaacataaaaccttgttcacttgagggagcttgttcttgatatattgtgtcttttgtacctagagactgtcaaaggaaaattgtcccacccatcacagctctgttgaagggacatgttttgaaccccatgactccagtccctctcagccagtaagcatttgaaccaagatcagtcaaaccacaggttggtgagtggcctgggaaaaggcctgaggttctgcccagacaaggactggtagggccacccagattcttattctccagaatgtggactagaaaatgtaaagggaaatagggagttagcagcaggaatggacactgaaaaatacagagggcaggagggagggagaaaaagaaagattaaaattgaccattgggtagaagtagggaccaggaggaattaggaggctgaagttatgagaatcagaacctagaaatagatagaagcaaagaactagtggaaaaattagagggcgaaaaagccaactgggagaaaatgtaagacaaccagagggaagcaaagagagaatatagccaagtcatgttactagtggagtgtcaggatgaagacccagactctcttgtggctgaggcctctctcaagcttcgggcttccatatcctgtctctgaacaggccatgtattttttcctgtaggattcctgcctcccttggtggaccttgtgaaaagctttcactgttcatgctacccttaatgcttctctgtcccttgcaaacaaactaaccctaacagaattttgattacaggcctgagctctcagataaagaatgcgtatatagttttactagaatctattagtatcatacaccgtgattcggataagccatataatgcttaagctttgccatggtcacaaatgaggggactctggaaatatattcatttcctaaaccagtattataaatactaaatgtattctgtaaaccttaatgtatatagtattctgtaaacgtaaatactaaatgtatattgtaaacctaaatgtattcatttcctaaacttttcaggtcatagcacacataaaaatgaaaatatttacacagcagctgctgtacatggaggagcctcctcatggccatggatagggctgtcccaaacaccccagcctcagaagccacaagggttgaaaggggcattattgttattcctggcataggcatttggaagttctgccttgggctgctaatttactgtgcaatgagttaatgcttctatataagagtggtatcctggtggtatcctggaagaattaaaacacaaaacttccttacccacttcaatatttcaccaatttcaaatatactttgaattaaataatggtttcttctcacagtttacctcctgagactacatagaagtaaatttttgtatgatgacatttgttcataaggcagaggttattactctcccccactacctccattataaaatggattgcataccctctttgcaagttgtgttttatgttatagatgacaaataggttttgttttatccccttgccaacctcagctgattggtgctggctgcctggagcatggagttgagaagtttctgaggttgaaagtgggtggattggagatttaacagcccttgtggtttggagtatactttgtaagactctgatggatgttttataataaactttgggcacagaggaacattttagggccattccaggcaagacatgcctggaataattcaccctctgaattgctttgtcttagatgacaacttattgcttaaatcccacattattcccagaaatgtgctagtttgagaaaaagaatgagttgccccaagtgtttctttgtagatagagataatgccttttgcagaaatctgaaagagtcaacaatattaacagttatattaatagcattcatttccgagggattactatgtactaaatgcagtcctaagcattgcccatgtatcatctcatttaatctctccagcaagcttttaaaaaggtactgttcttatcctcatatgacagataaggaaactgcagcagtagctagaaagtggcaaagccaagagttaaactgggcagtgtgagctcctctgctctactgctagaatcaggtattgtttgttaccatttccttctgttttagagacctgaaccttaaaataaaggactgctatgcctgtcctgagcctcatttatcctgctttgagacagtaatgttctataaaaatgtgtcagttctaatggagctcagtttaatggtctcaggatcatctcttatgatcgacaagttacagcattaaagaaaacaaatgcactctattttcaggaaattgctagatatggagctgatgagaacagatgtaagtggtttacaagacttctgaagggctgggcttgacgtgttcattttgttacctttgctttgtgtgttcaccggaaaaaaataataaggctccatctgtaaccagtttgtagcaactgggagggccttggcattgggttaggaatcctgacagaactctactacctttgttcaggtcacgtctgtgtgagtgcagggctccctcgggatccctgaggtatgctgtgagcctgggtctcggctggaattacagtgtggctcattcctcaatgctcatttttgttcagaaaggtccaagggtcagaatgattatggactaaataactcctctcccgagggaaaaaatgagtcatcagggaactagatgttggcagagacctgtcggggaaacagattatttccctctgttctgtttctggtttggtttgttttttttctctctctcccccttgtttttcattttttacttctaggattgccaaaagttaagttatccccagtaaacacaccaagcaagatccacaaagctctttaatcaaaatgacaagatggtaattatttagtgtgatcctgttagtaattggtgaatgaagtatgtctcatttaaaaaaataaattttgcaagaatcagccttttgtttctagatatttatgctaactttatattttatagtcttatctacatgttccacaaaaaaatggtaattgtatgttgaaaaaggtacacatttactaaaggcctaccatgtttgtatgcacattcacataggatacctcatcaatttctcatcacccattagaaagaaattactaacctcattttatagatgaggatactgaggctcagagaggttatgcaacttgcccaggattccagtagctgataaggtgtggagcctaaactttaaaccagatctggtctgtttcactccagagtcattccaaagtgtgtccaccatgttgtgcatcttctgtgaagtgtgtcaattaagatctcattaactcatacacaaaaatgagttagatgtgatctctgctttcaaaaatctcagtatattaaagaagcgttgataattataatacagggcaagtccaatttacaataggccaatgagggtttatgtagtcaacttcctgaggcaaaaggaaaagcagaaaaggttcacccaagaagagatattggaaagaagtcttagctttgccaggcagagtagtggggttggaaggagacatagataacattcttaggtgacaagagtatttgtaaagctctgaaaaggaagaattggctgttcagagtgatagggaggttgagtgtgtattagtttcctaggactgctgtaacatagtactacaaactgggtagcttaaaacaatagtttattgcataacagttctggaggctcaaagtccaaaatcaaggtgtcagtgggattctgagggctgtgagggaaggatctgttccatgccagtctcctggattctggtgatggctgatggtccttggccttccttggtttgtagatgcatcactcctatctctgcctctgtcttcacctggcatttgccccgtgtctctgtgtcttcacatggctatcttcttctcaagacggtggtcatattggattaagggcccagcctactccagttatgaccccatcttaactaattacatgtgcactgaccctacttccaaataaggtcacattgtgaggtactgggaccttttttgaggggacacagttcaacccatagcagagtacctgttgaaggctgagagctacttatcacagaccacttgagctacaacagaacatggcttcacgctgtaagcaacagaaagccaactggagttataatccgggaagggacatcatcaattgtatttgggaaataactctggcaacagtgcagggagaggtgaaagtggaggccaactggtggcaggcaggccccttagaaggcattctagtactcagtcaaaatattacgcagaacttggcttcagaaaagatccaatttccagaataaaaaccacacgtgtaaaatgttttcctagctttagttatttataatatgcaaaatttgtgaacaacgtaaatgtccaacaatagaagaacggtttggtaaattataagcagctattataaattgctctttcaaagcatgttgataatacaaagcttgtatttaaatttttttaaagtagggtataaagtatacaagtaaaacacgattttgagtatattaaatgtaaatgaaaacagaaagaaatgatgccataatattaatggtggtttgctttatgtggtgggattgtgggaagatttttttcaactttaagtataatttatgtgcaataaaatccagcaactttaagtgaacaattcaacaaattaggtcaaatatatatagtcatggaagcatcaccataatgatgatatataagagaactttttttcttttttttgagacggagtctcgctctgtcccccaggctggagtgcagtggcacaatctcggctcattgcaagctccgcctcccggcttcacgccattctcctgcgtcagcctctcgagtagctgggattacaggcgcccgccaccacgcccagctaatttttttgtatttttagtagagacggggtttcactgtgttagccagaatggtctggatcttctgaccttgtgatccgcccgccttggcctcccaaagtgtgggagccaccgtgcccggcctaagagaacatttttatcctctcaaaagtttcctcatgcctctgcagtcagtcccttggcaacctgaaacctgctttttaccactgtagtttcagctgttctagaatttcatgcagattaaattattcaatatatagcattttgtgtctggctactttcacttcagttaatgctgttgagattcatttatgctgttgcctgtgtcagtagctggtttctttttagtacagagtagtattccagagcctggctatgtcataatttgttcgtctacttaccagttaatgaatatttgggttcagtatggtttttaactactataaataaacctagaaactattggctcttctagttttttgtttttgtaaattttcataaaagcctttgtagccattcatcttggatgaataattaaaagtggcattgctggatcatgtgataagtgaatgcctaacttagtaagaaattgtttcccaaagtggccatatcgttttgtagtcaatatcagcatgatatgagaattccaggtgttccacattctcacaagcacttggaattgtcagtctttataattttagtcattttagtgggtatatggtattatcccattgcagttttaatttgcatttccctaatgagtagcgatgttgaacatcttttcatgagcttatttgcaatctgcacatcttacttggtgaagtgtttgctcagatcatttgtccatttgttattgggttgtctgtcttatttttaagttaaaagagtacttttatatattctaggtagaaatgcttcatcttacaggtgtttgcaaatttttttccctgtctgagtcttgcatttttattttttaatggtgccttttgaaaaccaagagttttttctttttatatagtctaatttaaattttcttctgcactcattttttgttttatttatgaaatctttgccaaactcaaagtttctaagattttcgtctatattgtcttctaaaaagcttatcgttttagctcatatgtttaggtttatgacttatttcaagttggtttttgtatatggcataacgtaaggggcagatttatttctttccatgtagatatccagttttcctagtaccatttgtcaaaaacgccgttcttttcctttttgaattttcttggtacattttggttgaaatcaatgggccatatatgtatgggtctgttttcagaatttttattatgtttgatgtgtatgtgtacacatggcaataatccactgtcttgattattatggcataataactgttaaaatcatatttttcttttcaaaaattgttttgctgttttaggttctttgcatttccaaaaaaattgtagaatcagcacttaaatttcttcaaaaaaagtgttgatattttgattgggattaagttgaatcaatgtcagtttggaaagattgagtgtcatttagctttttgtttatttacatattctgtaatttctctaagcaatgtcttattattttcaatgtacaaggcttccagatattttgttaaatttatgcctatatattggattttttgagttttttacaaatagtatttttctgtaatttcaattgccagttattcattgctactacatagaaatacaattaacttttgtatattgaccatatatcttgtgacttactaaactcagttattagtgcttctagcttttttatagattccttaatattttcaacatagatgattaagaaatttataaaataaataagttttctttctttctaatctatatgagttttatttctttttcttgccttatactggttaggacctccagaataatgctggatacaagttatgtactagacatccttgccttatgcccagtcttaggggaatgtgtttagtctttcaacattaagtatgatagaaaccacaggttttcatatatgtctgttatcaagttgaaggacattccttctattattaggaactgagggttttaaaaatcatgaatgggtatagaattttgccaaaagcttttcctgtattaactaagacaatcctgtttctttctttcttttatttttttatacttcaagttctgggatacatgtgtggaacgtgcaggtttcttacataggtatacatgtgccatcgtggtttgctgcacccttcaaatcgtcatctacattaggtatttctcctaatgctttccctccccgatccccctatcccccaacaggccccagtgtgtgatggtccctgccctgtgtccatgtgttctcattgttcaactcccacttaggagtgagaacatgcagtgtttggttttctcttcctatgttagtttgctgagaatgatggtttccagcttcatccatgtccctgaaaaggacatgaactcattcttttttatggctgcatagtattccatgttgtgtatgtgccacattttctttattcagtctatcattgatgggcatttgggttggttcgaagtctttgctattgtgaatagtgccacaataaatatacgtgtgcatgtgtctttatagtagaatgatttataatcctttgggtgtatactcagtaatgggattgctgggtcaaatggtatttctggttctagatccttgaggagtcaccacattggtttccacaatgattgaactaatttacactcccaccaaaagtgtaattagtgtaaaagcgttcctatttctccacatcctctccagcatctgttgtttcctgactttttagtgattgccattctaactggcatgagatggtatctcattgtggttttgatttgcatttctctaatgaccagtgatgatgagctttttttcatatgtttgttgcctgtgtaaatgtcttcttttgagaagtttctgttcatatcctttgcccactttttatggggttgtttgtattttcctgtaaagttgtttaagttgcttgtagattctggatattagctctttgtcagatggatagattgcaaaaattttctcccattctataggttgcctgttcactctgatgatagtttccattgctgtgcagaagctctttagtttaattagatcccatttgtctattttggcttttgttgtaattggttttggtgttgtagtcatgaagtctttgcccatgcctatgtcctgaatggtattgcctaggttttcctctaggatttttatggttttaggttttacatttaattttttaaccgatcttgaattaatttttgaataaagtgtaaggaaggggtccaatttcaattttctgcatatggctagccagttttcccaacaccatttattaaatagggaatcctttccccattgctgtttttgtcaggtttatcaaagattagatggttgtagaaatgtggcgttatttctgaggcctctgttctgttccattggtctatatgtctgttttggtaccagtaccatgctgttttggttactgtagccttgtagtatagtttgaagtcaggtagcgtgatgcctccagctttgttctttttgcttaggattgtcttggctatatgggctcttttttggttccatatgaaatttaaagtagtgttttctaattctgtgaagaaagtcagtggtagcttgatgtggatagcattgaatctataaattacttggggaagtatggccattttcacaatattgattcttcctatccataagcatggaatatttttccatttgtttgtgtcctctctcatttccttgagcagtggtttgtaattctccttgaagaggcccttcacatcccttgtaagttgtattcctaggtattttattctctttgtagcaattgtgaatgggagttcattcatgatttggctctctgtttatctgttcttggtgtataagaatgcttgtgatttttgcacattgattttgtatcctgagattttgctaaagttgcttaccagcttaaggagatttggggctgagacgatggggttttataaatatacagtcatgtcatctgcaaatagagacaattcgacttcctcttttcctatttgaataccctttatttctttctcttgcctgattgccctgaccagaactttcaatactgtgttgaataggagtggtgagagagggcattcttattttgtgctggtttttgaagggaatgcttccagcttttgccccttcatatgatattggctgtgggtttgtcataaatagctcttattatattgagatacattccatcaatacctagtttactgagagtttttagcatgaagcggtgttgaattttatcgaaggccttttctgtatctattgagataatcatgtggcttttgtcattggttctgtttttgtgatggattatgtttattaatttgcatatgttgaaccagccttgcatcccagggatgaagccaacttgattgtggtggataagctttttgatgtgctgctggattcagttttccagtatttcattgaggattttcgcatagatgttcatcagtgatattggcctgaaattttctttttttgttgtgtctctgctaggttttggtatcaggatgatctggcctcataaaatgagttagggagaagtccctcattttctattgtttggaatagtttcagaaggaatggtaccatctcctctttttacctgtggtagaattcagctgtgaatccttctggtcctggcctttgtttggttggtaggctattaattactgcctcaatttcagaacttgttattgggctattcaggggttcgacatcttccttcttctttttcttcttcctggtttagccttgggagggtgtatgtgtccaggaatttatccatttcttctagattttctagtttctttgtgtagaggtgtttatagtattctctgatggtagattgtatttctgtgggatcagtggttatatcccctttatcattttttattgtgcctatttgattcttctctcttgtcttctttattagtctggctagtggtctatgtattttttaatcttttttaaaaaacaattcttggattatttgatattttgaagggtttttcatgtctgtctccttcagttctgctctgatcttagtcagccttcttgtcttctgctagcttttgaatgtgttttctcttgcttctctagttcttttaattgtgatgttaggatgtcaattatagatctttcccgctttctcctgtgggcatttagtgctataaatttccctgcaaacactgcttccgcagtttcccagagattctggtacgttgtgcctttgttcccattagtttcaaataacttatttatttctgccttaatttcgttatttacccagtagtcattcaggagcaggttgttcagtttccatgtagttgtgcagctctgagtgagtttcttaatcctgagttctaatttgattgcactgtggtctgaaagactgtttgttatgatttccgttcttttgcatttgctgaggagtgttttacttccaattatgtggtcaattttagaataagtgcaatgtagtgctgagaagaatgtatattctgttgatttgcagtggggagttctgtagatgtctattaggttcgcttggtccagagcagagttcaagttctgaatatctttgttaattttgtgtctcattgatctgtccaatattgacagtggggtattaaatctcccattattattgtgtgggagtctaagtctttttgtaggtctctaagaacttgctttatgaatctgggtgctcctgtattgggtgcatatatatttaggacagttagctcttcttgttgcattgatccctttaccattatgtaatgcgcttctctgtcttttttgacctttgttggtttaggtctgttttatcagagactatgattgcaatccttgctttttttttctttccatttgcttggtaaatattctccatccctttattttgagcgcatgtatgtctttgcatggagatggatctcctgaatacagcacacagatgggtggtcttgactctttatccagtttgccaacctgtgtcttttaattgaggcatttagcccatttacatttaaggataatattgttatgtgtgaatttgatcctatcgttaggatgctagctggttgttttgcctgttagttgaggtagtttcttcatagcgtcaatagtcttgacaatttggtatgtttttgcagtggctggtcccagtttttcctttccatatttagtgcttccttcaggagctcttgtaaggccagcctggtggtgacaaaatctctcagcatttgcttgtctgtaaaggattttatttctcctacgcttacgaagcttagtttggctggatatgaaattcagcgttgaaaattcttttttttaagaatgttgaatattggcccccactctcttctggcttgtagggtttctgcagagagatctgctgttagtctgatgggcttccctttgtgggtaacccaaccctttctctctggctgcccttaacactttttttttttcattttaaccttggtgaatctgacagttatgtgtcttggggttctcttctcaggagtatctttgtagtgttctctgtatttcctgaatttgaatgttggcctgtctttgtaggctggggaagttctcctggataatatcctgaagagtgttttccaacttggttccattctccccatcactttcaggtacaccaatcaaatgtaggtttggttttttcacatagtcccatatttcttgaaggctttgtttgttccttttcattcttttttctctaatcttgtcttcacactttatttcattaagttgatcttcagtctctgatatcctttcttctgcttgatcgactcgactattgatacttgtatatgcttcacaaagttctcatgctgtgtttttcagctccatcaggtcatttatgtcctctaaactggttattctagttagcaattcctctaaccttttttcaaggttcttagcttccttgcattgggttagaacatgctcctttagcttggaggagtttgttattacccaccttctgaagcctacttctgtcaattcgtcaaactcattctccatccagttttgttcccttgctggcaaggagttatgatcctttggaggagaagaggcattctggtttttggaattttcagcctttttgtgctgttttttcctcatcttcgtggatttatctacctttggtctttgatgttggtgatcttcacctggggtttttgagtggacatcctttttgttgatgttgatgctgttcctttctgtttgttcgttttccttctagcagccagacccctctgctgcaggtctgctggagtttgctggaggtctactccagaccctgtttgcctgggtatcagcagtggaggctgcagaacagcaaagattgctgcctattttttcctctggaagcttgagcccagaggggcaccccccaaatgccagctggagctctcctgtatgaggtgtctgtcgacccctgctgggaggtgtctcccagtcaggaggcatgggcatcagggacccacttgaggaggtagtctgtcccttagcagagctcgagcactgtgctgggagatctgctgctctcttcagagctggcaggcaggaacatttacgtctgctgaagctgccccgacagccactgcttcccccaggtgctctgtcccagagaggtgggagttttatctataagcccctgactggggctgctgcctttctttcagggatgccctgcccagggaggaggaatctagagaggcagtctggctatagtggctttgccaagctgcagtgggctccacccagttctaacttcctggcggctttgtttacactgtgaggggaaaattacctactcaagcctcagcaatggcggacacccctccccccaccaagcttgagcatcccaggtcaacttcagactgctatgctggcagcaagaatttcaagcctgtggctcttagcttgctgggctccgtaggggtgggatccgctgagctagactgcttggctccctggcttcagccccctttccaggggagtgaacagctctgtcttgctggcattccaggcaccactggggtatgaaaaataattcctacaactagcttggtgtctgcccaaaaggctgcccagctttgtgcttgaaacccagggccctggtggcacaggcacctgagggaatctcctggtctgcaggttatgaagactatgggaaaagatactaatctgggccagagtgcaccattcctcacagcacagtccctcagggcttctcttggctaggggagggagttccccgaccccttgtgcttcctgggtgagacagtgccctagcctgctttggcttgccctccgtgggctgtacccactgtctaaccagtcccaatgagatgagctgggtacttcatttggaaatgcagaaatcacccaccttttgcactgatcccacagactgaagctgttcctattcagccatcttctgttctcaatcctgtttcttaaaagctggacaatatattaattaaattgattcattatgaaataataggatgatcttgcattccaaggatcccacttcatcataatatattaccttttatgagtgttgcaatatttgatttgctaaaatactttcaggatttttccatctatcttcatgagggttattggcctgtaactttttacttctagtgtctttttgttattgaggtgatgttggcctcataaagtgagttaggaaacgtactttcttctagaaagtagaaatggtgttatttccatcttgaatgtttggtaaattgtaccagtgatgccacctgggcctggagttttctttgcaggaaggcttttaatgcaatcttagtcatttaatggatggaaggttgtccaggttatctttttttttttttttttttttttttttttttttgcctttgaaagagtcaatttgtgaatttattggcataaatttgtttataatattctcttatcttctttctaattcctataggatgtgttatgatatcatattggtcattcctgaaattggtaattaatgtcttctcttttcctgttcattctgtctaaaagtttatcagttctattgatcttttaaagaaccagcttttggttttaatgatgtttttctattgtttttatgtttcatttttcattgatttttgctgttatctttcattttgttcctcatgcttgctttgcatttaattgctcctttttctaatttcttaaggtaaatgcctaattatttatgtgaggtctttctcattttcaaatatgagtttaatgctataaatttcctctaagcactgcttagctatatcccccaaattgtgtttttatttttaatcagtccaaaatattttctaatttcctttgtgagttcttctgtgatctgtgagttactatgtagaagcgtattgtttaattaccaaatgcttgggagattttctaaatttccacttgctgttagtttctaacttcattcaaaggacatagtttgtgtggtttcagttcttttaaatttactgagaaatgttttatgacccacagtatgatatcttggaaaatgttccaagtacatttgaaaagactagtagttccccacatggacacgcggaggggaacatcacacaccagagactgttgatgggtgggaggctagggaagggatagcattaggagaaatgcctaatgtacatgatgggttattgggtgcaacaaaccaccatggcacatgtatacctgtgtaacaaacctgcacattctgcacatgtatcccagaacttaaagtattataataataataataataataataataataataaaagattagtagttcccctttttccacagttttgctttccacagtttcagtgacccactatcaacaacggtccaaaaatattaaatggaaaattccagaaataaacaattcataagttttaaattgtgcacaaatctgagtagcatgatgaaatctcacattgtcctgctccctcccacatgagatgtgaatcattccttgtttggcatatctacaccgttcacactacctgcccattagtcatttcgtagccgtcttggttatcagatactgccactgtatcacagtacttgtattcaagtaacccttattttacttaattatgtcatcgaagtgcaagagtattgatgctggcaatttgggtatgccaaagagaagctgtaaagtgctttgtttaagtgaaaaggtgaaagttctcaacttaataagtaaagaagaaaagaaaaaatcttacactgaagttgctaagatatacaactgtaagatatattcttacagttggtaagaatcttctatgcatgaaattgtgaagaaggaaacagaaatttgtgcaatatatatataaggttcagtagtatctgtggcatcttctgagggtcttggaatgtattacctgtggataaaaggggactagtgtatattctgctgttgttaattatagtgttatctaaatttcattgattattaagagagaagacccaaataaataaaatcagatatgaaaaaggagacattacaactgataccacagaaattcaaataattattagaggatactatgagcaactatatgccaataaattggaaaatctagaagaaatgcacaaattcttagactcatacaacttaccaagattgaaccatgaggaattccaaaatctgaacagaccaataatgagtaacaagatagaagccatactgaaaagtctctcagtaaagaaaagcccaggacccaattgcttcactgctgaattctaccaaacatttaaagaagatctaatagcaatcctacttgaactgttctaaaaaatggaagaggagggaatatttccaaactcattctatgagtccagtattaccctgataccaaaaccagacaaagacacatcaaaaaaagaaaactacaggccaatatctttgattaatattgaatcaaaaatcctcaacaaaatattggcaatcaaaattcaacaatacatgaaaaagatcattcattataaccaggtgggatttattccagagatgcaaggatggttcaacatatgcaagtcaaccagtgtgatacatcatatcaacagaatgaaggatgaaaaccatatgatcatttcaattgatgacaaagaaagaatttgataaagttcaacatttattcatgataaaaaccctcaaaaaactgggtgtagaaggagaatacttcaacataataaaagccacatatgacagaccaacagctagtatcatactgagtggggaaaagtgaaaacacttcctctaaaatctggagcataataaggatgtccgctttcaccactgttattcaacatagtactggaagtcctagctaaagcaatcaaatatgagaaagaaataaatggcacccaaattggaaaggaagacatcaaattatccttgtttacagatgatatgattttatatttggaaaaaacctaaagactccaccaaaaatctattagagctgatacattcagtgaagttgcaggatacaaagtcaacatacaaaaatcagtagcatttctatatgccagcagtgaacaatctgaaaaagaagtcaagaaagtaatcccatttacaatagctacaaatacaatcaaagaactaggaattaaccaaagaagcaaaagatctccacaatgaaaactatagaacactgacgaaagaaatggaagaggctttttctagagatgccctgctgggagagtatccatggctttgcgtccccatcatggccctgcggtcggcggcctcctcctggagcacagcaaggtcaggtggcacctgcttgagtcctgcgttgccatggccacagttcctgagttgctgcagcagcaggaggaggaccacaggaagctgagatctgtatctgtggacctgaatgttgatccctcacttcagattgacatacctgatgcgctcagtgagagagataaggtcaaatttacagtgcacacaaagaccacactgcccacatttcagaatccagagttttctgttacaaggcaacatgaggactttgtgtgactacatgacactcttcatgtaccctagaacttaaagtataacaaaaaaaaaaaaaaaaaaaagaaagaacagaccatgctgggcttattgtgagtgttttagaaaatcaaataagctagttctttctgccttgctattcatttagtttaaagagacttatatccactttttataatggattgtgaaaattttgatttcatctacctactagagtatttgctaactattgggtaagtggaaaatatgtgaaggaatagtgttacagctttgaggtaatgcatacaggcttacattatttatgttgtaaagtggtataaacagtgtaatgactttagtcttatttacctttaggtttggtttttctctggtatgttctttccaatgtcagtagaattgatttctaggaaacattagtattggtaatagtatgtgataagatttctcaaaagtgctgaaggaggccatgcctgtaatcctaacactttgggaagctgaggtggatggattactgagctcaagatttcaagacctgcctaggcaacatcatgagaccttgtctctactaaaaatataagaaattagctgagcatggtggcacatacctgtagtcccagctactggggaggctgaggcatgagaatcacttgaacctgggaggtagaagttgcagtgagccgaggttgcaccacttcactccagcctgggtgacagagtgagactctgtctcccaaaaacaaaaaagtgctcaaggaggcagttttcagcccttgattgttaattcttggctgcaggaacagaggcttagctgattttaaaggagatttccatgcattttgtcctgccatgcagactgaagaatctgtccaaatgacaatttcttaataattgaacaaaattagtactgaagcttatatttagatatgttctgttcattcaaaatcaaagtccttgattatcctttgggattaggaaaaaaatcctttggaatactggagacttcataatcttgatggctaatcattggtgtttagcatttgttgtactagttttaggccaacattgaagcagtatagacactgttgtgctctgaacgattgtctgtaatggataaactgggcaaatgattgccatcaaagtgaatacaggaagatacctccttttaaatggccagaagaaataaggaaggttaagaaaaaacaggagttgacttttaaatagccccataggagtggagtggttgtctcctgtggaccagcaagagtagaacgaggcaccagctagaaaacatcgcttctgggacaagagactcatgagttcctgcctctgctgcagattccgcctgctcctacgaaggctgacttcaatggtccttgagagaagatgcagaaactgggagaaggtaaagggtctttgaccaaagaagaatttgccaagatgaaataagaactggaagctgagtatctcgctgtttttaagaagactgtgtcctcccatgaagcctttctttagtggctttcttctcaccctgttctcagtaaagatcgcaactttcatattttcctggaatatgatcaggatctaagtgttaggtggaaaaatactaaagagatgtttggtggcttcttcaaaagtgtggtgaaagtgctgatgcagtcctttttactggagttaaggaggtagatgacttctttgagcaagagaatgacttccttattaactattagagtaggatcaaagattcttgtgtgaaagctgacaaaatgaccagatctcataaaaatgttgccgatgactatattcacactgcagcctgcttacatagcctggctttagaagagcccacagtcatcaaaaagtatctattgaaggttgctgagctatttgaaaaacttaggaaagtagagggttgaatctcatcagatgaagatttaaagctaacagagctcctccgatactacatgctcaacatcgaagctgctaaggatctcttacacagatgcaccaaagccctcattgactatgaaaaatcaaacaaagctctggataaggcccagtttaaagagcaaagatgtcaagttggctaaggtacactaggaggagtgctgccagaaatttgaatagctttccaaatctgcaaaggaagaactgataaatttcaaacggaagaaagtggcagcatttagaaagaatctaattgaaatgtctgaactggaaataaaacatgcgaggaacagtgtctcccttttgcagagctgtattgacttgttcaagaataactgatatgccttcactctgaagaaaagaaatgaatgtgaaagaaagccaaacatcacttgcacttaaatcattaccagcggaagatttattgtcttcaactttagtttaaaattatgtgaataaatattttgatttctacaaatcttaacatttaaccatgttggtttaaaaatattgttgcttgctatttggacataactaatttttccttgtgcatttaatacctctgggcagaatctaaatactgagttctcctgtagtatgtctttagttactaagagaggatgtaggagacatatgccttctggaaacaagtagaagcaatcatctggcccatgtcctacaaacccatgaatgtcagggaggtgccagttacagcaggtgattcagcaacttgaggcaggtaacagaccttccattcctcactgaaggtggggtttgtgtttttgttttgccccctgttactcccctggtagtcatctggtgtttgtactataacaacagcaagaaaatctcatttgtctttatgtactcttggcacctcctttttttaaatcgagatataaatatttgaggggagaaaagtatctacgggtatatatggaaactgataatgtggtctactttataagatggccagatctacattaggaaaagtatgagctccttccatagtgtctgtgggaggtgatggggggagaggggacagtgtatgtctttggcgtttgtttttttataaagtatataataaaataatcatgctactaaaaaaaagaaattgaagaggacacaaaaaatggaaaaatagtccatgttcatagattggaagaagcaatattgttaagatgcccacactacccaaagcaatctacagattcaatgcaatccctataaaaataccaattatgtgcttcacagaaatagaaaaaataatcctaaaatttatgtggaatcacaaaagactcagaatagccaaagttatactgagcaaaaacaacaaaactggaggaatcacattacctgacctcaaattatactgtagatctatagtaaccaaaaaggccaagtactagcataaaaaaacagacatatagaccaatgggatagaatagagagccccaaaacaaatccacacacttacagtgaactcatttttgacaaagttgccaagaatatacattggggaaaagtcttttcaataaatggtgctaggaaagctggatatccatatgcagaataaagaaactagacccttatctttccgcatatacaaaaattcaaatcaaaatggattaaagacttgaatataaaacctcgaactatgaaactactaaaaaaaagcattggggaactctccaagacatgagactgggcagagatttcttgattaataccctacaagaacagtcaatcaaagcaaaaatggacaaatgggatcacgtcaagttaaaaatcttctacacagcaaaggaaacaacatgaagagacaacccacagaacccacagaaatgggagaaaatatttgtaaactatccgtctgataagggattaataaccagaatatataagcagctcaaactactttgtaggaaaaagacctaataatactgtttaaaaatagccaaaaatttgaatagacatttctcaaaagaagacctacaagtggccaacaggcatatgaaaaggtgctaatatcattgctcatcataggaatacaactcaaaactacaatgagatatcatctctccacagttaaaatggtttttatccaaaagtctggcaacaacaaattctggcagggatgtggagaagagggaacatttctacactgttggtggggatataaattagtacaaccactatgaagaaaagtttcgaggttcctcacagacaaaaatagtgctactgtatgatccagcaatctcattatcaggtatatattcaaaagaaaggaaatcaatatattgaagagatatctgcactcctatgcttgctctagcactgttcacaatagccaagatttggaggcaacctaagtgtccatcagcagatgtataaataaagaaaacgtggcacttatacacaatgaagtactagtcagccattaaaaaaaaaaaaaagagaatgacatcctgtcatttacaacaacatggagggaactggaagtcattatgttaagcgacataagccaggcacagaaagacaaacttcacatgttgttctcacttatttgtgagatccaaaagtgaaaacaattgaactcatggaggtagagaatagaaagatggttaccagaggctgggaaagatagtgtggttgggggtggagggctgaagaggaggggggatggttaatgagtacaaaaagaaatagaatgaataagacgtagtacttgacagcacaacatggggactatagtcaataataatttaattgtactttttaaaataactaaaataatataactggattgtttgtaacacaaaggataaatgcttgaggggatagatactcgattttccatgatgtgattataatgcattgcatgcctgtagcagaatatctcatgtaccccataaatatatacacctactaagtacccacaaaaattaaaaataaaaaaattaaattaaaaaaggtacagcattttaacccttccttggaacctaagctatgcatctgaaaggggagtttttaactgtataagtctgtctaaatgccttagtaacgtgatgaattatagtaactcagtgttttttcctccctatttgcagaatgttaaccattgctatgttttccagaaaaaccctatattagttaggatgagtaaagttagctgctataatacacaaacatcacaacctggtgtttgatagagcccagtcagatgttcctggttggcagatggttttccttatgatctttcatatgggtggatgagttccttccatcttgtggctgcatccccttctggatcttcagcattctctctcttcattcagctaaagtataaagagagcacagggaagatatacctacttcttaactctttgtccaaaaatgacatatatcacttcttactttctattagcctaaacttggtttgtggacacatctgagataaaggctgcaaaaatataatcaaactatgcctaggaggataagaaatcattttggtaaatgcacagcagcctgccacaaatttatttgaaattgataataattgttctatttaagaaaataccataaaaaccctagaagaaaacctaggcaacatcattcaggtcataggcatgggcaaagacttcatgactaaaacaccaaaagcaatggcaacaaaagccaaaattgacaaatgggatctaattaaacaaaagagcttctgcacagcaaaagaaagtaacatcagagtgaacaggcaacctacagaatgggagaaaatttttgcaatctacccatctgacaaagggctaatatccagaatctacaaagaatttaaacaaacttacaagggaaaaaaaaacatcaaaaagtgggcaaaggatatgaatagacactctcaaaagaagacatttatgcagccaacagacacatgaagaaatgctcatcatcactggccatcagaggaatgcaaatcaaaaccacaatgagatatcatcttgcaccagttagaatggtgatcattaaaaagtcaggaaacaacagatgctggagaggatgtggagaaataggaacgcttttacactgttcatgggagtgtaaaccatttcaaccattgtagaagacagtgtggcaattcctcaaggatctagaactggaaataccatttgacccagcaatcccattactgggtatgtacccaaaggattataaatcatgctactgtaaagacacatgcacacatgtttattgcggcactattcacaatagcaaagacttggaaccaacccaaatgatagactggattaagaaaatgtggcacatatacaccatggcatactatgcagccataaaaaaggatgagttcatgtcctttacaaggacatggatgaagctggaaaccatcattctcagcaaactgtcacaaggacagaaaaccaaacaccgcatgttctcactcgtaagtgggtattgaacagtgagaacacttggacacagagcagggaacatcacaccccaaggcatgtcgtggggtggggggcagggagagggatagcgttaggagaaatacctaatgtaaatgacgagttaatgggtgcagcaaaccaacatggcacatgtatacatatgtaacaaatctgcacgttgtgcacatataccctagaacttaaagtataataataataataataataataataataaaagaaaataatagggtgtggcctgaagaacattcagccctgtcccttttgtgtctgtgatgggccttatgagacacccttctcaacggtctgtgattctgaaccaagagtgtcctggtatctgaacactaacctgcctgaacactacccctgatcctacctttacttagagagtggaatcctcagattttcctaatatgtcgactaacgttgtgagaagattgctatttgggattggcattattaacacctcagatgaactttatttgtgggtatgtttttatttttatttttatttgtgggtagattttatttgtggataggtaggtacatggtggaggtgaaggtagaaaatggagcagaaaaagcatgcaaaactctgtcttgtaaatacaattaatcgagtgtcagatgttgtggcttgagagtgtccttttctaagatctgtgagggaaatggtagacaggttgtttcatcttcatgccttcaatgcaatgtcttagtgaccaggtgacttcatctccattaaggtaaaatgcctatgttcattaagataaggttagatcgctgtagcacaaaggcagtggctttgaaaaacacagaaattaatttctatcacatgtataagtatgaagtgagcattccaggctggcagacagctccactccacatggtcactcagggactcatgttcctacaaaagagctgtttcccataaccccagagcctgtcatcactttcacggtctcactgggtcacctgggttctacccgtccagaaggggaaagtggatacggaaaaagcaccccgcaatgttttaagaagtcaacaggcaagtactacacatcatatcacctgtgctcatatttcactgctgagaactatcctttggtcacatctaatgcaagggtatctggaaaatacaatatatgtaggcaaccatattctcagcaacaatcattttattgtggaggaaagcaagaaagaatcttagaggacagtcagtagtctctgccacagggtccatacaaccaaataatgagagtgatagttagaacagaatcacacttttattgcaagacaaaagagaagcataataagcttcaaacgttgatactattattaagttatttaataggccctggtgtgtaaagcattcagaaagtgtagctgcatattcttcaaattcatatcttaatttcttataagcatatgaaaatatttagaaaattaagaatagttttccacatttgctttcattctcaggacagcatttcatttatgcatttatggagcctctctgcgtgccagttgctgtgctagactctgaaggtataaagacaactaagatacagctctgctctcaagaagtccacaaactagtcatagatatgatctgggtttgggtttttattggttttgtttttacagtgctgaatggtgtgattagcgctgacctagagttgtgtgcacaactcagcatgggtgcacagggatgattcagggggcgtagttacagaacacacggggctaaacctgaaagtgagggtaggagttgaccagatggacccaaatagggaaaaacattactcgctaaggaaatggtgtgggcaaactgagaaagtataaaacagctcatgtgtgaaagtgttagtgagttagcctggagtctgaagtgcaagtcagggcagagcgagttgggcttatgagctttgcatcgtgagctgctaacagattttattctataggtgatgtggctccactgattcccaagacacctggttggatctggatttagagaaatcattagcaatgtaaaatgatagattggaatctaaggagttcaaaatgccagcagtaaggctaaacatgctgatgctttagctgagaaaattcttgtggaaagagttccatgtgccaaaagaaaaaaaaaaaaaacacttgacaaaactcttaggaatttcgtcttttgagaacaaagtcataaaagaaatacactttttaatcaaacttatcatagtgccaggtagtataagagaaatatatatatatacacacacacacatacacatatatctttatataaaacataaagatacatatatctttatataaaacaaatatatatatctttatatatatatatataacaaaaatatgtatagcataaaccacctttgaaggagacaagaaagtgtgagctcatgacataagacagtgtataactaggcacactgaaagtgcaggggctcccaaggctgtgagtattcagaggagggagtttaaaccatggcataatgagggattggaactttgccttgaaaagagacaacctgtcttggtttgactacgtttcataggtacaaatagaggcagattcttcttcctcaaatgaatgggcatttcacccaaacataccgacaagggaatggcagttgcacaagcagctaatttcttcttctcttcctattgagtactataatggaagaaaggagaggattattagccaaaaaagggaatattatagtgtgaatatttatgttcccccaaattcatatgttgaaatcctattctttaaggtgaaggtattagtaaggggggcctctggaaagtgattagggcatgagagcaaagccatcatggttggattattgtacttataaaagagaccccagagagctaactacctctcccaccatgtaagggcacagctggcaggtgccatctaagaaccagaaagcaaccctcaccagacaccaaatctgctggtgccttgatcttatatttcccagtctccagaccagtaagaaataaatttctattgtttagaagctacccagtttatggtattttgttacagcagcctgaacagactaacacagggaattaatggttagaatctctgtttcctccaggcaggattcagcaggaatactgaagaagggtgatggaataattgtgacagccactggctcatcttagaagtcagttccctcagatgagaaccatagagggttggtagggcgtagtgagagcagcagctgccagtaagacagactggatgtgaatcctatggcctgaggctgtcccagaatggtcccccatcaagtgtctttatgctcatggaggtacctttgtgatttttatggaaaatagccacatattcaggggctgggccacttgtctcttcaagaacagggagaccctagagaccaaggagggaaagtctttataaagtggcatttgcttgaggggctagaggacctgataaaggaaatatcccagggactctgtgcaaagacagtttggtgaggcagagggcaagcgtgcagcaaagagttaacacagcaggcctgctttagaaaggcctgcttgcaagggtggcccttggctggtgtctgggaacttggctttcaagacagtttccaccaccctgactgctaagggtaactcgtgatgcataaactacatgtgccaacaatacaatttatgctttctccctgaaactctggaattttagtacatgctaagcagctggtgcctatgtgaccagcccccaataaaaaccctgggcactgagtttctaacgagcttgcctgtcaaacagcatttcacatgtgttgtcacagctcattggggaggaattaagtacatcctgtgtgacttcactgggagacgacttggaagcttgtcctgtttcctccctactttgctccatgcaccttttccctttgcagattttgctttatagtgtttcactgtaataaatcttagccatcagtacaactgtattctgtgtcctgtgaatcttcctagtaaatcaaacctggggatggtcttggggattcctgagacagcaagactcactggaaggactccagtagaaaacagctgctcagcattgacacagataagcacatatatttgttttaatttctatcttccagaataagacatttgattattttaggtgtatcttccttaacaactgtaactactcagaatctttcagattttaggaaggcactgaatataccatatattattaaatgccccaggaggcctggggaatacatactaatgtactcaaatacattagtatggctgcttttaatacatgaaaagtctcactaagaagaataaatagaggttatatgtagcctcacatcagtccaggtcagggctcaccaccagatgagtttctgccaaacttaggggaaaaacacttaaaatttttagagcattttgaattttcgcattgcagataagggattgtggacctgtattaccctccttcttttgcttatccggaaattaaggcttagaaaagttaattgatttgccaacagtagcacagcttgtatctgatctggatttcaaatttaggactgtctaggctacatgcccgagaactcttatctatcactctagactgtctttctagctacttattttaagaatatgtcttcagtgtctgcatactactaaggaggaagtaatgtgtgaacaagggagaatagaaaagaagaaagtaattatatttttttgacatggccatttacataatttactttccttcatgaaatggattcctaatatatatttattgttaccttctgtaagtctaactgcatgacaaggcccaaaagagaaatatccacccattctctctcctagggtatgtctgttatatccttatagtcattctcagagtgtgagtgagagagtgtgtgtgtgtctgtatgcatgtgtgtgtgtgtgtgtgtgcccctgtatttgcattttgccttccaaggcagcaggagtgtgtcttattttctctctgtttctcttttattgcataatgctcaataattcatttaagttgatatgctttcattaaattgagtagaaaattaccttggctgaatgaagataactcccagatttctctgcatggggaggccagccacctcgcacttactggagaaagttcttaatagacttacccacttttaccctcattgtggcaacaaagaaatggtttggagaaaagagaaacaacaggactccttccagtaaaacaggaaaatatattttacataggtatttgctgtgaggaggatttgaagggacaggaaatcactatcaaatacatgtgaactgccaagtttcattttgacttttctgctcctacctgcctctcactttaaaaaataagtgcttgcttacccatgtttaggcaatagaaaaaataaaataaaaaaaaataaatgctgtatcaattagatagatgtcggtaacccagttttctgaatcctgacatcccagaatgtaagaatttgtcattctaataagtctgttctgcctcaacttgtaaatcagcttaattcaattctaagtgaaatctctcgtttttcattatgtctgacacaagcttagtaattctcagaaaatagtccttgtgaaatgaagctcagctggaaattctgatattcgatgatgcttacactaacaactgtcattcttggcaatggcttcattattcagtgacacagttaagagccttgttttacttttattcaaaaatgtctttgtctttctctgcttgttccagcaacagttttcctggagttttggaaaagacggcgagcagtaattgcttatgactgggatttgatagactgggaagaagaggaggtttgtatcatttacctcagaatgttgtaaaaagcaaatcacccagaaccacacgacccccccccaaaattgtcactctctgttctgtgacggaagtcaggtgtactcataaagcattttcaattgccttttcagaaaatttcaagcagtataaaaatggactgacaatttttgtaaatttttgattccttagtggaatcaaatcccttgattaagtggagaattccacttgtaggtagaggcaccagaagaattggtggtgtagctttttttttccattttcttaaaaatcatccttttttctctaacttcagcagaaaaagagcattcatttgacatctccaggtacatggaagcaatccttccaagagaattacccaaaggcagtgtgtctgtgagcagcacccaggaccgtgcccaggtgtgcacaggctctgaagtatgacatcaagtgttccgtgctggggacaatccactctgaagcggccaccttgggagacgtggttaaatggagggccagctctagacaaaactgccaaggagggccagactcagcccaccactgtcccttagcgtcttctaggccagtccgttgttctcctcctgacctgtcttgttctaatagtctcttcttgcccctattcctgtcggaagtctgaagtacccacactaggcgtggtcaccacggtcccctcttggaccctgcttcccttgacagttggtccaggcctcagccccactctcctccctctcgttcattatctcttacccctcctgagtctcatttcctcagagccttgctgtgccagtaaatcagataaaccactcatatgtgtaatagttttttgatcatggctattaatatgtgttttccttgaagggaacacatgtatatattttcatgtataaaaaagaatctttcagaaatatgaacgatgtgaattttagccctgtggtaggcttggtgggggaagtaattctgagaggtatttttgttgttgttgtttgtttccttcacactatgcctcctcaatggctgcctgttccccttctcccatgaacatgtttgggtagttttttggtttggtttggtttggttttgaatgtacttcaggtgtacaacaggaggttttgatacatgacactgagattttcagcaatccttgttctcctgataaggctttctttcatgtttttataaatattctccaggccaggtgcggttgctcacacctgtaatcccagcactttgggaggccaaggaaggggtaccacttcaggccaggaggaggatttgaggatagcttatagatggccatcttctccctgtgtcttcaggccaggagttcgagaccagcctggccaatatggtgaaaccccatcactactaaaaacacaaaaattagctgggtgtggtggcatgcagctgtgatcccagctacttgggaggctgaggcacaagaattgcttgaacccagaaggtggaggttgcagtgagccaagattgcaccactgcactccagcctgagtgacagagtgagaccctgtctcaaataaataatgtgtatatatattttttctaggttctagatatatatatatatatattatatatatatatatatacatacacatatacatatatataaatagattttcttcaagtggccaattttcaaacatatatatatatgtgtatatatatctagaacctagaaaaaaaatatacatatatatatgtatgtgagtgtgtgtatgtgtgtgtgtgtgtgtatacatatatattctaggtttgaagaagcttcccaggctgactatgacatctattggtagcagccggactgcattcagaaattcctcttgtgtggtgccattctgctgtttctggttatatgtgttcatgggaacagttcccagtgggatggaaaatattctttcctgggaatcaccttgggcaatttacttcacctttggactttaaaaatctctaatgaaaagaagtgggactaaattttccccttctatctgtaaagtgtggccctatttgagtaactttgactaaaccagtctacaatcattgttggcgtttgtggtgggcccctgatgtgggcacccttctggggaacgtatgtatcccttataagtgtggagccttctgtcttcccagcccctgataaaaagcgtggagtgctgaattgtcctctcactctgcatacctttgtacaggagcctacatacgtagccattcccagcttgggattccttgtggaaatgcctcacttctagcccatgatttctaccttattgtgcagaaaaacccagactcgctgcagaccttctggggcaacctcgcacattagtttgtcagggctgccataacaaagtaccacagactgggtggcttcaacaatagaaacttacatgctcacagttctggaggctagaagtccaagccaaggtgtcagcagggttggttctttctgagaaccatcagggaaggatctgttctaggcatcttttcttggcttatagatggccatcttctccctgtgtcttcacatcgtcttccccctgggtgtctctgtgtccaaatttcctcttcttataaagacaccagtcatattggagtagggtccaccctaatgacctcatttgaacttaattaccactataaaaaaaacctgtttccacatatggtcacattcagtactgcgggttaggacttcagcagatgaatttgggggaagcaagacacaatttggcctataacacccagcgatatggtttggctgtgtccccacccaaatctcatctttagttgtagctcccataatccccatgtgttgggggttggacctggtgggaggtaattgaatcatgggggtgggtttttcctgtgctgttctcatgatagtgaataagtctcttgagatctgatggttttataaaggggacatcccctgcacatggtctctcttgcctgccaccatgtaagatgtgtctttgctcctccttcaccttccaccatgactgtgaggcctccccagccatgtggaactgtccattaaccctctttttctttataacttacccattcttgggtatttcttcatagcagtatgaaaatggacagatacatccaggaacacagacctgtctccatgattggccttagttctcggatgactagctcaagggctcttgatgacacttatggcccaataaattgaaagtttcccaaagaagcagaagattctaggtctgctatgtttatctcctcaagtataactgcctaaaataaatgaaagacagagcctgctcctaatgtatctcctgctgatcttacccatgacctacccctgagggaagtccagccttgggctaattcagtggcaggagccaggctgagccatgtgaaggccatccttcatgctacatgggcaggctgctgccaaactgggctctctctccatgacctctcttctgtcagctcgttccttgctttctgccagtaccttcatccgaatcttgaccatttctgcctggattaactcaatctccatttcagcagagtttctgctcatttgccatcctctcccaacactctcaaacataatgcatgcttaattaacgggaaccacatcaggttcccttgctgattgccttttcctaatctcataattggtttttagtcagaagcttttcacattcaggaggctcagctaaatgaaataaaatctcagtttgatttagaattggaggaaccttgattttaactggttttgaaaggtgcttaccttgttttcaattaagaattaagaatatacctaaagtctattggttaaagatgaatgactcctataggaacttattaaaaagtagattcaccatgtttttagtgaactaaacctaaaaatgcaaaaaaaaattgctggagaaaactaagaattatattgtcattataacttacaaaatggattttgaacattttcctgtagagaagccttctttgtcctggtgtttcttatcactctctggtaataaaagtaaaagcttattagttgttccaaaccattaggacaggacagcttgtcccttttaaaataccattctcagggtggttttttcttcaaggttagttttataagataacagataaatgtaactgttagtccaaatttctttgcttttgatgatagtaaatcttgatcttcactctttagattttcttcaagtggccaattttcaaacatttaagcctgggcacccaaacccacttcattggttgactaattagtgtggcagctgttgactctgttttatggtggggtaaaatgatatttctttttttattgtgtgagcacctctttagtgcattaaaatgtgtctgcttgtcctttaggaagaaatacgaccccagtttgaagccaagtattccaagaaagagcggatgaatccaatttctggaaagccagaaccttatcaagcatttacagataaatgcagcagacttatcgtttctgcatctggaatattttttatggtttgaaacttttaaaaaaatatttgtttcataaaatacaaacctatagcataataacagtaatcatattgggcatttgcattgttctacaaaatatttttgcactttgttatttattcctcacagtaacttcgtctggtggtcagggatggtattgctatccccatattacagatagaacaactgagactccaacaggttatggggcttgcccgaggtcagccagtaggtagctaagagctgagaccctctaatctgatattctttcctcttgccatattctactgtgtgatgctgaaaggagtcaaaaatgtgagacaggatgtacagtagtgtttttcaaacttttcaccatgcccatacagtaagaaatatattctctgtcataaccccgaatatgccaagcaagtagatgtataaaacagtgtaagtaaaacagtgctcacctttataatatgcataagctctgattttgttttattatagtatatttttaatgacagattagcctcctaaaattaatttcctgactcactaatgatcatgtcagtttgaaaaacagacctcagtttttagcttttcctaaaaagcagtcttagtaattaactttaacactgttaattactgaacaaaacatatgcagatgtttctgaaatgtcattttagaacagtaaaggatgattaggatcctcctttccttttttcaaatgatgagtatataaatatatgcctagaccattagagtaggaaggacaagactatagcaaattcagacaggctactccctttttccagtgaagaaactggggagatgaagggctgggcagcttacccagactccttggctcagaccaagattcaaatccatgcctgtctacagatactgcttttaagcaactgtgtcatgctttgccttctatgtacatattcatatttattgtattgtttcttacaaagacccatagacatagattaagcttttcctgttctatggatggggaacttggaacacaggaggctggagctatggaaaggacaagcttgcccaaggtcacactgctgggtgatagctgagctagggctctaatctctcttctgactttgaatccagccagctgtccatcctacctcattgccatccttgtctgaatttcagcatagattttacctgtctcctgatcaacagcactacaattaagatctggacaggtttttgtttattttattgttattttggccagtctgagctaggacttgtacttgagcttttagaacatatctcccttaaaagtaagcagaaaataaattatgtgcaaaacaggaatacttttgtgaagaaaggaatctctaaatcagcagaggccttcctgaggcctggcttcaaggtctagcctttgataattaagtgggttaaggtctctaagacatgttaatattaggtaatcatctaatgaaagtcacaaaactttttggagtctcagatttgcattaaagtcagccctatgtgtctgtgggttctgcatttatgaattcaaccagccacagatggaaattttttttaaaaaaaggttagttgtagctgtactgaacatgtacagctacatgtcattatttcctaaacaatacagtataactatttacataacatttacattgtatcaggtattataagtaatctagagatgatttaaagtatataggaggttgtgtacaggttatatgcaaatactacactattttatagaatggacttgagcatctgtggattttggtatcatggtgttggggggtggttctgggccaatccgtcatgaggatactgagggacaactgcatttcatagagaaagaagatatgctgtattgttctcaaatgccatgaaatcttcagggaaacatgcttcagtctgtgtgaatatcagattaacaagatatgtacctatcacgtagttggttcactcaacagcaaataactgagcacttactatgcatctgtaattatgctaaggtgctgtagaaaccatgtgagcaaaaaagactccttccctgtccttatggagcttactttctagtaggggagcctgagaatagtcaaacagattgttagaaattataagtagtgtcctgaaaaagatgtaaccatatggtatggctaccacatgacaacacgaaaaacaaatagtctgggagtcatgaagaacttttattatgaagtggtgtttgagctgagaagtgaggaaggatgagtaggtgttaactaggctgtgtgtgtgtgtgtgtgtgtgtgtgtgtgtgtgtgtgtgtgtgttcggcaagagattgggtgggtaggtattacaggcaaaggaaatagtcttggcaattaagggtgcttagcccgtttgatgtaatgagagaagctgtggggaccccagagggaaggaagaatggtgcccaaaggggctagagagagggtcttgcaggctgcgtaagggttttgcttttatcctagaataataggaaactaataaacaattttaaaccgaagagtgacatgataggatttccatatgaatatttgtccatctgctcaatgtatattctgcattaaaaagtgttgtcccatagcttacacagattctcaactttcaagcgtgtagttcttttattttaattaaaaaaaatagaaaaaggcaagagaaagtattaaccacaatgaaaagtatgcatttgattgtgatctcttgagcagtactgccatggtgttacttccttttcccatcagaggatgttccaggaatgtgaatcctcttcctgtaacattccaccaagaggttcaccgggtgtcttgtcttcctgccagatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtggtaagtgagctgcagtggctagccaaacggatcaaaatgtgtgggctgcaagtgacagttttcttctgttgctaaggggatctggcctcagagaggtgggccattcacatagcactgatgtcctggcagcgaagtgcctggcatgaagatgcacttgggtctgagtgcttaaaagtcttgattcaaatctagactccgggcttttctgcagtataagattgggcaaagcacataacctctctgaacattagttcccttatttatccaataagattatattgtgaaccccttaagtaaatttagagaaagaatttagaacactcagaacctgtgacacagcattgcaatgttggttcctgtttctttttgattatcaatgataggaagatagacagtatccaaagcattcctggctaggtacaggggctcatgcctataataccagcattttgggatgctgaggccagaggatcgcttgagcccaggagttcaagaccagcctaggtaacatagtgggaccttgtctctacaaaaaaaaaaaaaattaattagctggtcatggtggtgtgcccctgtagtcccagctgctttgtggggctgaggtgggaaggtcacttggttcaggaaagtgaaggcttcagtgagcagtgacagggccactgcactcagcctgggtgacagagggagaccctgtctcaaaaaaacacaaaaacaaacaaaaaccaaagcattccttgatataaccctgcaaggaaaccgccaagctggtacatattgcttttgttgatttccaggctttttcagatagcatatttcagcccagatttctttcctgaatccccaaactcacacgttaaactgcctgcttgaccatctccacctaacactttcaaacccaactcctcatcttccctccagaatcagctcctcccacagccttcctaattgtacttgcccagactaaaagtcgtggcattctactggactcctctatttctctggctgtctaaatgtatccagaatttgatcactttctgcacatcccgaagtcccaccctggtccaagtctgcagtgtctcttgccgagattattgcagcagcttcctaactggtctcccagctttcacattgctcccttcaatctaggctcaacatggaagccagagagagcttcttacatgtaagtcagttcacatggctcctgtgttcacaaggtgtagtggctttcctctctctcacagtaaaagcctgcgaggccacatctacacagtggcctcacgggctttcgctcatctggtctgtgtgacatctctgacctcatcttttcttttactcactgtgattcacctgctccagccgcacttgtccttttgatgctctcaccccaggactttttttatttgctgttctctctgcctggagccttttcctcccacagggtctgcatcgcttagtccctcacctccttccagtctttgttcaaatgtcacttctctagtaaatgcttccctggtcactctgttttaaattgcagcccactcctgctatctgacaatttcccatctgcttgcctgtgttttttctatagcatttatcaccatctaatatgctatatattttacttatttattttgtttatctgccatttcttttggaatgtaggcccataagggcagaagcttttctttattttgtttgtttgtttatttttttttcactgttgttattccctagtgtctggaacagggcctggcacatagtagatgctgtgtaaattgttgttgctattttttgtagaacaaaagtagtgcctgacatggtcggctgctgaggtcaacctatacataaaaatatggccaggcactgtggctcatgcctgtaatcccagcaccccatctctacaaacaaaatttttttttaattagccaggtggcacacctgtagtctcagctacttgggaggctgagatagggggatcacttgagcctaggagttcacgactgcagtgagtcatgattgcaccactgaaccctagcctgggtaacagagcaaggacctgtaaaaaattaaaaaaattttaaaagctgaccttaaaggtttgtagtgtaaataagtaaaacaatgtacatagagtgccaaggacagttgttaggcatggagtagatgttcaattaattatagttcccctatccttatttatactgcgtcttaaatctgggccataatgctgaaatgcttacatctttgaaaaaagattttccaaaggccaactaatttaatactattatccatacaggtttatctatgtagcttatcatttctagttctttaaacaatcctgagttccataaccaataaaacttgagtgattcctaagagaattcaacctacccaataacaaagaacttaatttatgatcactaggttaactagtaatcaatgagctaattaaatgcaggtagctcattattagtattaaaatacataaaacatctttattattttaggaaaaaagtttcaagactcagaagtaataaaaaaaaaagggcagttgctgatcattttgacgtgatgtttgtgcgacagcttagcaagtggagattgaaagtagatggttagcacttcctgtacctcccccttttgaccccccaccaggactcggtctgtgttaactgtggaatacacattgtaggtagagagtgattcctagtgaaattaaccaaacagccataggtgaaatgttttgcatcccattaggatgcaatgaattaatgcctactatattgttatcatctatttcctccaatgtcttaaaatttaatttatacatcttcttaacaaataaatgcctgtgtggcatgggcaaaggcttcatgactaaaacaccaaaagcaatggcaacaaaagccaaaattgacaaatgggatctaattaaactgaagagcttctgcacagcaaaagaaactatcatcagagtgaacaggcaacctacagaatgggagaaaatttttacaatctacccatctgacaaggggctaatatccagaatctacaaagaacttaaataaatttacaagaaaaaaacaaacaaccccatcaaaaagtgagcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggtgatccttaaaaagtcaggaaacaacaggtgctggagaggaggtggagaaataggaaagcttttacactgttgatgggactgtaaactagttcaaccattgtggaagacagtgtggcgattcctcaaggatctagaactagaaataccatttggcccagccatcccattactgggcatatacccaaaggattataaatcatgctgctataaagacacatgcacacatatgtttattgcagcactattcacaatagcaaagacttggaaccaacccaaatctccatcaatggtagactgcattaagaaaatgtggcacatatacaccaaggaatactatgcagccataaaaaaggatgagttcatgtcctttatagggacatggatgaagctggaaaccatcattctgagcaaactatcgcaaggacagaaaaccaaacaccgcatgttctcactcataggtgggaattgaacaataagaacacatggacacagggtggggaacatcacacaccagggcctgccgggggtgtgggtgaggcgggagggatagcattaggagatatacctaatgtaaatgacgagttaacgggtgcagcacaccaacatggcacatgtatatatatgtagcaaacctgcacattgtgcacatgtaccctagaacttaaattaaaaaaaaagaaagaaagaaatgcctatgtacaggaagtgaatctgtaaatacacacttgcccatatgtttcgagcaggtgccagtgttgtcagagtaaaacacttcatttaactggaaatcattgatccagcaatatctatttcaagacacagcctagataagaggaagtaaacaaattcaaaatgaagacgggagcatagggagtggcaaaagtacgtagttgctgatgttacaaagcacctgctatatgctgggagctaggctgctaggcattttacatcttttgtctcccagagtgttttagactagccaacatggatgaggtagagttcacactcgaaagctaacacatattattcttagggatgcccttgtggtttttcatttattttagatataacatgaacatctttggtactctgattttcagccaacatcaaactagaataacataaggttgctaacgcaagaatactgatgagaacagggaatgacaagccatagcaaagagagggaaagaaaagaaaaaatgtacataagaactctaaaagcagcatcaaccaggacctctttgtgcaggggccagttatcttaccctcctcagctatctgtgatgatgtctcatccccgcacacacatttacactcctgtcccctgaggttttgtgggtaccattatgagggcaaccaaatgtgtaatatagttggaatggtttcatcagaacatcttaaaaaaattttaagtcgtttctatcagcataagggatgacagactaaaggttgtaatatagctttgaccagttcagaagtaaactctccagtggcttctgaaattactcaatgtgagatattatcgtgacccaatatagattttttacagctgtctattgttttcaactacttaacatattgaccatacttttcttccaaaggtaatcattatttagacattaattattaataatttttatcaactaaatataaaaaccttgagagctagattaaagactctgattttttaataattattataaatcacatatcccatttctgactttttgctagatttgtccagtgctaactaaaataactaaaatatttttatatagtatttactttaaaatttatattatttttacaaaagccctctaggtcctaatgaaatattatgcctcttaatggctggttaaggggcacttagtagttcacattttattccgtgtcttgaaaaataaatatttcaaagatagagtgaatagaagtgaataggatggaatttcttgttcccgatcatattgtctcaattctgttctgcttcactagtgaccgaaaaacatcccaatatggtggttgcaagccaaataggccaacaaaggctatatcccaggaatagactaaaaagttattatcatcctttttatccagccatgccaatctgaatcagatatttaattatactataaacacatctcatcttccaaaaaaaaaaaagtaaaagtacaccagataatatagcttgcatcagagcaagtccacatttattgatcagcctggcaagataaaagtagaagtacacacagcttccttttggacatatctgtaagatcagaaagctttctgccggttacagatattcacaatgagaatttgcagcatccagtttggaaacttagattttccactgctcttagcagaacaaacttcccgtggtttatctctcaaccgtctaatgagaaatcagacatttttccagaaaccactcatgtggagatctctgagcggctgtgagtccctctgtgtgtgtgcccttccctcctgcatcctgtccaatgtctcacagtccatatccttatatgtatatccttcagcatatatatgaagtagtcacagatgccatggatccctactgtgtccctgtatgctttaccttatttttcacaaggttaatattactcatatgttgactcttatgttgttcctttttttaaaattacaatgttttcagtgttcacacccatgtaacaaaggcatatcctcagctccgagggccttttagacaagtgtgcaaagtgaggtactgtgacctacacatcattgtgaaagacataaaagataaaccagttaatcaagaattgtatttttgagaaaggttgtctcatcagtcaaattaattttccctgataattacataattaaataattgtaatgttataatgccttcgtaatacattgtaatattaaaatatatttgattagaacatctgttcttatctgttgtttactaggattttgtttttatgatcaaatgggtatgactaacctatgtcacaaggtttcttatggaaaatgacaccaatctccattaccactggactccaagagtctgagatttctagacataagatttgttcctatgccatattaatatatcctaatatagcaaaccataattgttgctgaaagtttggagtcatacatacagattatgttgtttatttctgtaattagcagaaatctcagataagagaattcaaaaattaagcaggacaggaaggtcagtaagttcaatacccatcctgcccacatataaagaaaaggatggtctgaagaagagataaggaacttgccaaagtcctgtagcttgctggatggtcaagctgtaattccagcctgggcaattttaaccagtgtgtttttactactttcatctaaatgtgttcttaatcttcatattgttccagtctattaaactacttttccttttcattttcacttaccgtcttttgttttagaaacagcacttgatgtttcaattatacccactctggggaatttcctagagctggatttaccctagactatactctctgctccttggtacacacacgcacacacaaacacacatacacacatgcatacatgtaccccaccctcagaaccatctattgaccagatggctgggtgagttaaggatgcgtgagttaaggaggcatcgggtccaccaatggaaaagtggagtaccataagctctgggaatttccagtaatgtttaatcacttcagtgcttttgaatgctgtaatctagagtttacagcagtccataaagaataggattgcaggatcttaccatcagaagcgggcttagagattttacgttcaagatgcagaggttcagcaatattatgactacccagcactgcctagaaagctggtaatgaatagcagctagccttgttgccataaaattattcgccccaaaataagaagtgagattttataaatagttagataggaccttgtacatttctttcttgccctgaaaattacgctaatctccattaccaatggactccaagagtctgagatttctatacacaatgttttcattggttgagcaatggatgcttaatgaaattattttgactcgtgatttgactccctatttcctttgtgattatagattttataatacgtgcagttcatttattaaatgcatgaaatttattttacagctctatgaaaaagttgccctgcttctgacgaatttaggtgagtggaatcctttctatttcatagaactgtactgtgggctagagagtatggttcaaagattcctttctctaatactgctggaaagaaatagtccctttattttaaaattcatacaacaagttttttctttgccttcaacagaataatttaaatatgtctagtaatttttctatataaatctttaaaatctgtcacaaacattatctgtcatgagctaatgtaatttaaggtagattttctcttcatgcacaaaaaatagcattacaaaagtacatttgtataaagtatccagtataatttaggaaagtgttcatttgctattgcctataatttttgtttaattaaaaatgtatcaagtttttatggtatataaactcacagcaaagttagtttctttgaagactggaaggccaggcatggtggctcacatctgtaatcccagcactttgggaagctttggcaggaggattccttgagtccaggagttcaagaccagcctggataaaataacaagaccctgtctctacaaaaaaattaaaaaattagccaggcatggtggcatgtacctgtagtctcagctactccagaggctgaggcaggaggattgcctgagcccaggaggtcaaggctgcagtgagtcatgatcatgccactgcactccagaacaatctggtaaccagtaataacttgtacatttatcacattttcaaaataaagaaattgtcccaattttattaacaaggtattggtcattgtgctccatgcagtttgagaaaattacatgctcccgtccacaacttgctttaatgcattccataagaagcttgtccagaggagaaaaaactcacaaaagtgttcctatttttattcatcattctgacaacagatagcatttactgaaactttctatgagctggatacagagctaggcactttaccttatctcttttaatgtcattgaaatcttccatcaccaccagttcttgcccaaaaagatagaagaggtttatgtccatggaagaggtaactgcccattggtagacaatgtaccctgtggtagcttgatccaggctagcagaaatgccattggaggtacagtcctggtccatccacggtggggacacctgggaacctagctggtgaccaggagacctttccatgtaaccaggagttcagtagcagaagtgaaaccctttaagaaaaccctttaagaatcctgtgtctttttggccctccgcaacagtatggccttgtcctaaaactgacattttaaaccattttaaatcagatttactttcattctcccttcccttctcagacatgctccctaaaagcattttgagttataatttgtggaaatgaattgattaaatgaagtattaaatgagaaatcagacactcagggaatgtggaagcagacaaaatgctactgtattaaatacatttcattagacattgcttgctcatagaatgtagctcctgtgaaaggataaattcattcgacatgagatctctagctggagatttgatcttaagggcaaatggatccatgttttggttcacaccattatgtccagagaacatttgctttatggaagttgaaatatatggagatgagattggcccctgactgaggtcaggaaattataagacacagatggtgatatgaattaaaacctctaaagatgatgccacctccttgatatttgtccatgagaatggaaaatgggggataagggtaaaagcaaatgagtcaaatgctcttagccttctatgataggcatttgactccctcttaagcagtaggttggtataatatgagaactagaagttgagaccaaggaactctttggagctgggaggaactaagcctgcatagattaagaggaaaagaaaaggctactgcagagagccacgactgggaatgaggcctcgacagcctggctgtctatgctgctggctctccaggtatcctgtaagagtggaacagtctaggtattcaattctatcagattcttccatagccacttctcatgagacccttgttgggtctggtctgtgagcttgaggatcctatgagtggtctgttccaccacacgccatccgtgggtaaactggagtctcctgcagcctcctcaggactcctgcgtccccaccctgtgtgtgtggggagggaaagagagggagttgagaggggatgagattcagcctttcaaactctgctcaccttttgtccacagaacagcctcgcacagagtctgagtgggagaacagcttcaccctgaaaatgtttctttttcagtttgtcaatctgaacagctccacattttacatcgcattcttcctcggaaggtaagaacctgacccctgcacacctccccaagctgaggacagaacacttagaaggcactgactcgtggggacagagaagccctcccttagggtgatttatacaaagtgtaaaaagggaagagcatcctcctcccttctcttcccaaatctcaaaaccacctggcatcccagggaaatcatctccactcaaaactgtctgtgcaccttttgttgctaagataagcagaggaaaatagtttgtgcatgtgagtgatgcattgaaaacttctggcctctgtctgcacctgaatcaggcccctggctttcccacctatgacggcaggtggtacaacggggagggggctgtagcatgtcctggattcctgacttcacttaaaagggaaggacatcctgacaggaaagggggcaaaaatgggatacagaggatgctgggtaacttttaaatccagcagttatgaggatttgggaaagattccctgggtagtggtaatgtcgcatgaattcccttacatctggaggcatttcagaggagatgggaacctgggaaggaccaggtatagggttttggtgagatcaacacagcagtctctccttcatttctagctattccagcagcacaaaattctaggcaaatagttcaataatttttttaacagcatgactattactcagaaaaatcaaatgtgtttaaatccaggagtaaaacttctgcttacacaggtcagagcaattgatatgcagcagaaaatgttgaaagtccacagcaagcagcaagaactggcttctgctttaggcagcctgacagaaaggccagaagagacatgtgccctggagaattccagaagctatggttatgacagatctggagggtttcctaattcccccagacctactacttatagtagcagtcattcacattggagaatgtgctaaactaaatgtaatattcgctgaaagcttggacctagagcactaatggcttgtttttctctgtgtgttgaagatttacaggacacccaggtgcctacttgaggctgataaacaggtggagactagaagaggtctgtattctcccatcattccttgtttccgacagacttgcattaaacagccttagggcaactttgtgtagattataaaccagacaccctttcttcctctccattgattctggaatttctgtgtttgcttaccttgcagtgccaccctagtggatgccttattgatctgtgtatgcaaatgggtattataatggtgctaaagcagacctggaataatttcatggaacttggctacccgtaagtaccttagtatcaataattgagaggcagcattgctcattattggcttttctaggtgtggcaagtaagataagcaatgcagactcagcagttaagccagtgcgtgcacctggaactaagtgctcacatttagacatccaaaggcagccatgaaaatcataaacattggctcttctgggagatttagcacaattcacatgaacaaacgtgaatattctttaaggagactctttaggcccctaaatattggatacttgcttgtgagccactttaaatacctctgacctttcgggctccagcattgcaagtccttagctatgtatgacacattaactacatctccactctcccatcctcatggtaaggctggtgataagatgttgacaacaatgagcaaaaccttgcatcaacttggtaaggatgaccttgaattctgctgtgtttgctcagttatggtcagttaagttttaatggggacataaatcaacaatgcttctattctgctttaattccacacctattggtttccatgtcagctcaatgtctctgtagagacaaagaaaactcaaggtttcagggaggaccactcagccagaacgattagtgggaacttggttcacttcagaaaatcttttcttagctctctgtcagaaccaaagccagtaattttctgttcttagatttatttttagaaatcttgttccaagtatttgatgttttctataaaacttttaaaaaataaaacattaaacaaaaattatcagtgttgtattctactttaagatataaatcacaattaaaatgtcatagacatcaagagaattatattttatcttctgataataaggacatagagcaaaattgtaaagtaggcagtttgtctttgatgttcattcctttatttgcttcatttcccatgtgttttgttttttggcccttctactcctggatatccttcaactttttccttgtcctgtacagaacacagacctgcctccaatctgtcatttcctcaatgctttctcatattacaaaatgcactcctgaacactgctaagggttcctgtgctaaccttaccaatgccgggtgcattttactgggagtcagagtccctgtggagagctcatgccaaaagcaaacaagtccagttgtagaactgcaggtgtttgtgtgccaagagaggaagcattttgtgggtttgcagatctttaggcccctgatgtcagagtatacagctcagcacccatgtagcaagactgctcaagggtcctaaatcaagccacttaagccagatattcctcaagatatcttggtgttgcctttgtactggggtatccatttatagatattctcagtcctctattcaaccctcataggcaatgcccaacatgagacagtttcatgaatgattaaaacaagttcatcaatcattctgtttacttgcaaatataaatacttgaagtatagactccattgttattttcttcctaacctgaggctttatttctttgatagcctgtcctgaattttttcaaactattgtttctgtattcaaactctcctttttcttattacctaagtcatatgatcagttacattttttgtaagaaattgatctttttgcccaggttaattcagaattggtggactagaagaaaagtacgacaagaacatggacctgaaaggaaaataagtttcccacaatgggaaaaggactataaccttcagccgatgaatgcctatggactcttcgatgaatacttagaaatgagtatggaaatattctactttatcttattaattataaattttagatctccaggtatattcaactaaacatatacccgttatcatcaaggtcctcagtgcgtagggattcctaaggcaaacagagaggaaggcatgtcctgcttaaactgtgctacacttacatttaaggaatcagatttctctggaatcaaaccgaagctatttctcttagcacgtatctaagaccatgggctttggaagtaaattatctgggttcaaatcccagccctatcatttattaacggtgaaactttgggcaattacttaatctctctttgtctcagtttcctcatctctaaagtgggaataataataagaggaaccatttcataaagtctttgtgtggattaaatgagttaatgcatgaacatgacttagagcaatgcctagctcactatgtacttggtacatgttacttatatcattattattctcttattctttttgtcttctggagggaaaggcaaataaaatatcttagataaattaagtatgaatatattttctttcattattaaattgaatatgtatatatttcctttcattttaagctctaacataggagtggaaatgagggaagggctgggcaagaaccatttcttctaaaggtagcagttctttctggtcaaattagaaatttaaaggaatagtagaattgatgcttaatgtttcttaaattgcttatgttctaagtatctacttatgtctttagagtttcaattatagaatggaagaatgatataacctagggaagaaatcaatttggacattaaaaataaaacttaataaagagaattcattaagagaactaaccactttgagatccttaatggattcttctcccataaagaagacaatgaacaataatgttggtatattgagtgcttaaaaagaaccttttatgtggctagaatttggtagtgctccaaatcctgaagtatctttgcaacacaaaacaaatctcagaagtatcacaagcagactgatgagttctaactgctcacttctgttcttttgtttttgctattttcttaataacttccccactttgttatgtactttaaaatgtattcactgaagtataatagtggaaaagtgtatataagtgtagagaccaatgagtttttgcaaatttacacacaaatgtaaccaaatatatgtagatgagaggttggcaaactattgcctgcaggtcagattcagcccactgcctgtttttgtaaataaagttttattggaacacagcaactcccatttatttacatattatttgtggctgctttggcactgcaacagtagagttgggtagttgtgtcagaaagtggctggtctgcaaagccttctttatttctagaaaatgttgctacccagtgagctagatcaagaaatagaatattatcaatatcaaagaagacttctttgtcccctcttccatttataacaccctctctaaccactttcctgacttctaacaccatagattaactttacctttgttattctccatttaaatgtaattgtagagtacataccctttgtagttggcttgtttcattcaacatcatctttctaacattctcccattttgctacaggtagtagaacttcattttattgctgtatagtattcctagaatgtagaccaggagccaaattatgaaacaggagtttgtctttgacacccaccctcatctttccttagtcatgtgggtttttctgtttgtttgttttgttttgtttgcatttccactcccagatgagccccaactttgtcccctgctgccctgacacagcacacagacccctataccaccatcaatccctcaaccctccacatatcatgaaatgtactcctgagcactctaaataataatatgctaggtaactgcattttaacaaaagcaaagcctctgccaagcttgagtcaggaaaaaaaaaaaggcaaattcacttgtagaagtgaagacatcagtgagccaaaagatgagctattttgtgagtttgcagatcttctaggctcctgaataataatgtactgttattgaccaggcgtggtggctcacacctgtaatcctagcactttgggaggccaaggcaggtggatcacctgaggtcacgagttcaagaccagcctggccaatgtggtgaaacgccgtctgtactgaaagatacaaaaattagctgggcgcagtggcaggcgtgtgtaatcccagctacttgggaagctgaggcaggagaattgcctgaacctgggaggcagaggttgcagtgagccaagattgcaccattgcactccagcctgggagagagagcaaaactccgtctcaaaaaaaaaagaatgtactattatttatccatccattctactgctgatagacacttgtgttgtttccaaatttaggctcttataaataatacctttacggcatttttgtacatgtattttgattaacatacgtagatgtttttattaagaatttacataagagtggagttaggaggccatagatatgcatttgtttgtctttaataaacacttgaaaacagtcttcaaaactgggctgtgccagtttatactctggctaatagtagaacagttccagttattccacaaacttactaaaacttgcgttcgtattttagccatttgggttggtatgcagcagtatctcatcatgattttaacttgaaattttatgataactaataatgctgagcaccttttcatatgcttatagttatttggataaacttgtgaatttatattcaagcccatgttttttttgtgggtatctgtcttttccttagggatttgttatttatatattctggatatcaattatttgtcagatatatatgttgaaaattaaatatcacttctcagtggttggcttgacttctcattctaatggtgtgtttaaatgaaaagaaatttcagcttcattcttcttcaaaattgttgccatataagttttagaaccagatttctaatttctataaaaatcttactgaaatattagttgggattaaattgaactcctacatcaatttgaagatatttgatgtttccccagtccatgaaaatggtatacctttgcatttatttatgtctttttacatttttctcagcaatactttttgtagattttagtatataggttttgtaaaatttagattagagttgtttctaggcaccttaggaatctttgtgcaactgcaaatgatgtttttattgttttattttctaatgttttgttactaataatatacagaaatattgttgttttgtatgtttgcttatgcaaacttgctagcatctaatgtcaattagagttgcttatatattttttgagattttctaccatatatacataattgtatcatccacatataatgataactttacattttcctttttagtcattttatatatatatatatatatatatatatatatatatatatatatatatctttttgttcttgcctaaatgcactaagaccttttatataatgctggataaaattgatgatactggacatcattgtttctgacctgagggtgaaagtgttcaatatgttaccattaagtgtggtgctagctgtattgttttgtacatactttttattatttccttaaagaagttttcatatatccctaggttgctgagagttattatcatgactagtattacattatatcatgtcatttttctgaatctattgaaatgattatgtgattttttaaaaaattttactaatgtggtggatttcattgattattttttgttgttaaaaagttgttaaactaacctagcaaacttggaaaaaatgcccacttgggtcaccatgcatttttttaattactaagttcaatttgctgatattttgcttatgatatttatatatacattcatggaagatattatagtgtagtttttctttcttgtaacgtttcatttagatttgggtatcatttttatgatagccctttaaaatgattgggtaattatttttctcttaagcagtttacataagattactattatttctttcttacatacttggaagaatttacaatgaagtagcaggacttgaaattttcttcacaggaagaactttaattatagatttattttacttaatagatataggactatttcatttttttgtttcttctagcatctgttttcataagctgtgttttagtcatgtattttttcaagaaacttgttcatttcatctaaattttcaaacttagcagcgtaaaattgtttatatatctccttattaactttttatgtatctagggtgtatagtgatgccctttctttcacttataatttcatagtttgtgcttttctcccttttttaaaacagtaccttagaggtttattaatcttttcaaaagaaaaactaactttggtctttgttgatttttctctactacacatttgccttttggttcattcatttctgctcttatctttatttccctcctttacttcctttgggcttaatttcactttttttctcagcatctcaagatgctgattttcagattttctttttttctaatataggcattcagagctataatgttctctataaatactgctttggctgtatcccacaagtttttatatattgattttattagcaaaacattttccatttcccttgtaatttattttcgactatgcattttgaaggaatgcattagtatcaaaacatctaaagagttttgatatattgctctgtcattgattctaatttaattacactgttatcagagtatattctctacgttatttcaggcttttgataatatatatatgtgtgtgtgtgtgtgtgtgtgtatgtatgtgtgtatatatatatatatatatatatatatatatatatatatatataaataaaaagatttaccttatgctcctttataccatctatgttgatatatgtttcaagtatgttctgcatttagttgtttggtataatggtctacatttttatgtcaattaggcaagattggttaattgtgtttttcaaatcttctaagtccttgttaaatattgtgcctcttatctactagttacatacttgaaatccccaagtatgattgtggatttgtcttattctatttttagttcagtcaacttttgctttatgtattttgaaactgggttattatgtacatacaagttggattattctgacttactgttgaattggtgtttttatcattatgtaaagtaattattgaataatgcaacactttgaggatatgatgggcaggaggctgaagagctaaccttaaaacctttcaaagggcagaagtgagcctcttattgcctctcagagctaaggagatagggacccagcagtttctcaatcacagcaaaggaacaagaacaaatcaaaggtggagtaagctttacaaacactctatgccagcactagcccagcttaatctgtgaccagctttaagtgatttctcttatctgcctaacatcaccaggaggaattctttctttatggtagaaaagaacatcactgaaagcggagtatcacaaatttgttcctaaagaactagatagtaaataattttggctttttgagccaatggcaaaatcaaggctattttgtagacacttttacagccatttaaaatatagccatttaaaatgtaaaaactattcttagctcacagatggttaaaaaagaaaatcagatggttggtcaaatttggccacaggccatagtttgctgacccttgatctagagcctctacatgtgtggcatacaataaaaagattactaggtatgcaaaaaggcaagaaaatgtgactaataatcaagaggaaaaaggagacccaaagatgattcagaaattgggtttagcacacagagactttcaaatagctatgatttacgtataaaaatagaagaaaatactgacaaaaatgattgaaaaattaagacttttgaaagagaattaaaatctataaaataactctagaattgcaaaatataaatctggaattaagaactcatttgatatgtttaatagcagattgaggctgggtacggtggcccacgcctgtcatcccagcactttgggaggccaaggttggtggatcacctgaggtcaggagttcgagaccaacatggcgaaatcctgtctgtactaaaaatacaaaaattagcttggtggtgcgtgcctgtaatcctagctgctctggaggctgatgcagagaatcagttgaactgaggaagtggaggttgcagtgagctgagatcatgccactgcactccagcctgggcgacaagagcgaaactctgtctcaaaaaaaagaaaaagaaaaatgagcagattgacttagcgtaagacagtaaattagtgaacttgaagacaagtcaataaaaagaaaatccaaacaagcccagagaaaagaacagaaaaacagagcagaaaacataagaaacatgcaaaacagccaaaaaggctgaaatatttgtaagagaagtcctagaaagaattaaagaatgagaaaaagtgatatttgaagatgtaatgtctgagaaagggtaaattaaaaggaggtaaacttatatattagaatataaaacagttaaaagttgaactaggtctatatagatcaagataatatctcaaaattatcatgtgatatgaacagggcaaaaaaattgtaaataatgatattatgtaaagtttaggcacaaaaattatttacatgatatatgcactatgtataatttattgatatatggatattcatgtgtgtgtgtgtgtatatatatatatatatatataaatgaactggaaggatgcatgcaaaactcatgtcagcaattgtctctatgaagggagaggaaaccactcaagagcaaaaatagaggagaattcagttttatctatatagtatttattttatttataaaaagatattaagcaggtatgacaaaatgttaccaagagttaatactaactcttccatgggtatatggaagtttgttatatcattctttatgctttccaatatttaaaagttttttcccaaagaatttttaaaaattaatctacctctatgctacaagtctcttcccttgaaaaaaaaaagcagcagttaatgggcattaatcacttcaagaccaatatcatgtgggtcacctttgtgctatgtaaaaatgattggttggtttggttttaggccataatatttaactagataatgaaactcattaggtgtcagataaacaaaaactaccaatgaattaaacacattttctttttaaacttgcagttattttcattataaatataacctgaaagaactaaactctagttgctttttctgtccataacatccattactgttagtgattgtaagaattatctctgtcagttttatttctacctgataggttttctttgtgttctggccttcgttgtaattacatgtcagtcattgaaccagcattatttggtacctgacaagtccttcccatacacaaaacccctgtagtgagtatgtaggaaaaagaaacataaagaagttgctgtttctactttcatgaagctcactgcaaaaggggaaaaaggcaaaacgccgtaaaatcaagacaaagtaagttttatggtggtgagcagagttgtggcagctacagaggaggtagtagttaattacaattatgaaagactcaagagggtatatttgagtactcttgaaggtagaatgactacttcatcaaagtagtcatagcaacactgcatatatgctgtatccccataaaatcagaagactagtgtggccagagtagaggattgtttgggaaacctgttttctgtgtggggtgtatttggacatgaggcttggaagtttgcttggagtcaatttattgagatccttgaatggcatggtgaagtttcggatttattctgcagccagtgagaacctactgaaacattttgtgtagggagatgagtgatggggttgaaccaacattttaggcacactgacagcagaatgatagggaagggagctgaaagtttggaggcaaaaaagtcagttagaaaatcagagtctgaactcaagtggggacagtggagaggagggagaaatgagagacatttttgaagagtaattgtcaggactaggaggctaatggttctgaaggctaagctagcagagacctggtttttatgcaagttgattcagaagggaggaaacgagaagggacataaaaggataaatacgttcaaggatgaggttcagagattggtttggggagtgctgtttctgtagcattacagacaactggaaattccctgaaaagagtcagggttagcgatagagaattgagaacccttatcagagagataataatgaagtcataggagtagatggacttaccaaggaaagagagaaggcaggagaaaaataaaaccaaggttgaaacagaagggaacgcccacatctatttgtgggtaaagagccacctagcacaagcactaagtgtgaatgtgaccaaagacaggggacacctggaggtggcagtgtaaccaagatgaggtagatggactctgcagaactctggagctacaacgctgggattagagtcctttcttacttaacttgttttgggcaagttacctgacctctttgtgcgtcggtttccttacctgtaaaatgaggataatagtagtacccaccacctaaggttgtcatgaaaattaaatgagttagtgtatatgaagtaattagaacaatgcctgtttttacatagaaaatgctatatatgtgtagtcattgttttgttgttgttactttctaaaataaagtttgtaaatatattttttactatttttacagtcatatatgtatatatacatagtcattcaaacagccaaatactttttgtccatgatgcccagtaaattttatttttttattttccattatgatgactggttgttttgcatcagaaaccacctccttttgaaaaaatttttattttgcaagttgcaaaaagagtagtttctataccttacttttgctaatgttaacatcttacatatttattaaaacaagaaaagttaagaatacaatgctattgtctaatccacagaccttatttgaattttgcattttcccagtaataacttttttcttgttcacaatacttccaagatccagcattgcatttagatatgttgtctccttagtttcttttaatcaatgacaattcctcagtctgtctttgtttttcatgatcttgacatatttgcagagtatttgtcagtagttttggaaaagctccttcaattcaggtttgtctcgtgcgtttgcacaattgggttggggttattcatttttggcaagaataccacttaagtgatgttataccctcctcagtgcatcatatcggggtgtgtaacatcattatgtcttgttactggtgatatttactttgatcacttggttaaaattatgttttcggctgggcacggtgactcacacttgtaatcccagcattttgggaggccaaggcaggcggatcacaaggtcaggagtttgataccagcctggtcaacacagtgaaactctgtctctactaaaaatacaaacattagctggttgtgatggcgggcgcctgtaatcccagctactcaggaggctgaggcaggagaatcacttgaacccaggaggcggaggttgcagtgagccgagatcgtgctgctacactccagcctgggggacagagctagactctgtctcaaaaaaaaacaaaaaacaaaacaaacaaaaaagatgttttccaggttcctctgctaaaaagtttctgttttgtaattagtaaaagttatgtgaggagatactctgagaatctacaaatatcctagtttcttcaatacacttccccctactaattttagcattctttgatatttcttgcctacaaaaattattactgtgatgtttgactaatggtgattttttaattttcatagttcctcctatgttgattaattagaattctaccataaggaagagccaccccttatctcccatttatttatttaatcacttatttacgtaagtatatatttacatcagtctggacttagatacttagtctttgggtcataatcccatgctttcattattaatattctttcatacaaattgttccagatttggccgttaggggtgccttcaagtttgttctgtgtcctattggcatgtccccatcatttgttgagcatttccttcctttctggcatcacaagatgtcccaggcttctcttgtattgtccctaccgtagctctggaatcaaaccatcctccaaggaacactgattcctttggttagagaatgatatttaggaaacaagatctggatcctaggtgtgctcatagctcccaggattccgttgcttccaggcccaggaagtgcctctttttccagtctcctggccatctttctggaagagatatcccctgtgcgtctgtattgggaaaaatgggacttaagacaataacatattcagattatgatccctttgaaaatagtaatggaaaaccaatactctctgctctttttccttttttcttttctagttcttcagtttggattcacaactatctttgtggcagcttttcccctagcaccacttctggccttactgaataacataattgaaattcgacttgatgcttacaaatttgtcacacagtggaggagacctttagcttcaagggccaaagacataggtaagttggatttgggtatgtttttaaaaaacatattaaacatctggtggataaaattttaaaagccacaaactttagatttttaattatgttttccatttaatataattcacctaatttttgcaaagaataattatattagttttaaataatattagacaagaagtaaagctacctatttggaagtttataatttccagtgctagagaatttgtgcttaaatagagtctcaatttgattatttctatcttaagattctagaatctaaaatttagatttattatcacttatatcctttttaaaatagatcttccatttgcttaaccttgatttgttctttcctaaatgtttgcctgatttacatgaagtataatccagtttttctaacggcagagatgaactttggtctttgactagagatgctaagttgaatcagatgcagctcgcatgagagctgcctgagatcaaagactgtcttttattcatttctgcattcagtgcttagcacagagcaggcagtcacccagccaatatgtgtggaagagaattgcatgtggatgttattgttaatgacgtcttttaacctccacatgaaacaagcacacattctgtgagcacctaccctgggtcagtgtgttattggcagggcccacaaagatgaacagaagggaccaaatccatacccttaaggagctcccagtctggtggggcttgacattatgtgtgctgatcctatcagatggtattttggtgccttatcattaaccagaattctctgcctcatgtctgatcctgactattaagtcacaagcatatagacactcccatagaaactccctcaatgccaagttgtttgcacaaatctttcctcctggttgcaaatgtcagtatttggaaagatgaagaaaggacccatgaaaaggacttttaaaaattaattccattttttcataattatcacctctgttttgtgtatggaactaacacaacacttctatttgaataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtaagtttgctataaaaccactatacagtttctatttcctagccattttttgaggttggacactcagacagaagactgcactggagaatatggaatacatgcccagaaggagaggcctgtgataggggaggtggaattatgatttattataaataataataataacactgtcagccaaagaaaacatgtcctcatctaccaaagagttggaggacatacaagtcagacaggttttagatggaatccaatgtaagagtggcaattaatcattttccccacccctgacctctgcccactatgaatttagaaatgtgtgatatgctaatgtgtataccaaaacagtagcatatgatgtatatatagttatatcattttatgagtttgcaaaaggacagttacaatctgatttacattgtgtcattatgtgtaaactctgcagatcttacataggaaatacggaactaggtactgagtacccagtaggtcctcaataagtattcgtggaataagtaagtgaatgactttttcatgggtattgacctgaccaatgcctatattaccccaagcaagctgagtggactaaactccttgggaggatcaattctatggcattgcctcaatggtttgcaaagccagggcacgctatatatggtcagataaagataagtcaaaattataacatcccctagtttcattcctgtaccttggagaaagggcaagaagtcttaacatgctttaaaaatccctgtttggttaaagccaaaatagttaaactcttattatgggattttgatgtctataggtcagagtgaggtgtgtttggggatcacagggtcttcttaataacccagaaatcaccctacatgggctgctgtctacttatacaagcagccctggtttactagcctgagccagattgattcatcctctacagccattgtagctgatcgaccccaaggagttaagtgccaccaaagcaaatcaactgaactcatgcaaacctggcctgggtccaattcattatgaatcctacataaatgggctaaggtgtggatgattgaggaatgtcataaagctcacaatccagttatttgaaaaggcttctgtaaagttcttgactactataagcatgtggccatgacacactaattatctagcaacttttagtgagcataccatcccattttaagagaaatgtaaagacatgttattttgcccaggcatttctttctaattgcaactatcgttgacattctctgcttggcttagcctgaaaaagcttactttcactcaaaccactttcacatgtgtttttagttgattctcaaaacagccctgggagtgggatgtgcattataatcttcactttgaggagcaggaagagattaaaagaggttaagtccagaatcacaaggcatagtaactctgggagcccatgtgaaggtggagcctcgactcactctccatcccgcacctcacagcccttgaggctgtcccttaacagtaaaccccctggattttccgtcgtaatggtgtttcagttctttcccaaattcaaatatggtgaaatctatcttgttttagggggaaccaaaaacaaaatgggaacctttatgcacaattgatagtgaatcaaagatttagaattttaacaacctggtagatttaagacaatgtccacagtgattaaagtgtatctcatagcctccttgtatcaattttactgggctctttggagcttttcttttctttctttcttttttaacctttctctttgacttaggagccttctgccactttcaatttatggatctgccttttgttttctaatccattagtcatttttcatgttttcaagtagttaaatttatgtatgtttcttcatgaatcttattttctgcctcactggccactctattacttttcagattttttttatttttccaatttagaaatgctttagaaattattgaactcataagagtagcagaattgtcaaggtatagaaagtcataagcctttagggtagtacagtgattgctggctcatccctttcttatgtattaaaggattgaaaattataagtggtgagtggctttcacggtagaattctcacatttaaatgagtgtgtggtcttctcagaagttacatggaagagatatgcatcctaatccaaatggcactaccctgtagaagacattttctagatctttcttggaagtgcctacagaggccatctaccattcctttaagaaaactgactttatattcacaggaaacccttcgtctgttacttttttcttggtacttctcaattctccctgatcatcagtgtagcctcatctccctctgtctcattgagagctggtggtgggtcacagtgagggtatatagcattcctgccagtaaacccagtgatagacatgggctctctactacctgtgaccttcctgctataacaatgggtcagtgagttgacacttgcatgccactagctgaattttatacagcaaaatgtgataaatctcacttgcctgaattgatgacaactttcactatttgatattgacaatagctaacagtctacaaaaggtgaaaggaattagtgaaacgtctagctgtccgtgcatcttttcccccattatggaaatgatatggaaggaagatgtacacagctgataactgtgtgttcctgtactaggtacacatttaatgctttgcactcaggagtaaccaccctctaaagacacattttcaacttggatttatgactgtcattcatgcattaggtccatgaaacaggtgttttatttaaatttaaattttcttaatggagtttttgagcagaacaaccaatggacagtagcgttagtcttgataaagcctcggggctggtctgtgagataagagtgcaggaggggttatgaatattccatttcagtgctgggcctttttttttcaccagttcccagaacacctttcccttcccacagctcagatctctagaaagactctgctaaaacttactccctctctgtgacagctaatcatcctcaaggcactaatttattttcatgtccaggtctagacagttcctaggtaagggagacatcattccaaattaccctttcagtaggggagtcctgctgccagttggattaaggcatgttacacactccctgaccatttgttttcacccacgagtgacttgacaaatgggtccttcagcttggttcattttttttaaggccatgataaagccagtgatttgtcttgagcacgataacatgcagaacccatgtgttctcagaactgtgttcatgtcatcattttggtttagtgttcagcagcttggaataatcatgccagacttgttaatgaagagaatctgaagatcatgatttattcattcaatcagtaattacttattgaccccctgctagatgcaagaaataaataaaatgaataatcaccactcatgtttatcttacttataggctaagatcttatcacatgctatacattcattgtttaatataatcccctcaaggaccctatgaggtgggaacttctgtcactttaagaagttacgtaaatcgggtgtggtgacacatgcctgtagtcccagctattcaggagtctgaggtgggaggatcgtttgagcctgggaggtcaaagctgcagtgagccatgatcataccactgcactccagcaatgagcaacagagcaaggccctgtctcagaaaaaaaaagaagaagtaagaagttatataacgtgccaatattacatgactagaaaccagcagaactaagatttgaccccaaaacccaagcttttgtatgtaaaacactatttaaagaaaaatgtatacaggatgtatctaagtgctaatttcacccaaagtttcaaacattgttatttcagtaagtgcatgtgttaaccacaatgttcaatatgtaaaactgtttagagacttggagaaaagatgtttctaagagtgctacttgctatgatacttttaaaatgggctttttcttgaatggaattattgacagaatgattaaatcttgattttatctacccattcaatctagaatgatcaatagaatctcatactttagtttcctccaatcagatcgattcaatatttatgggattcctacactgcacaagactgtcctaagtcataggatacacaaatacctaagatacctgctctgctcccaaaaaattgcagtccaaaggagagggcatacatatatgctgccaactctagtacaagcgatctggtaatggtgaactaagtaagtatggtggcactacagagagagggaaaggagtgagatgttgtgactggagtgattaggttgtcttcctagtaggagtggtgtttcagttggccgctgaaggataaatactatttccacttgtaaaggaagaggtagggaattctaacagaaaagataacaagcagaggcatgaaaacatcagaagctttcagggaatatagtctaacaggactgtagcatgggatatgagttggggggatcatatgcacaccaatcatatttggaacattttgagaatatctataaatatatatgaaaccattaatgaggaactgtgtttatgtgtatcatcaacaaaagaagctgtggcttacatacaatttatgcccatcatgtaatgctgctttttacctatttcactgaaacattaattggggtagagatgttctatatgatgattctgcagaaaaaggatgagaaccaaaacaagcaacttgttcctgattcaacatgcccagggctttccagcgtatcccaacctgagtcctggttgacaaggaagggccagttaaaggcatttacaattgcagtgacgtctgggaagcagggtcttcagggaactggatacagagaaggtgatgagtgttctaatggtagaatgtgcctcctcttataggtgcatggttggctatgtgaatgccagcttgtctgtatttcgaatttctgactttgagaaccgatctgagcctgaatctgatggcagtgagttctcggggactcctcttaagtactgcaggtgagtgtggcacccagcgtggctctgcctgagctgggctggctccaccgtggggaggttttactctgaaggccccttctggctgagtgtgtttaaagcagtgactgtcaatctcaacagtgcattaaaagcacatgaagaattttcaagccttctcttgcccgggatacaacccaaaccaattaaaacagaatgtcagggagtggaactcagaaaccaggtgcagtcagaattgagaactgctagcttaaagggaaaaactaaaaatatagtagtgaaggttataccgctgctccagggactcagggacagacaatccccaggcgggttgagcgacagctgttgagggcacttgtctttgttctgcttctctctcttgcccagagtatatcacatcacatttctaaatgttaaacaactcagaagcctgtggaaagaggcccagttcatttcaggttccaccacagtagcctctgcaacatgtgctcattctctctttctttctctccctctaaaaggaaatgaattaaactgtgcctcttgatgtgtatctatacaaacgtacatgaaggagaatttgttgagcacctactctgtgccagaaactgttactccatttaatcgtcacatcagccttctaagttaggcaatattatctcatctgacaaatgataaaaccattcactaaaagctcaatgagattacttgtgcacagttcttgaagagtccagatggcacctttttctcttaatactttgacgttataagaattttgtgggctcacacctgtaatcccagcacttgaggaggccaagttgggaggatcacttaagtccaggcagtcaaggctgcagtgagctatgatagcaccactgcattcaaactatggagcaagaccttgtctcaaaaacaaaacaaagaattttggagattccctatcatgacattctatgttctccctgtaatcaaagccacaaggaagaacagccatggagtcctagatgctttgacatagggacttttgtaatgatccacttcagtccctcatcttacagaaggtgaaggtgagagaagccaggggctccccatttctgtgcagtgacagcataccctccacccctttaaacactcatgccaagttcccaggtctcattggctgtcacatctcatcagatggcttatttcctttcccacatggagtaacaagtaagatggggagaaagactggctggaatataatctagtgccgctctctgttggggtctagtggagaagcaagcaattaagcaacaattgatactttcttcagtagatttcccacttgcttgtccagaccatttcgtacatgaaattatttagcaagcattgttagacatatacaggatcctaagtatgaaatgcttcaaaataaaatgccaactattatttggagttaaaaactttgtaatcatttgaaaataagataaaaatacagagtctttctcctcttctgcttcctggctcataattcttcctgcctgtctcacatagtatcataaaagtatattccagaaattattaatgtgaatggaggtattaatgctggcaccattaagttaaattatgattgttttgtttagcatttttcttaaaagtcccccaaagaaaacattttaaaatttctaattaaaatcatgtaaaataatattttcaggtttgttttcagtcatatagcaggtgaggcacccagatcagcttgcgggctgaaaatatctaaacatgtagagaaaaatttaaaaacaccttctcaaatacattaatgacctgggaagaatatttggtattctaaggcagaaagaagtggtacacagagcattgcagccaacttttacccaaagggaatttgctgaagtgagtggactggagctttctttttatttatttatttatctttttatactttaagttctagagtacatgtgcacagcatgcaggtttgttacatatgtatacatgtgccatgttggtgtgctgcacccattaactcatcatttacattaggtatatctcctaatgctatccctcccccctccccccaccccacgacaggccccggtgtgtgatgttccccttcctgtgtccaagtgttctcattgttcagttcccacctatgaatgagaacatgcggtgtttggttttttgtccttgagatagtttgctgagaatgatggtttccagcttcatccatgtccctacaaaggacatgaactcatccttttttatggctgcatagtattccatggtgtatctgtgccacattttcttaatccagtctatcattgatggagctttctttttcaaagctttccatggttagggaaagtgaaagaaaatatagaggccaggtgcagtggctcaccctgtaatcccagcactttgggaggctgaggtgagtagatagcttaaggtcaagagtttgagaccagcctgggcaacatggtaaaaccctgtctctaccaaaaatacaaaaaaattagccaggcatttttgtgcacacctgtagtcccagctacttgggaggtaggagtatcacttgagtctgggaggcagagattgcagtgagccaagatcgcaccactgcactccagcctgggtgacagagcgagattctgtctcaacataaaagaaaagaaaatataggaatgaccagcctgtaagtgtatacttatatgctatataaaacaaccataatatagtcacactagagtctattatacagcaataaaaataaaccacatgcaataatgtgaatgaatcttagtgacataatagtaaaaaaagcaagccccagcaaactacatatagtatagtaccctttctataaagttcaaaaacaaactaaatagtacaatattcagacaaatgcatatacatataagttaaaaataaaaatgaaattcagggtaagggaagcaattgatgtaagttcctggtaatgttttagttcttgggcttcatagtggatttatgagagcttgttgtattattaaagtattactttaatggagtcacatggattaaagttctctgaatagtgcctggtccccaacaggtattcggcaaacatttgtggcattttatgccgactcaaaagtgatagctggaggatacattaggaaggactcttctagtggcaagtggcagaaatccagggtaaactgacttaaacaacaaaaaattgttcagttagctgggagagtcaaggggtgatatgagcttcagtaatggccggatcccaggcctcaagcagtgtcagcaggatgctgcctctctgctgtctctgctttgttttcttgacttccttctcaagcaggctctctctctccatacaaggccaccaggagtcccaggcttttgccttctgtgggcttagtgatcattcactaagtgatagttctggcagacatcttgatgatgtcactgatcaggtctggctcatcttttgagctgagatcaggcaggtggagggggaagtcctagtcaacccacacagatgattccccagagaagagatattattttatcagaagaaaaatgctggacaagcaaaacaacagatatctagtatagagaaacttcaaatttccctcctattgaatgaggactatataatgagaatggaagagatttgagaatcagaaaaatcatagtttgaatgcaacatttttctgtgtctttatagataccgggactaccgtgacccgcctcattcactggtgccctatggctacacactgcagttttggcatgtcctagctgctcgattagcttttatcattgtctttgaggtaagtttcctcagccaaattctttatttcctttgacataatgaagtcagtaggagtaatgaataaaaataagtgatggggattttgaatgtgattatctatatttccagaagtagtagtgtcatattatgtaacctctttttgatcttttttcttaattgaagtatttgatttttccaagacatatttgaaagtccatagttggtttttaatggacaaatctgaactcgttgctcctaaatgtaattttctggggccatagttcttaaactttagcaaaaatgcagtttttccatcctcactcccagatattctgacataccatgtctgtggcttgtttttcatgagctcgttgtaatgattctgactataggcattctgggaccataatttggaaacatttggaaaacatcagcccagtaagattcattctttttttctttttctttttcaacttttattttagatacagtgggtacatgtgcaagtttgttacaaagttacattgcatgatgttgaggtttggggtgcgactgaacccaccacccaggtagcgagcatagtattcaataggtagttattcagcccttgtcccctccccctctcccctctatagtagtccccagtgtctgttgttctcatctttatgtccatgtgtacccagtgtttagcttccactctaagtacgtacaataagaacttgcagtgtttagttttcagtttctacattatttcacttaagataatggcctccagctacatccatgttgctgcaaaggacatggtttcattcttttttatggccacatagtattccatggtgtatacataccacattttctctatctggtccaccattgatgggcacccaggttgattccatgtctttgctattgtgaatagtcctgtgattgacatatgagtacatgtgtctttttggtagaatgctttattttcttttgagtatatacccagaaatgggattgctgggttgaatggtagttaagccctttgttctttgagaaatctccagactacacagtagttggactaatttacctttccaccaacagtgtgcaggtgtccccttttctctgaagcctcgccagcatctgttaatttgtttactttttttttttttttttttttttttttaagactgattctctctctgtcgcccaggctggagtgcaatggcacaatctcggctcactgcaacctctgcctcccaggttcaagtaattctctgcctcagcctcctgagtaggtgggattacaggcacccgctaccacacctggctaatttttgtatttttagtggagacggggtttcactgtcttggccaggctggtcttaacctgacctcatgatccatccgccttggcctcccaaagtgctgggattacaggcgtgagccactgcacttggcctgactttctaataaaagccgtactgactggtgtgagatggtgtctcattgtggttttgatttgcatttctctaatttccttagagattctgagcattttttcatattattgttgtctgcttctatatcttcttttgagaagtatctgtttgtgtcctttgaccactttttaatggggttatttgttttttacatgttgatttgtttaagttccttacagattctgggtattagacctttattgggtgcatagtttgcaaatattttctcccattctgtacggtgtctgtttacttctttgacagtttctcttgctgtgcagaagctctttaattagatttgacttagcaatttttgtttttgttgcaattgcttttcaggacttcaccataaattctttgcccaggccagtattgagaagggtatttcctaggttttcttctagcatttttatagttgaggtcttacatgtaagtctttaattcatcttgagttaaattttgtttatgatgataggtagaagtccagtttcattcttctgcatatggatagccagttatctcagcaccatttattgaacaaggaatccttcccccactgcttgtttttgtcaagttggagattcactctttctaaatgtctccaattattgccatcatcattaccacacatattgaaatatactgattcatatagttaatttatgattttcaaatagttatcaggatttcccaacatgatcataagcattttccaataggactgggtattacaagtggtatttctggttgtgtatcatcacggaattatttatattcaagcatccaagtaagtatttattagctaagactcaaaatggaattataaagtaaaatctgtctagcaattgtctatattatatgtcaataaaaatatattatctattttctttcagggtttaagaaaattgctgtaaaaatagtttgcatttctatgactctagtcataagtggaaatttcatctcttgtcacatatattaaagccagattaataaaagccaaggttgcctctcggcttggatctaaagtttcctagacctcttcaagactattctatcactgctttttccttcagtccagggaaccaaaagaagaaaatattaagctgctcttccctggaaattatcttaccaatggcacactctctctttaaagaagatatttttaacccatcactgtcttaaaatttttcagacaaaacttcttgttgtttgtttgggatttttttattttaagttccagggtacatgtgcaggacatacaggtttgttacacaggtaaatgtgtgccacggtcatctgctgcacagatcaacccgtcacccaggtattaagctcagcatcccttagctattctttctgatgctctcccttcccccacccccacccccaacaggcccctttgtgtgttgtttcccaccatgtgtccatgtgttctcatcattcagctcccacttataagtgagaacatgtggtatttggttttctgttcctttgtcagtttgctgaggataacagcttccagttctgtccatgtccctgcaaaggacattatctcatccctttttatggttgcatagtatttcatggtgtatatgtaccacatttttttatccagcctatcattgatgggcatttgggttgattctatgcctttgctattgtgaatagtgctgcaatgaacatatgcatgcatgtatgtttataatagaatgatttatattcctttctaataagcgccatactgactggtatgagataatatttcattgtggttttgatttgcatttctctaatctccttagagattctgagcatcttttcatattatttttggctgcttgtatatcttcttttgagaggtatctgtttgtgtcctttgccatacaagttatagaattgctgggtaaaatggtatttctgcttgtaaatcactgaggaattgccacactgtcttccacaatggttgaactaatttatactcccaccaacagtgtaaaagtgttcctttttctctgaaaccttgccagcatctgttgtttctggacttttaaataatcaacattctgactggtgtaagatggtatctcattgtgatttttatttgcagttctttaattatcaataatgttgagctttttttcatatgtttgttggctgcatgaatgtcttcttttgaagaatgtctgtttatgtcttttgcccactttttaatggggttgcttggtattttttttgtagatgtgtttaagttccttgtagactctggatatcagacctttgttagatggatagattacaaaaatgttctcccattctataggttactgtttgctctgatgatagtttttttgtgctgtgcagaagtactttcatttaattagatcccatttgtcaattttttcttttgttgcaattgcttttggtgttttcatcatgaaatttttgcccatgcctacatcctgaatggcattgcctagattttcttctaggatttttatagtttggggctttacatttaagtctttaatccatcttgagttaatttttatataaggtgtaaggaaggggttcagtttcgattttctgcatatggctagccagttctcccaaaaccatttattaagtagggaatcctttcccccattgcttgtttttgtcaggtttttcaaagatcagatggttgtagatgtgtggtcttatatctgagatctctaatctgttccattggtctatgtgtctgtttttgtactagtaccatgctgttttggttactgtagccttttagtataatttgaagttgggtagtgtgatgcttccagctttgttctttttgcttagtcttgtcttggctatttggactcttttttggttccacatgaattttaaaagagtttcttctaattctgtgaagagtgtcaatggtagtttaatgggaatagcattgaatctataaattactttgggcagatggccgttttcacaatattgattctttctatccatgagcatggaacatttttccatctgcttgtgtcctttctgatttccttgagcagtggtctgtagttcttgaagaagtcattcacttttcttgttagctgtattcctaggtattttattcttttgcagcagttgtgaatgggagttcatccatgatttggctttctgcttgcctgttgttagtggttaggaatactaatgatttttgcacattgattttgtatcctgagactctgctgaagttgcttatcagcttaagaagcttttgggccaagatgatgggattttctagacacgggatcaggtcatctgcaaaaaaaagataatttgacttcctctcttcctatttgaataccctttatttatttctcttgcctgactgcctgggccagaacttccaatactgcgttgaaaaggagtggtaagagagggcatccttgtcttgtgccggtttttaaggggaatgcttattgagaatttttaacatgaagggatgttggattgttatcaaagaccttttctgcagctattgagataatcatgtggtttttgtctttagttctgcttatgtgatgaattacttatgcttatgtgatgtttactgatttgcatatgttgaaccaactttttatcccagggatgaagccaacttgatcatggtagataagctttttgatgtgctgctggatttggtttgccagtattgtattgaggctttttgcatcaatgttcatcggggatattggcctgaagtttttttgttgtctctctgccaggttttggtatcaggatgacactggcctcataaatgagttaaggaggagtccctcctttttaattttttggaatagtttccatagaaatggtatcagctcttcattgtacctctggtagaattctgctgtaaatctgtcagacaaaactttttaaaaggctgccttatttggcttttcaaatagaattttccattttcttttaatattttgttattaactatttgaaaatatgagaactatgcagaaaagcttcttaattttgtgccatccatgcatcaccaaatttatcaagttttaaataaaacgaagaatacttagcagtatcatttgaacatgatttagtctctatttaatactttagaattgtaatagcccttaaattgtcatctagtacttccttggtcaccattatatagatgagcagaagtgacagtgactctagaattccagctattagtatttcaagtaaagaatttgtgactgtttaccaaaaagaaaaaagcttcttcctgaaatgatcatttccctaggcccactgataattcttataaccaagatttgtaaagcacttgacagtctacaaggcatttttaaacattttctcataattctcacaatactcactttatagatgaggggaatgaggctcagataaattaaataattcatcctcaggtagacagacagcccttaagcagtgaaagctaccagcttcaacctgggttttctgactccacagaatacattcttctggctctcctttgaattaattatctgaccattcttttcccaccttccttccagactcctctttctattccttaggtggtgccatcagaccagttcaggcctcacctgtcctatcatcttgcattacacacgcctcccctggtcactttgcactctccacataccccagagggtccacatccttcttcagccaactctctaacctcattcaggatgcacagtagacctgacgctgttacattctcctctgttttagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccatgtaggtgagaggtgtgctcagcgtctgaggccattccgaggttgaatgggtgctttaaactccctgaagcaaagcttaccattgttgcagtaacagggatcaaaataaactccttagaagcttcccaatccaaaagaagcttgttttttactttaatcgttgcaaattttgcttgatcttcccctcccacataccttctgcaacacttctctgccttcttgccagactctggcctatcagtcaaggtcttcatgaattggcctaggagttccctgaaacaaagcgtcctctctcttttcctccagccgggctgttttctttaatatccccagggaaacatgccccttctttctaggtgggtgggaggcagacattagcaaagagaattcttcctgaaagcctcagcggccagagaccaaggtgcaacagggctgtcctgggctgcaggaccagtaactgatgaagaatttcttctggccccaccactactggctgctttcttcccaaaaaggccatttctaatttttgcttgaaagcatagtatctgcctgcctgtttctatttccccaatagttggcaggatgtgatgttgctttagactgcccttctgactcagtctgttcacccataaagcaagcataaaaatgtttataccatccctgactccatttggggttacaaattctttgaatgcctttggtgcatggtaagtacaaactattgcacctcatgttttaaagcaattgtgtatgcataagatctttatgccttcttttctctttccagaaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttc

SEQ ID NO: 71 - DNA, 62229 bp, Homo sapiens
gtgacctggaactcccctcggtactgacatgatgacagtgtgcaggccggccaagggcagccacagccagactgaaaacctgagctacaaattggctgacaagtaagaacacttctcccccgagagtgtagacgctgacccagcttcttactctcctaccacctccttcttcactgatcctacttccttgagctaaggagctcttttccaggtcattctaatgagcctcctgcagaccgcctccatgcactgcattcatttaaggcttcaggccaaactgatcgagagagtctgactaatggccagtgtgaggagaggatgatcccttggtaactttagccctatccccatgacgcattccaattctgggtttatttttctaactactaggatgttcaggtattttacttatgtttgagccctaagtctttgcagctgtacctgtacacagtcagttttcccatctaataccagcgtgattgtttccttctccccagatggagccctttctctgatcctctcacattccacaaagcagttggcagccactgaggggttcttagctctgcaccccagtctggaaccccttatggggcgggagaatcctggaaacaggaactctagaaactcttgggctggcaaccacatggagcaggaactctgtccttggggactcgtaggacagttgcggcatccttgcctctgttgcgtgagttttgtaaatccagtgtgagttttcagcaagccatcctttgttcctctcaagttttccgacagagcttccatagttgtgaagtcactccatgtgtttgggctcttagacaataactatgatacttacaataacactagttaccatttgttgataccaagatttagaaagtatgctgtactttgagcacattacatgttaactcatgaattcattcattcattgaataaatatttgttgactagctgctatgcaccaggcacagtaaacaatataaatgtggcctctgactcatagagtttcagtctacagaaggaagatgaaaaactcaggattcaagtctcaagtccctcatttccaaagcccatgtatttagctcctaggccatagtgcctcacagcatataggacattaataaccacgttgtagaccatcagtcatcaccatgcagacactaacctggattgttgtgtttttaatgtgtgtgtctgtcctctctcttcatcttgcctctagcactgtgagagcaaggaccatcacttctgccttttgaaccctcagtgagataacaaactgattctgactaaaatcttaattcatgctaatatctccagtggtgatggaacaatttaaaaatattttctctttgtaaacacactgttaggaatcctaattgtttatttaaataaggaattctgccttgatagccatatttaaaataggaaaatgtgtttgccaaaaaaatgtgtttgcgttttcgcaagtttctattttatgccatgcaaccaagaacagtggcgtaatttatgtgctaatgtctccactgaggaagaggtctttacacaaacaaccttgggaatagaaagctaaatagtaacaggatgcatgaaattgctacttattcatccctcacggtgaaccttaactggagtttcagaatttccatgcggtcagatctatacattcagaaaatgggcaccgtgaggtgttagctaatgtcggcacatccaaagtcactgtactcagtcataacctttgctggtggaataatgtttgcattggacaacacagatactctcattcttgttagactaatttaaaaatgtttttccttcaaaataatttctaatatcttcatggcattatctaatctaaaattacatttggaagcatgtatcattacatatatgttctaggccaaaactttattcagtgatggaaatattcttcttccccatccagtacggtagccatcagccacatggcgcttctgagtccttgacatgtggcaggtgtaactgaggaactgaagcttgaatttcattggatttaaggttaaatagtcacgtgtggctggtggctactctattagatagtgcatttctaagccaagtgtgaaatctgaatctgcctctttattcacgcattcattcatgcaccagatatttattgaccaccaactctcccaggtattgttttgggtgctaggggtgcagacttggctacaacaggccaaaataacagaataatccctgccctggtggcaaggctcatgaagagctcactctagtgaggccccattccagaggaggttctgttcagatgcatccaatcattgtggctttgcccacttgaatcagacaatttgtcaagttcaggggtagcacaaacttcatgacttgtgatgttgttttagtttttaaatagtcattgcaaagaactgcctgtggataagaaaagcaggaaaagcagcctatgtaatcttttacctcgtgaaattactcctattttatttttatttttatttttgagacagagtctctctctgttgcccaggctggagtgcagtggtgcaatctaagtttactgcaatctctgcctcccgggttccagcaattctcctgcctcaatctcttgagtgagtagctgggattacagggcctgccaccacaccccgctaatctttgtatttttagtacagacggggtttcaccatgttagccaggctggtctcaaactcctgacctcgtgatccacccgcctcggcctcccaaagtgctgggattacaggtgtgagccacaatgcctggcccatattattatgatcttcattttacagaggtggaaactgaggtttagaggacttaaacaacttgcctaaggtcacgtgactgaattaggatttaaacccaagcctatctgactcctaaacccgattgctccttcatttcaccatgctgtctccccaaggaaaacacaaattgagtttttaaaaaaaatttttgtagagatgggggtcttgttatgttgcccaggctggttttgaactcctggcctcaagtgatcctcccacctcagcctcccaaagtgctgggattacaggcatgagccactgcaccctgcccacaaagtgaatttttttttttaataggaatttcaatgtttgtggtttgtgacttgcatataacatttatatctaagttctagcaaatctctatgaccagccaagaacaataagaatcactcacctggtgtttgtctttcttgtgcagggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacaggtaggtgccggtgtggccaggcagagtgtcgccacctgactctctcagtggtttgtgtcccatcataaccgtctgttctcagctgaattatttgttttattaaactgatggatcttgtagtccagatggttcatagcttaagatactttgttaattaacctggaaacttggtaactgatgcatgtattttgtgtttgttctcagtcctcaaaaaagaagagtatgtgcttttaaaaattaccctttagatgtaataaggacttggaattgggacagtaaccaagagttaaatgaaggacttatgttaaccctggcagtctacaacttggtagtccctgctaactaccagtgcttgaatttttcttggtgtgggctttagaaatacactggccctatcagtgtctatctatgtgaccttaaacaagttatctaacctctcgaagcctcagtttcctcatttatacatatggatgcacgcactgtgaatattttataacgttaaaataacacattaaataataaagcatgttaatgcttaaaaataaaatctgtgcttcgaaaacaatttttctattttgcaacttaatctctagtccatttctgtaacatgctagttggtttgatacccactaatctagaaaccagctttagagcaaaactcctcagaacagttgttgtactccctttcatcatttcacctcctattttctcttgacccaccccattgagctttgggaacctcctcctgaaactaccctgtcccgaggccaccagtaacctccatcttgctaaatccaattgccagttctttgtttttttcttaattggcccctctcagtattcgaggaacacctgttgacttgctccatcttgaaacacttccttcatttggcttctgggtcacccatgtccctggaagtcctgcttctctggctcctttgagttccattcttttttccttctatctgtcagagcacaccccgaacctatccccacctcaacccagggccagacctgagacttttcttctccatctacactcactccctaaatgatctcatccagtcccatggctttaaatgtcaatgtcatgcttatgattcccaaattgaggcattcagccccaactccctcccccagcttaaggtttgtgtagtcatctcctgcttggatctccatttggttgtcttatcatttatacttaacgtgtccaaacccaagttctccatccaggccaccagtaaccacctcctaaaataattgtcatccttctaaatggcatcaccgtttgtttagttgcttaggccacaaacctaaaaagtcatctccaattcctctctttttcatataccccttcctaattcatcaccaggtcctttggttctagtttcaaaactttatcccaaatctgcctacatctcctccactgctaccatcttaatcatcttggattcacttcccatccgtagaacattcctccctcagcagccagaggagtcttctaaaaatataaactataaattaaatcctgtcaccccccactcagcatggtctgtcatgtaggatgattcttttggctgtaaatagcataatttcttttttttccccactttctctgtaaatagcataatagcataatttcttgtgttctcttcaagggggaaaaagtttgcatattctagaatttatttacatatatttgtatatatatatgtaaatatatataagttattcccagtttacaaataatgctgtgataaggagcatatagcattactagttttgctacttactagctgtgggacattggacaagcaactaaattgtgttggcctcattttacctatctgtaaaatggtgataattatattatagtaaccacttcacagagttgttgtgaagattgaatgagttaacatgtataacataaacttagtacagagcctgttcaatatgtgtgaagtgttttatttttctctggctccattctgtttaattaatcaggctatttttttttcagtaccaaactattattttaacttcataatgtattattattattatttttttttcgagacagagtatcgcccaggctggagtgtggtggcacaatatcagctcactgcatcctccacctcctgggttccagcaattctcctgcctcagcatcccaaatagctgagattacaggcgcacgccaccacgcctggctaattttttgtatttttagtagagacagggtttcaccatgttggccaggctggtctcgaacccctgacctcaagtgatctgcctgccttggcctcccaaactgctgggattacaggcatgagccccacacccagaccataatgtattttaatatctagtagagcttatagaaagttcttaatgttgctaataattagtcagttgatcctcttggacttcctatatataacatcatgtcatatgcaaaaaaaaataataatcactttgtctctctcctttttagtaattataaacctcttgtttgtttatttacttattattcaccttttccaaaaatgtcttgagtgtttctgcctgtatttttctgaatgttctaaatattactatcaaatttcacatacataaaatatgtgggggtttttgtaattaatatataattatttgacatgctatgtatttgctacatttatttctaagtcttttctctttttaatgcaatggttaatgtcttttttctcatatggtctttgtatttaagaaaactcttattttgtgtgtgtttgtgtgtatatatatgtgtattttttaagacatcttaaatttcttattatttctaatagtctgttagttgattcatagaaactatgaatataaccatattgtctacaaagaatcatcattttaccttttctttttaatttatacctaattctcttaccaaattgcactggctgagacttccgaacagtgttaaatcgtagtgctgaaagcagcgtacagtcttacttcgcccctaactttaatggtaacgcatctagagtttcactcacaggcactcttatttgagatatgtttttatgttatcaagttagtgtccatttatatttattttttcacttagagttttaaaaattaggactagagattagatttttgttaaagtacttttcagaaactcctgatgatcatatgattcttctgctctgatccattcatattgaatttatattttaatattaacccatccttaaatgtgggggatgaattcccattcgggcctggtttattattcttttaatgtactactgaattttatttgctaatattttaagatttttgtatcagtaaataaattagactggtctagacttgggttttattgcactatcttttttttgcagaatacatacaggatgattgcactatctttactaggtttgagtttcagtgttacttgaggtctggagaagaacttagatgcttccttctttatgttctgagaaaatctgaatccatctccaataataaatcctttctccagccagtgccaaagcccgggtccccgagcactcccatgacttccctgcccctgcccagtgcttcccacagcagcccttccacgccccttctggctcttcctccaaggaggtcccacacccccagggacaggttgattctgggaaactggaatccttcatctgtgtcatcactgggcaggcgagtcaacctggggaacagttattcccattatcttttctctcttaactatcatctgcgcttttcagtcttccagtgttttctttataaacagctaaagttacttatttcagtccaaagatgaaatttttcttggccagtttgaatatggtttcatcagctgtgttttaacaattttgactttgggtttttcattttgtttaaaatagtacaatggaggtgattagggcaagatattcactttctactcttaaaaaaataaagtatgctctttattgtggtcctatctcttaaaaacaaaaaggactgtaccacgaatttggcagacgcaccaccctctttgagggaggaaagccaaaccaaggttgaagaaagaaatgattaaggatttagaggttatgagggtttcaaatttcatggccaggctgtgtgtgccttagagaatgtattcagcttattttcataggccaattatttcacctccttaagagcaaaaccagcggattcagatcctcggtttaagaaagcgtatttttctttttctcttcctgtttctctctcttcttttttcttttctcctcttctctttccttccttttccctccttttctctctccctctctatttgctgtcttctcttttctttcttcatttctttaaagccccaggaaattaaatgcaaggacttaggccttcaatcctaaaatggaaaatgagaaaccctcaaatgtcaggaaattccaaagataaggttcctacaacaacattaacttggttatatgtgttttatggcatacacttaatagctctggcaagaatgccttaaggccgacatttaacaagaaaagttactactctttaagtgtgagcaccatcctgaattcacatgtatctacatactcaaaatgtcttaactggaattcagatttttaaattttagtttaacctggtcatgtgacagcttgtagatctttatgaaaccaaataactgcaatgaccaaaatttcaacttttcagctgattattttggcatcatatagatttggcctttccttggagctttagtgtaagactttcagaacttcttgaggacgtgaaacctcagtcattatatggctgccagatcacactgtgctgttattgattccataatttccatcttctatgggactgatacggatccccacagctctctggctgggcagcaaccctcggctctcacaggtttaacagttaaaattaacttaccagccaagctgtggtccatctcagtcagcaaggcatccctgagacaactcggaattaccacgtctaaaaactgaatgtttcaagtcttcaaaggagcgcattgtttgattaagttgatgtttagagcaaaagctactctggaagcttctgagaaacttgatttagtaaagccatttatttcaatagaagctgcattggaaaacagagagacggtgcttgctcttccaaggttgctgttgtccattacaagagtgattttcatgtcatttctcattgaaaggtggaaatcgttggatattagccacaatgagggacagaaatagtttttccttctgacatttagggtttagatccaggatagagaaaagcagaaaccctgtgagtgatcctagtacacggtggaggagttacccgataacagaatgcaagctgagagctaacggaagtctcctcctgcctagccgcctgccctgagcacctggtggtaggaaagcccttcctgagtatggcgagccatggggaagagctgccgtggccactcaggagagacaggcagaaagactctggcagctggaggaggaggatggaagtcagcgcgtggcatccttgatttctaacccagctggatgatgttttaaatggtcgctaggtgccaggctagccaagctttttttttttttaaacagggtcttgctctgtctcccaggccggagtgcagtggtgcaatctcaactcactgcaacctccgcctcctgggccaagtgattctcctgcctccgcctccggagtagttgcgaccacaggcacatgccaccacacccagctaatttttgtattttttgtagaggcagggttttgctatgttgcccaggctggtcttgaactcctggactcaagccatctgcctgcctcagcctaccaaagtgctaggattataggcgtgagccaccacacctggcctgtagccaagcttttttaatccatagaggaaaataatcctgggggaaatggattcaaaacaatttactaaaaattaactcaataatacagctgctttttttttttaaatcttgaagtagggataaattataaacagtaaatgtagcacttaaaaccagcttttaaaatattcattcacggggccaggcatggtggctcatgcctgtaatcccaggactttgggaggccgaggtgggcagatcacttgaggtcaggagtttgagaccagcctggctaacatggggaaactctgtctctactaaaaacacaaaaattagccaggcatggtggcacacacctgcaattccagctcctcgggaggctgaggcaggagaatcacatgaatccaggaagtggaggttgcaatgagccgaaatcctgccactgcattctagcctgggcacagagcaagactccatctcaaaaaacaaaatggtccagcaaggtggctcacgcctgtaatcccagcactttgggaggctgaggcaggcggatgacaaggtcaagagatcgagaccttcctggccaacatggtgcaaccccatctctactaaaaatacaaaatttagctgggcatggtggcacgcacttgtagtcccagctacttgagaggctgaggcaggagaatcgcttgaaccggaaggcagaggttgcagtgagctgagatgcgccattgcactccagcctggcgacagagcgaaaataaataaataataaaataaaatactcattcacttattcaaccaacaaatatttaccacgcacctatcgagtgttagacataggaatgtaataatgagcgagatagacggagactctgtcctcacgggatttgcagaccagtaatagttggaaggacacagctggtgtcgtgatcataactcctgtcagtgctgtgaggaatcctggtgccatgggaacattcagcagggatgtgtagcctatcagggaaacagatgggatcaagaggaagtgacgctcgggccagcgggagggtggggagtggacgttcagtttgagtgaactaataggtgaaagccctgagacaggaaagactgcatcatgtcagaggaactgcaaggcaggagtgtggcctgagggccaggaagggtctggggtgaggcctgaaggtcttctggacctatacacaaggtgtggatttgggcctattacctaagggcaatggaaaaaaggaacatttttaagaaggggagagagataatcagatttgcatgtttaaggccgggcacggtggctcacgcttgtaatcccaacattttgggagtctgaagggggtggatcacctgtggccaggagttcgagaccagcctggcctacatggtgaaacctcgtttcgggtaaatatacaaaaaattagtcaggcatggatggtgggtgcctgtaatcccagctacttgggaggctgaggcaggagaatcgcctgaatccaggaggcagaggttgcagtaagcctagatcacagcatttaaccccagcctgggcaacaagagtgaaactccatctcagaaaaaagaaaaaaaaaaaaaagatttgcttgtttaagagaccatcctgtcagcagcctggagactgggtgggcaccaatgggcaggtgcggtgaggcgatggggagaaacagtgaggtcttgtggttaccctgtggtgtagctgcctcggggactgagagaagtgggtgggttcaagagatgctttggaggtaaaacttgggttaactagttagacgtaggcagtaagtgggagggaggctaggagtctgatttccaggtttcagacctaaacctttggatggcaacactgggcaaggagttggttctcatcagagaggcaataggattacgagttcagctttgagattcttccgcattgtccaaatgggaggagctctaagttagcatttcatttacaaaaatatggagaagtcatgaagaacattcaaaatacgactcagaatcacagtgtttggcattggttgttgaaatttggctattacataggttataacgcccttcagcaaagttctttggaacaaccagctcattctagcatctctgaaactcagaagcaccaaatatcaaacgatcatttgaggacctgggaagtaaagtgaggctgagtggaggttacacctcttccccaggctgtgggctccccaaaggcagggacctctcgcctttgtatcacccactttgagcacaatgtgactcgcatgtttacttattaaacttgcaggcgggatgtggaatgaatgttgaaaatgtttaaattagagagaagcctgtttggatgtggttatcgttcattaacctttcacagtttcctttctctcaaagttaatgtgtaaatgaaggtactaaaactttcaagttaaaaaaaatatttgtagagaacagaattaggttagcagttgaaggattggtgtgatcacatttctcctcttcagggagcctaatcacctacctaaacctcagaaggggaggactgatgtccctgacatttatgtaggctgtagaaataatgctaggtggtccgggcatggtggctcacacctgtaatcccagcactttggggggctgaggtgggtgggtcgcttgagcccaggagttcaagaccagcctggccaacatggtgaaacccccctatctctacaaaaaatacaaaaattagccaggcatggtggcaggtgcctgtaatcccagctacacaggaggctgaggcaggagaattgcttgaaccctggaggcggaggttgcagtgagctgagatcgccccactgccttccggcctgggcgacagagccagactctgtctcaaaaaaagaaaaaaaaaaagggcagggcacggatcacctgaggtcaggagttcaagaccagcttgcccaacatggcaaaaccctgtctctactaaaaacgaaaaattagctgggcgtggtggctctcacctgtaatcccagcactttgggaggctgaggtgggcagatcacaacgtcaggagatcaaaaccatcctggctaacacggtgaaacccagtctctactaaaaataaaattttaaaaaatagctgggcatggtggcaggcgcctgtagtcccagctactcgagagcctgaggcaggagaatggtgtgaaccgaggaggtggagctttcagtgagccaagatcgcaccactgcactccagtctgggcgacagagcgagactccgtctcaaaaaaaaaaaataaaaattagccagatgtggtggcaggcgcctgtaatctcagctactcgggaggctgaggcaggagaattgcttgaacccagagggcagaggctgcagcgagccgagattgcacctgggtgacaagagcctgggcgtcaagagcgaaactccatcaaaaaaaaaaaaaagaagaagaaaagaaggggaggggaggggagaggagggagaggggaaggggaggggagaggagggagaggggagggggaggggaggggagtagggaggggggaggggaggggagggaagggaagggaggagaaagagagaggaagaaaaagaaagaaagaaagaaggaaggaaggaaagggaagggaaggaaggaaagaaggaaggggagggagggagggaaagaaagagaaggaaaaagaaagaaagaaaagaaaagaaagaaaggaaggaaagaaaaggagggagggaaagagaaagaaaagagagagagaaaggaaaggaaagagagagaaagaaggaaggaaggaaggaaagaaagaaagaaagaaagagaaagaaagaaagaaaggaaggaagggagggaaaataaagaactgctaggaagagctaactttctaaatgctttggcatgtgttaccaacacatgacaatgatagatcaaatgttataattggaatcctactttcctactagttctagaaactgggcatgtaaagatttctggcttctccttgatcttgtatggactgtacctcatgttaatttgtttgcctttcagacttcctgcataggaattagtcacctgaaaactaaccctttaatacaggaaatagagctgctatttgagaaaccttttgatgaatcgttttgcaaattagttttgcaacgtgaataaccatcttttattttgaaacagggtctcactctgtctcaaaatgagtgagagtgcagtggctggaatgcagtggcttgatcttggctcactgcatcctccgactccctggctcaagggatcctcccacctcagcctcccaagtaactggggctataggtgtgccccaccacacccagttaatttttgtatcttttatagagacagggtcttgctctgttgcccagctggtctgaaactcctgagctcaagcagtccacctgcttcggcctcccaaagtgctaggattataggtgtgagctactgcgcccacccccatcttcatttttttaaagggagtttttaattgttttcaaattggacttttctaatgctgtttagactagtgaccttttatgtgtcagaaatcaaatgtaaagcatggctgaccttttttttattattattattattccccagaaacaagatctcactctctcacccaggctggagtgcaagtggcatgatctcagctcactgcaacctgtgcctcctaggctcaagggatcctcccacttcagccttccaagtagttggaacttcaggcacatgccaccatgcccagctaatttttgtaattgttagtttttgtagagatgggatcttactttgttgcccaggctggccttgaactcctggcctcaagcaatcctcctgcctcagcctcccaaagtgctgggattacaggcatgagccactgtgtctggcctgagctcttatattagcatcttgttcttggaaatatagaaggattatacaaaacattcaaactatgtcttgaaatcccaggtgtctgacagtaaccactgggataaaagctaatcctatcccaacaaaccccaacacataatctggattcccgcttgcattacatgtgctctatttttatgtatgtatgtattttttgagacagagtctctgtcgcccaggctagagtgcagtggcgcaatctcagctcactgcaacttccacctccccggttcaagcgattctcctgcctcagcctcccgagtagctgagattacaggtgcacaccaccatgcccagctaatttttgtattttcagtagagacaaggtttcaccatgttggccaggctggtcacgaacccccaacctcaagtgatccgcccgcctcggcctcccaaagtgctggaattacagacatgagccaccgcgcccggcctgcattacatgtgctttaaataagcgagtcatccgctgagatttggagagcctttaaccatacaaatatcttctgttgttagggcagttattatgaaaacattttaaagattcagatgttatttcataggtactttatcatttcgaaatttgacctatacaaatattgtttccaatgagattttaaaaaataaaaacagaactataatcccagacaacagggaggctgagacaggaggatcgcttgagcccagaagtttgagaccagcctgggcagcaaagcaagacctccatttctacaaaaaattaaaacttagccagccatggtggcatgcaactgcagtctcagctactccggaggctgaaggacaaggattgcctgagcccaggaatttgaggtgcggtgagctgtggtggcaccactgcactccagcctgggcaacagagggagaacctgtttctaaaaataaatagagctctcgccatggcaaagcaaggcacagctacagcccctttctctctctcaaagaaaaggccaaactcagccagggtcgtgctgtaattctaggcagtcaaggctttacctgtaggtggtggttactaccctggccctgagagtgggagaaactgcctggcttccagtgaaatgaccccttcctgtcccccttttccctgtaagggttcatagcatctcctcatagcatagattacttactacttgagggaaacagagggtctgcctgggtatcgcacagtactgtgtaatgcagcaatgtaattatcactgtgtaatgcagttttgtatggaaaattagttcaggttcccaacagcaaactgttgaaattcagcctgttttagtttggagcctgtgaatgcagcttccctcctgacatgcctcacttaaataaatgctctccataatgccctgtgtcattaaaagcatcagtctccaaccagacttcctgcggtcagaccctaattccaccaccttttcccaatatacctggagcaatttatctaacccctctatgcctctgtcttctgataaataaaatgtgtataagaggccgggcacagtggctcacgcctgtaatgttagcactttgggaggctgaggcaggcagatcacctggggtcaggagttcgagaccagcctggccaacatggtgaaaccttgtctctactaaaaatacaaaaattagccagacatggtgatacatgcatgtaatcccagctcctcgggaggctgaggcaggagaatcgcttgaacccaggaggcagaggttgcagtgatccaagatcatgccactgcactccaggtctcaaaaaaaaaaaaaaaaagtgccaaaaaaagtggataagaatagtaattttgggttgggcacggtggctcccacctgtaatcccagcactttgggaggcccaggcaggaggatcacttgaggtcaggagtttgaaaccaacctgggcagcatgacaaaaccccgttctacaaaaaggtacaaaaattagcagggcgtgttgctgtgtatctatagtatacacagtcagggactgtctatactgtaataagacagtcagggactatctgtactataataaggactgttccatatccttagtcacaagccttttagacttggatgaactacataaatgggctgaaacttcgtgtcctgatttgtaaaatagtatagacagtccctgtctatactagtgagccactgctcccggcccccttttctattttctacgtctatgtttgtttacaaagttgggattttatttttttacatatactttattattttcacttagcataatagcatgaacattcttgcacataaaagccacatctcttattcatggattttcacaccttttacaataacagaagttgatttcaggccgggcacagtgtataatcccagcacttttggaggccaagacaggcagatcacctgaggtcaggagttcgagaccagcctggccaacacagtgaaactttgtctctactaaaaatacaaaaactagccaggcatggtggtgcatgcctatagtcccagcttctctggaggctgaggcagaagaattgcttgaacccaggaagcgcaggttgcagtgagccaagatggcgccgctgccctccagcctgggcaacggagcaagactttgtctcaaaaaatgaaataaaataaaagttgatttcggtaacaatttttctaagaaaaagaaaatttggccgaggggatatattaatatattctctgaaacagcctaatttgattcaaattctttgttttttcctcccatctggcacattccagaaagtcctatgagtttgaagatttactgcagtcttcctctgagagcagcagggtggactggtacgcgcagactaagctggggctgacacgcactttatcggaggagaacgtctatgaagacattctaggtaagaagccacagcgtctgtgtgcggatctgagtctgtctgggagaaaggggagggagaatggggctggctgctggaaacacacgtgcacacacatgtacacacacacacacttgaagacacctgtgcactcggatgaaaaagcaggcaggtggggtgggagagtgagccttgtgggatatatgacagaccctagggctggagggggaagactagctggtaatgagtggccaaggaggcagtgtggcagcgtggcatagcgagaagcgtggggcctggagtctgaagatccagaaccacatcttggttctgctgcctgttggccgcaggacattgagccagtgacttcacgtctctgaactgagttctcccatctgcataatgaggatgaagctagctcccttgcaaggttaaggactggagagaatgttgtgtcaactacctcacatatgacagatgctcagtcaactgcagggattactgaatgaaagaaaacactacacaacagagcctccttcagaaactgtcagagtgtggcactaacagggcatcagaacacagactaaatgtgatttaaaaagtaactttggctctaaagcgtcctctgagatttcagagtgggtctcagattcagagtttggtgagttcagtcatcttcagggaggttgatggttttagtgaagggcgagctccaactgcttacggtgcgggtgaaaggtgggggaagaaacaagctgataaaagggagaaacccatatgtgtgtgctggtgaggggcaggtagggtggatatatgcagacatgctggcatgtaatcatcaatactagaaaaaacttacagaaggaggaaatagaaaatttgaggaaggcagatgcttagctaagcaattggaattgcatctgtgtccaggctgctggagatgggctcctgccaaagcagcgggattcccagatctaaaatgggagcgagatctggacttctcttagcagtgactgcccaagaggatgctttcagttacaaggaacagaaaacccaactaaactagcttttccttcctccatttcttttctttctttcttttttattttttattttttgagacaggagtctcactctgttacccaggagttcaacggcacagtctcaactcactgcagcctccgcctcccaggttcatgcaattctcctgcctcagcctcccaagtagctgggattataggcgcccaccaccacactcagttaatttgtgtgtgtgtgtgtgtgtgtgtgtgtgtgtgtgtgtgtgttttcttttttaggagggacggggttttcccacattgcccaggctagtctcaaactcctgggctcaagtgatccacccccttcggcctcccaaagtcctgggattacaggtgtgagccaccgcacccagcccccttcctccatttcttacctctcaggttagctttattctcagcaggcttcccagcgtccccacaatggctgccaccagcttcctggaatccatatcttcttggtggagagaagagctggtatcctgcaagtcccagcagaaatcctgaggttcaccctcattagaccagccaaggtcatttgttcacctttagagccggggaatgccatgcagtgatatcacttaggcttagaatatgagcccttccctgaactgatcactgaggcagggatttgggatacctagattggctaaagcgctgaaactgagaatggagttaatctcccatggccacaaatgaggagatggagaggtaacccagtgaaatcagagactgctgccaacaggaggggcgcatggatggcaaaacagcagatatgcctacaagaatggacacaggagaggccaagatactgacctcagtgttttgaaaagggaaatgtcctcagtgttcccaggttcctgacacattgcctttgaacacagatccgccaatgaaggagaacccttatgaggacatcgagttacatggtcgctgcctgggaaagaagtgtgtcttgaattttcctgcttctcccacctcttccatccctgacacactcaccaaggtatgagtcccctgggaatggtggcaggagagggggccaaagcatggtggccttgagcactctggagttccggccagcactggaattccaggccacctccacctgccctgccgggctcctggatttgtacaacgctggctgactggtcttcctccctctagttctcttggagcccctctgctcaaaaaagcttcctaaaatacgattgagattctggctcagaaacctcctcaaactgggtaaataaaagatggtacatccgtcccatacaactgttaagaatgtcttaacatagagcatactctaagatacaagacggaaaggcatgatgtagaacagtagttttaaagtattttgccatttgtgggttgttgttgttgatttaattgagtcagggtgttgtcgctctgtcacccaggcaggagtgcagtggtgcaatcacggcgcactgcagccttgaactcctggactcagtcaatcctcccacctcagccttctaagtacctgggattacaggcacacgccaccagcccagctaatttttgtattttttgtagagacggggtttcaccatgttggccatgctaatcttgaactcctaggctcaagtgatccagctgccttggcctcccaaagtgctgggattacaggcatgagccaccgcacccagcctgtgggttttttaatgaaagaatatacatacatgtaaactcgcacatgtctatatgtgggtttttttaaatgaaataacatgcatatatataaagatgaaagaatatacatatatgtaaacttacacatgtatgtgtaagaatatctccatccccaatgttggaggtgaaaaaaaaatctctgtgcggatacccaagcatgagtaactgaggacctcagaggagttgtcctgtctgaatgcccagagggcagggggaaggctgaccttctttttacagaatatccttttgaactttctggagttacataccatatgcacatagataatataaccttattgatatagatggtaatttcaacccattgcctgcaggactagcatttgtaacagatatcttggcacccattacccctaatctcccatagatcctacatacaaatgccccttccatccagagcctaccaactacccctctgatgcaggcctgggacatgcgcactctctctaaagggccatagagtaaatatttggggctgtgtgggccatatggtctctgttgtaactactgagagtggccactgtagtgtgaggcagtcatagacaatgcgtaaataaatgagtgtggctgtatttcaatcaacctttgttgttgttgttttttgtttttgttttttgagacggagtcttgctctgtctcccaggctggagtgcagtggcacagtctcggctcaatgcaagctccacctcccgggttcaagcaattctcctgccttagcctcccaagtagctgggattacaggcatgcgcctccacgcctggctaatttttgtacttttagtagagatggggtttcaccatgttggccaggctggtctcaaactcctgacctcaagtgatccgcccgccttggcctcccaaagtgctaggattacaggcgtgagccaccgcacctgacctgaatgctgaaatttgactttttttttttttttcgagacggagtcttgctctgtcgcccaggctggagtgcagtggcacgatcttggctcactgcaagctccacctcccaggtttacgccattctccggcctcagcctcccgagtagctgggactacaggcgcccgccaccacgcctggctaattttttgtatttttagtagagacggggtttcaccattcacaggatggtctcgatctcctgaccttgtgatctgcccgccttggcctcccaaagtgctggggttgcaggcgtgagccaccgcgcccggcgaaatttgacttttatatgattgtcacttgtcatgaaatatttatttttccaaccatttaaaaatgtaaaagttaattcttaagtcatggcttgtacaaaaacaggtggtgggccagatgtggcccacaggtgccaaccagcgaggtcatttttaactctgcccttggctcttaccgggacctctccccatcctctgaggcccagttcaatcatgcgtcctttaagaagcgtctccagccatcccaatccctgggacttctttctctctgattatctgtaacactcagttaaaccatttctttttttgttatttttgtttgcttgtttgtttgtttgtttgagacagagtctcgtactgtcgcccaggctggagtgaagtggcccgatctcggctcactgcaagctccacctcccgggttcacgccattctcctgcctcagcctcccaggtagctgggactacagcctcccgagtagctgggccatcaccatggccggctaattttttgtattttttttttagtagagatggggtttcaccgtgttagccaggatggtctcgatctcctgacctcatgatctacccgcctcagcctcccaaagtgttgagattacaggcgtgagccaccatgcccagccttaatatatcttaaaaacatctccccaactagattataaattcctcaaggtcaaaaggtttatattctaaacctaagttaaaagaaagaaagaaagaaaaatgtatatattctatttctttggttttcctggaaggcctaacagttctacaatatttagtggaagaaattaaggaaggccaagtaccagctgcaaaggtcaacttaaatctcatggcaaggctctgtttccagcctaggaaaagcagtggtcttcctgtcccagccccacagggtcagcatcgctggcaggtggggctgtctccacctgaagcctgtctcctgtgcttgatggccataaagggatgctgcctgccaccaggcttctggaagaggtgagggaacaacctatcccaaaggatggatcttacagacccagataaattgctacaatacttgcctgcaccagttaactgtcatttctcttctcatatggaaaagggtgtcatcaagaataatccatggcaactgacaattagcaaatgctctctgcttgccttggaaatgtgttgttggtgttttcattggaatagggatgtcttcaacatttaggaaatccttcatttcccatggcagagaagcctgacttagaagaagaaagcaagctgtcacacctggtctgtcccctctgggtcctacctggctccccacttcatgcggggagtgaactgcctcacccctgaggaacaatgaaaaacatctgcccaggccaagcgcggtggctcctgcctgtaatcctagcactttgggaggccaaggcgggtggatcacctgaggtcaggagtttgagaccagcctggccaacatggtgaaaccccatctctactaaaaatacaaaaattagccaggtgtggtggcgggtgcctgtaatcccagctactcgggaggcagaggcaggagaatcacttgaacctggggggcagaggttgcagtaagccaagatcatgccacttcactccagcctgggtaaaagagtgaaactctgtctcaaaaaaaaaaaaacatctgcccaaggcagctctgcattcagggcagaacgctcctccctgataccaggaaataaaggcttaccaacccttttcttcttgtcactgctgggctggagaaaacctagagcctctgccaccaaagcagctaagcccagtaggtgagaatgtcaacaagaacttaacgtccagctgtatctgtatctgtagctgtcctgaacaaagagaatccagttgtccagagcacgtgtctgattgccacggatccttgcaagccctcagcgggacacggtgtccgtgctcattattctgctcatccacatctgggtgtctgctgtgtgccctgttctaggggacagctggagacttcaccacttcctccattagctcatcaaatattcatggagtatctaccgcatctgggctgcatctgggaccctaaagcttgcaggagcagtccctccatgtgacctcccccaccagctgcggagagatcctcagccatctttgggatgttcatttcattaggccacagctagttattcgggtcactagaatttccattcgagagggaagggcctgttggataggctctcctcagaaaggaccaatgtgtagctgcgggcagatgctgctgctgctgaacgcaaactgcaagctcctgaaagggactgttttcttttcttgctacgcatcacccaccgtttcttttcttttcttttgagacagaatcttgctctgtcagccaggctggagtgcagtggctcgatcttggctcactgcaacctccacctcctgggttcaagtgattctcatgccccaccctctgactagctgagattacaggcacaggccactgtgccggctaattttttgggtatttttagtaaagacagggtttcaccatgttggccaggctggtttcgaactcctgacctcaagtgatccacccacctcagcctcccaaagtgctgggattacaggcataagccaccgcacctggcctatacttttgaatatatgttctttttaaaaataacaagctgggtggccgggcacagtggctcacacctgtaatcccagcactttgggaggccaaggtgggcagatcacctgaggtcaggagttcgagatcagcctggccaacatggtgaaaccccgtctctactaaaaatgcaaaaattagccaggtgtagtggcactcgcctgtagtcccagctacttgggaggctgaggcaggagaatctcttgaacctgggaggcggaggtttcagtgagctgagattgcaccactacactccagcctgggcaacagaatgagactccatctcaaaaataaataaataataataatagtaaaataacaggctgggtgcagtggtccatgcctgtaatcctagcactttgggaagccaaggtgggaggattgcttgaggccaggcattcaagaccagcctggtcaacatagtaagaccccatctctataaaaaatttaaaaattagataggcatggtggtgcatgcctgtagtcctaactactcgggatgctgacatgggagattcacttgaacccaggagtccaaggctgcagtgagctatttttgtgccacagctctccagagtgagagcctgtctccaaaaataaataaatacatacatacatgcatacatgcatacatacatgcatacatacatgcctttcttttttttctgaaaacattgtaattgtaaagtttttctggttacatgataaagaataagtgtttcaattactgcaaagtttaatgaagaaaaaaactcgtccacaattggggaattttacttttctttatgcctctattttctaatatttctgtaatagatttacatttttttttgagatggagtttccctcttgttgcccaggctggagtgcagtggcatgatctcagctcactgcaacctctgtctcagtttcccaagtagctgggactatgggcgtccaccaccatgcccagctaatttttttgtatttttagtagagacggggtttcatcattttggccaggctggtcttgaactcctgacctcaggtgatccacccacctttgcctcccaaagtgcttggattacaggcgtgagccacctcgcctggcccagattgacatcttgtatatgtgtatttatgtgtgtgtattttaaagatcttcttaaaacgtgcatgtaaccccaacactcactgctaacactttggtttatttcctcccggattttctcacacacatctcgtgtggtgtgcgtccatgtgtttgtgtgcatgtgtgtatacatttttttaaaagatttgtgatcttgggaggtcgaggcaggcgaatcaactgaggtcaggagtttgtaaccagcctggcaaacatggcaaaacctcgtctctactgaaaatacaaaaattagccgggtgcagtggtgtgcgcctgtaatcccagctacttgggaggctgaggcaggagaattgcttgaatctgggaggcggaggttgcagtgagctgagatcccaccattgcactccagcctgggtgacagagagagacttcgtctcaaaaaaaaaaaagaaaagatttgtcattatattgtatatgcagttttgatgcttttttatattgatcgtattttcccatgtcatcaatttctttttattattattattattattattttgagacagagtctcgctctgtcgccagtctggagtgcagtggcacaatcgtgacttactgcaacctccgcctccgggattcaagcaattctcctgcctcagcctctcgagtagctgggactacaggcgtgcgccaccatgcccagctaatttttgtatttttagtagagatggggtttcaccatgttggccagatggtctcgatctcttgaccttgtgatccgcccaacgtggcctcccaaagtgctggaattacaggcatgagccaccgctccaggccatgagccaccgcatctagcctaatttatttttagaaacagtttttattgcctgcacggtatcccattatcttcatagaatgtcattagtccccattgttagaatgcccttgtaagcctttctatttttattttattttatgagacgaagtctcacgctgtcgcccaggctagagtgcagtggcatgatctcagctcactgcaacctctgcctcctgggttcaagcgattctcctgtctcagcctcctgagtagcgcaggtgcccactaccacacccagctaatttttgtatttttagtagagacggggtttcgccgtgttggccaggctggtctcgaactcctaacctcaagtgatccacccgcctcagcctcccaaagtgctgggattacaggcgtgagccactgcacctggcccttgtatgcctttctctgtatatatatttagagaagtgtctcttttttcatgcaagaatgtgtgtacctacaggcacatatgagcaaatatgtatgtttgtgtgaatgacagacagcacaggaggtctcctaagagtaggaatgatgttgagatgggtgagggggatggggatagtttatatcaaggatccctgtagtctcccacaggcagagtctcctgaggcagtaaagtcaggggcagtagaggactggaaggaattgagccaccagccaccgttcacagacaagaagggttaatgaacctgggctcgaatccagcttggccccctctgatggggcacacagcttccttgccactgcaccccccaccccgcccaggatgtcccctggccactctcctgaaacaactgaagaggcttcagcagggaggttggacctcagaccatcagggttcttgtctcttttcccttttggacactacagatcttttgctgtgccatcatgagtcggagatctatacaattaggggtgtctgggagcctctcagcagagctaagcccctgaggttactccagagggacacaatgggatttaggtgccatacatgttggtgtaaggtcctctgatcaaaagctagaatcttctctggaccacagtctgacacatcgttcttaggatcctagagtgacttcccttttatgccatagttctgggtgtgacaagcaactgctggttccctgatgttatgaataaagttctatggaaacacagccaggtgcattcatttacgtattatctacagctgcttttatactacaaggacacagtttagtagttttaacagagaggatatggcccacaaagccttaagtacaatctggctttttagaaaaggtttgctggctgggcgcggtggatcacgcctataatcccagcactttgggaggccacagtaggcagatcacctaaggtcaggagtttgagaccagcctggccaatatggcaaaaccccgtctctactaaaaatacaaaaattagccaggcgtggtggcactcgcctgtaatcccagctactcgggaggctgaggcaggagaatcacttgaacccgcgaggtggaggttgcagttagccgagattgtgccactgcactccagcctgggcaacagagcgagactccatctcaaaaaaaaaaaaaaaagaaaaagttttctgatccctaagtccaagattcatatcctcactttcaaaggccttcaatagacaattagatgtcttcattgctgtatcatctcttccatctgtttcactgtgcttactctaaggcttgaagactcttttgatctaatttactctccctcaccactattctcagatagtactgtgtcattgctaatactctcacccacagctaagtcttcccattctatcaaataaatatctactgaaatcccaccgcatcatgaaagctccctgaacatttggtggcttatttggggtgccctggaacacatcaggatcccctttctccagcagggtgaccactcagagatgcagcccacacattcttcagaaagctgtgtgttgtgtttccattccttctctggtttctttcttctctgaccttttcataggtcatatctcctttgaatgaacaccatcacaatctacatctctaacaaaagcagaacctacgttttcccaacagtttgacaggagattccagtgcaatggtaggagcatttccttggattttattgtagatggaatttggcctcaaagaaggcttgcccctcttccttctttttgtgctcttatggtgcccaatccaggtcagctcttcctctactgaaagtttatggcactaagcaatttattgctccttggagacctgtgataaaacattggagctggccacttaggaaactaggagtctttatttttggaaatctttttaaaaagaaaagattctgaagttattgctacttactatttggaactaagcaaatagcgaatggagaaatcaatggagcaaaatatgcctattctgtgagagtttaagataggataaatgtggcctcataagttgataaagaaaagctctttcattaaatagaacaaggataagttattttgggggaaaatggtttagatgaacatatcacaaaataaattaccgatggaataataaataaaatgtgtacaaaaccaagaaaatctggaagaaaatggaattgaatatttattgaacatctaaaaggagatagtttttttaggcaaagaaagaagagattaaatgaattacaaaagaaaagattaacacattttcatataaaaagttattataactaaaataaaaatacaagtaaatcacatgggaaaagcacacttacagcaaacctgacaaatagttaatatctgttctatgtagagctcattgaaaatagtaaaaacattagaatcctaaaagataaacaaagaacataaaaaatacactaaagaaaaatacagttggcgcattgaagtatgaaaaaatgtcaatgatgtaaaaataattatatatatatatatatctgaaagaaccttccatatcagtacattaagttttttgtttatttatttatttttttttgagatagagtcttgctctgttgcctaggcgggggtgcagttgtgtgatctcagctcactgcaacctctacctcctggcttcaagcaattatcctgtctcagcctcccgagtagctgagactacaggtgcatgccaccacgtcaggctaatttttgtatttttaatagagactggggtttcaccatattggtcaggctggtctcgaactcctgacctcaggtgatccacccacctcagcctcccaaagtgctgggattataggcgtgagccaccgtgcccggcaagtacattaagattttttaaataattgcatggtattccactgtgtgggtatatcataatttgtttgaccagcccctctattgatggatatctaggttatttccagtattttgtgattacaaaccatgtggcaatgtacaatatcctttgcacaatatgtttccttgtaaaaaataacattgcacaaataagagtatatcagcagagtaaattcctagaggtggaattgcggggtctgaagctatatgcatcataattttgttagctcacactagactgccctccgtagagctgtgccaagtgatgctcccaccaaccctgtatgacagtgtgggagtgacttttctccctcactttcaccaacagagtgagctatcaaattttcttatctctgagcaaaaaaatgtttctttaatggagctttaattttcttttctcttgggaatgaagctaagaatctttttatatatctaagaatcattgtatttctttttctctaaattttccattattttgcctgcttttcttttgagtcattagtctttttctcattaatttgtagcgtattttgggaaaatgagttaatttctgtgagttatcgtctatgggttctaaatttttttagcaagtattttgtttgccttttgactttgttttttgttttgttttgagacagtctcactccatcacccaggctggagtgcagtggcgtgatctcagctcactgcaacatccgcctccagggttcaggcgattctcctgcctcagcctcccgagtagctgggattacaggcacccgccaccacgcctggctaatttttttgtatttttagtagagacggggtttcaccatgttggccaggctggtctcaaactcctgacctcaagtgatcctcctcagcctcccaaagtgctgggattatggcatgagcaaccacacctggccagccttttgactttgaagaggcctgttttagaaataagatattgagggccaaagaaacacaattccttgtataaaaggcactcagcaatcctgcagcaaggccaaagtgaggcttaggccttgtaacccctagtccatgtgtcttgggttgtcagaaagcctcagctgtaacgtcttgggattgaggcaggtgacctcgcacttgtctaaaaagagaaaccgggccaggtgtggtggctcatgcctgtaatcctagcactttgggaggctgaggcaggcggattgcctgagcttaagagttcgagaccagcctgggcaacacggtgaaacctcgtctctactaaaatacgaaaaattagctgggcgtggcagtgtgtgcttgcagtcccagctactcgagaggctcagggaggagacttgcttgaacccaggaggcggaggtcacagtgaacagagatcgcgccattccactccagcccgggtgacagagtaagattccatctcaaaaaaaagaaactgaattagatttacatcgctcatcacacacagttttggtaattggatgatatgtattcattgaacacttactggcataaccaaactccacctaacctgggaacatagaccagttcctcttctcaatttcattgtctcgtccctggcaccaccagttatcccccggtcagtctcctttgaattcatttactcttcttttctccttttccttcacagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaaggtaatggtggcaacaagcttcatgctcaggtatgcatgaccccttctctgtgaaagaagactgcagaggggtctgggtggagaatacatcactggcccctctcccacctgtgttgctgcaggccagggggacacagtgaagccagcaggctggaatatccggaccttcgtcctgatcatttttgtggtcctgtggtcttcctcttagccactcttctcccaatcttagctgcttgtctaatcccagacaaggttttaatgcctatcctcaaaaagccacagctccttccttcaccgccacaaaaaacagaactccatccatcatgctctgacctgagacggtcgacacccgctgcagaggcaggtcccagtctgtgctctgagacagccttgtcaacaatacctcttgtggctctttgcagccaaaaaggtaaaatattcccaggggcttggaaatatacattctatatgcatccgttgttggttacatttccttttgctcaatttcagtgctgcagttctggtctctcttcattgaccaatttggtactgtagggtaggcagaatttctcctctaccctcttagggtctccagctgagccttagatttaaactgacgtaaaacagattaacaggagaaatgcatactcattttatttacaagtacgtgggagccctcaaaagaaaaatgtaagacccaaagaagtgactgggcctatgtgcttatatactaggctgaagaaagagcggcaattgtggaaaagtaaccaggaagataggggttaaacaaggtttgtttgattagatttctcttggcctcaactccccatcgctgctgataatgtttcttccctcctgttataaggagggcctcttttacatggagtttcatctcctgttttaagaagaaaagggaaggtcagagcgccctttgtgcacctgctgtttttagagtgtctttagttaaaaacaactaatatgccaaagtggcatattttggggagttacatcctgaactccttcaagatcaacttcttttttttttttttttttttttgacagagtttcactctgttgcccaagctggagtacagtggtgtgatctcggcttactgcaacttccgcctcctgggttcaagcgattctcctgcctcagcctcccgagtagctgggactacagtcaccacacccagctaatttttgtattattagtagagacggggtttcaccatattgaccaggctggtctcgaactgctgaccgcgtgatccgcctgcctcagcctcccaaagtgctgggattacaggcatgagccaccgtgcccagccaggaacttggagagcagggattcttaatttcagagttcatggatgggctttagggggtcatgaaacccataaaaatgtaaaactttatgcagataagtttcggtgtgggacactgtctgtagctttcaagggacttctctgagtgacccattgacctgaaagaaagtccagggaggctgggcacagtggctcacacctgtaatcccagcactttgggaggccaagataggaggatcactttagcccaggagttcaagaccagcctgggcaacatggtggaaccccatctctacaaaaaaaatttaaaattagccaggcatggtggtgtgcacttgtagtcccagctacatgtgaggctgaggtgagagagaatcacttgagcccaggagttagaggctgcagtgagctatgatcatgccactgcactccagcctaagtgacagagcgagatgctgcctctaaaaataaaagagagacagagagagagagagagagagagatggttctgctgaagtccacttagggaatgcacctttaagtagtggtgcctactgagtgactcaccttggcagcactaggagaggttatgaaaggacttggcaagtctgaggacagctaagaactgtcatcctagaacctagaaagttagactgttggaaatatctcaggtaagtggaatcacacagaatcgtcctttgtgaatgacatttcactttgcttagtgtcttcaaggtttaagcatgtgtcagcattttcttcttttttaagactaaatggtattccatcgtatgtatataccacattttgtaaatccatctatccgtccatggacacttggctgttagaaagttggagtgtttcaacagaagtgactgttgaaacactccaaccccttcattttcccgatgaggacatttgaccccatagaagccaactaaatggcccagagacacccaaccagctagaagcaaagagggccagacaatgtttaaatattgaaaataagaattgaaatattcaagccaacacggtggctcatgcctgtaatcccagcactttgggaggctgaggtgggcagatcacttcaggtcagaagttcgagaccagcctggccaacatgttgaaacccccgtctctactaaaaatacaaaaaaattagctgggcatggtggcacacacctgtaatcccagctacttgggaggctgaggcatgagaatcacttgaaaccgggagtcggaggttgtggtgagccaagatcacgccactgcactccagcctggtgacagagcaagactctgtctcaaaataaatagataaataaaatatttatagaacatggaaattgattaccatcctatatttttgtttactgacctatacagataaaagtgttatataacatttaacatatagctgtgagataataagattaattttgtaagcacacagaacaactaattttagagttcctccacgtgtgggattctgaatcacatatgccatgagcgtgtactctttgatagcaagccctgggggacccagcaaagcaaaatacataaattcgcactcaccagcttctcacgcaagaagagggaaaacaaatacataggaaacaccaaacttttttggtctgaaatatgaaaaacattttccatggaagcaggtctcctttcaaatgcatcagacaactaggctggcctgggaggtggggaggggcagggcacagggcgtctggcagtggtgatgggggagaccacataggctgagtggcctgcttggaggcttgggatgtgtcccacaccagggtatccatgtgcacttgcacactgcatgtgtgtgttctgtgaacacatggagggtacatgacatctggggagcgtgtccctctgcagatggggctgcacgctcgggtgcatggcaccactccccgtagtcccaagctagggctcgggagcagttctaatcccggttctcaccccactcagggctgctctgacattctttggaatagttcccatgaagggagccctgcctgggaactttttttttctgtctcttccttttcttgttttgttttgggaggaaaagctccttcccaagccgcagtgacatcgaggcctcagagggaaagcagccatcgcatcatgagcaatgggctgtctccccatgggtctctgctgctcgtgagcagatccagacaacagacgcccatagggcagtggagctggcagcctcctttagtgtccttgacagtcacgttcctgtgtggtagaaaaaaatgactgggctgggtgcggtggctcgcgcctgtaatcccagcattttgggaggccaaggtgggtggatcacctgaggtcaggagttcgagaccagcctggccaatgtggtgaaaccccgtctctactaaaaatacaaaaattagctgggcataatggtgggtacctgtaatcccagctactcaggaggctgaagcaggagaatctcttgaacccagaagttagaggctgcagtgagctgagattgcgccattgcaccccagtctggtcgacaagagcgaaactctgcctcaaaaaaataaaaaaaaaaaatgattgaaagacacccatgagcccatgggaagtttctcccactccccctggccctggccctccatcgtcctaggagaggggcagtgagggaagcccagctgccacagagagtgggctgctaacactggctgttcttctcctggtgtctggcagctggtgttgcgaatcaacgccatttatgaggtccggagaggaaagaaacgggtgaagaggctgtcccagtcaatggagagcaactcaggaaaaggtagaacccccaccaccagccctcctcccgcaagaatcggaaaagagattctttccagaagtggcttcctgttttttctggttggctcaccaaggaggagaacaagctgatgctttgtaaatgtcccgcactgtctttgggacagtggtggggctgggagctcagccggggcagcatgtcccctgcctccccatccttgtcctggtccaccaccaagtcagcccagtactgcaggccctggcctgactgtgggagcagccttccttgcttagcctgcacaaaaggggccaggaccttctgttgtattatctgatataggtaccatctagtaccatctgaactagagccaaattaatttggcagtacatcgagttggacgagacgtggtttgtgcaatacattgaaagagacaacaagaggcggggcgcggtggctcacgcctgtaatcccagcactttgggaggctgagacaggcggatctacctgaggtcagaagttttataccagcctggccaacatggcaaaaccttgtctctactaaaaaatagaaaaattagccaggcatggtggcatacacctgtagtcccagctactcaggaggctaaggcaggagaatcactggaacctggaaggcagaggttgcagtgagccgagattgcgccactgcactccagcctgggtgacagagcaagactccatctcaaaaaaaaaaagaggcaactcaacatcccctctgaattagaacatttgatctgtgctaccacatagaaagagtttcctacatgagaagaactcacatttgcaattttcttccttgttcttttcttctagtgacagatgagaacagtgagtctgacagtgacacagaggagaagctgaaaggtgaggagagccactactgtgcaggactcaggcaggtgacttggaagctgcaaaggtggcccctcctccttagtatgagggacagaagcgtcctgccggagcttgcttggcaaggcgtggacatctcgggagacagtggggccacagggtgctccagagccggtccgtcatgggcatgatcaaaatggcactacagttgctgagagccagggtggctgcagtaacggcagcgacccctgctcccatgcctctccctatgtcctgagggttttccacacttcaaggcttgacactgcagccctaagcctccagagacctggagcttctgcccacttctgctcaaattactgtgtgatctggaggaaatcacttaagatccagggcctctagttcatctgtctgatgaagttgttgaaataattggtccctatgggtctaaaattaaatagtctaggccaaggctttagtgagttttctgcaatttttcagaccccagggagaagccaaagaaagcaagtccaggggccgggcttggtggctcacgcctgtaatcccagcactttaggaggccgaggcgggtggatcacaaggtcgggagttcaagaccagcctggccaacatagtgaaacctcgtctctactaaaaatatgaaaaattagccaggtgtggtggcaggcgcctgtaatcccagatactcaggaggctgagggaggagtatcacttgaacccgggaggcggaggttgcagtgagctgagattgcgccattgcactccagcctgggcaacagagtgagactctatctcaaaaaaaagaaagcaagtccagattgctgaacgaggtgacagggacctgtccactcagtgaccctgctgcattcacctctgacacccagctgctcccggactcacctctagaatgaagcaaggccatttcattgcagagttagtggcaggaggggaggtggacaggagttcctgagttagtgggatctctgccagttgagtcacaagggatgtttacaaagctcccagctccaaaagccctatagtctggattctgtcacatcacaccaaccaaaagacgagggaaatgggtgaggggaggagtcactgtccccatctcatcagacagatgaaggcaaggacatcttcagcctctgcccagagtccagacagcaaaaccatggcagagcagagccaggctcctgcaccctgattggtttggtagccaactgaatgttggttctcccagaactttggcagagatcccaaataaagagtttcctactaatttgttagacacagaaacactttggggattagaaaaaagtacttgagctgataattacataacctattgcagctcggcacaattccacatggactcatggtcatttcaggctctttgctcactctgtctctctctctctctctctctctctctctctctctctctctttctctctttctctctccctccctcacccagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaaggtaacagggtggccaggtccctgtggcctgccagggttctaaccatcaccttgttgggactcatgaattgagggaggtgtgggagtctgaggaacacctagcatctagaatcttgaaaatgggtcctaattagggtatatcagatgaaaaaaaaatgctgctgctagagaatttgggaggtcccagaaaggagagattcagggacttaaaaagtttggccagacaaatacaaaaattagccatgcatggtggcgcacacctgcagtcccagctactcaggctgagacaggagaatcgcttgaacccaggagatggaggttgcagtgagccaagatcacgccactgcactccggcctgggcgacagagcaaaactccgtctcaaaaaaaaaaaaaaaaaaaatagtatggccagaaatgctttctcacttgctgtggtccctgtgctgaccgtgccatcctctttgccctttccttccatctccttatccagccagccacatctcttcctaacctagcctagaagtctctttcccctgaagccccaagtctccctaagcagcatcatacttgtgtctatgctgaacttctgctttgcttgtgtgctgtgcatctttgtgtatgtcccttccttttgttacaggcaggggatctcaatccagacctctagagagggttcttggatctcacacaagaaagaattcagggcgagtcagcagggtaaaatgaaagcaaatttattaagaatgtaaaggaggccaggcgcggtgactcacacctgtaatcccagtactttgggaggccgaagtgggcggatcacttgaggtcaggagtttgagaccagcctggccaacatggcaaaacccactctctactaaaaatacaaaaattagctgggcgtggtggcaggcgcctataatcccagctactcaggaggctgaggctgtagaatcgcttgaactcaggaggcagagcttgcagtgagcagagattgcaaaaagtaaaggaatgaaagaatggctactccatagacagaacagccctgagggctgctggttgcccatttttgtggttatttcttgattatatgctaaacaaggggtggattattcatgcctcccctttttagatcatatgggataatttcctaatgttgccatggcgtctgtaaactgtcatgatgctggtgggagtgtagcagtgaggactaccagaggtcactctcatcaccatcttggttttggtgggttttggccggcttctttactgcaacctgttttatcagcaaggtctttatgacgtgtattttgtgccgacctcctgtctctgctttaaccatctgggaatgcagcccagtaggtttcagcctcattttacccagcccctactcaggatggactcgctgtggttcacacacctgggacacttttatgtcatggaccatggccgtatgaattcagctttaccatatgttaaatcatggcacctaaaataaaataaataaaatggcacttaatatagcctgaagcaacatggcaataatttataaattattcttaggctttgacatcagtattaaagaggttccaccatattctaattcagttcaaccagaatttactaagaatatattgcattcaagcaattttctgcttggccctaggggattacagtgataaacaaaatgtgtctcctgtcctcaaggaatttaaactctcccaggaggacataaaataaccatctccccccacccccagaaaagcatgcaaagattcaccaggtagaatctgatggtctctggacagactcatgcctcagggagggcagaagggagggagcttctgtccttgcccactcagggactccctttgccatcaccacccaggcataaccccagcatctaccaaggcccagatcctgctgtccccaggcctcccctccttttgtaggccagccttccttccatcctgcccactgtgctctaacaccacaatcaagtcctatttttggagtttaggatagcaattatgtagattgaagtaaaccataggcaccggccttccaaaggtgacactcaccttcctctagctatcacacctctaaggaatgagctcctgacaccccactactacaggtatgcccagatttttttttgccgggggctgcccatgggtaagagaggccactgggtatgctcacactgactcacaacagagatcactgaggcgtgaagggctgtcctgctatcctgttcattgccttggggcctagcacaatgctgttcacgtggcaatgcttaatcagtgttgtaggaatcaaggaagcattaattcatgagttagttaattaatgactcaccataatgatcaaatgattattgtttccagcctggagtcacccacattaaattttttttctagagtaaagttgcacattcactgtttaaaaggaaactgatccagaaatgtattaggaaagaaatcactagtaatcccaccacacagagaccgtcactgttaacattttctttttcttccagtcttttctaatggtgtaatgttcttacaaaactggaattatacactgcagaatttttgtatcgtgctgcgtgtactcttttgtaaacctctcattatttataagcatatttaataaaaattctaaaacatcatttttcaagttatacaatgttccaatatgtgagtattccctagtctatttttctatgtaaccagtccccttctgttagaaatgtatctggctaccagtgtttctgtgtgtgtgtgtgtatttttttttttttttttgacacagtctcactctattgcctgagctagagtgcagtggtgcaatcttggctcactgaagcctccacctcccgggtacaagcagttgtcctgcatcagcctcccgagtagctgggattacaggcatgcaccaccatgcccaactaatttttgtatttttagtagagatggggtttcaccataatggtcagactggtctcaaactcttgacctcaaatgatccgcccacttcagcctcccaaagtcctgtgattacaggcatgagccactatgccctgcctgtgtgtgtatttttgagacaggatctctgtcttgctgttgtcatccaggatggcatggagtggcacgatcacagctcactgcagcctcaacctcctgggctcaagtgagccttcccgcctcatcttcccaagtaactgggactacaggcgcatgcaaccatgcccagcttatttatttatttatttttcgtagagacgaggtcttcctctgttgcccaggctggcctcgaattcctgagctcaagcgatctccctacctcggccttccaaagtgctgggatccactgtgcctggcttttttttttttttttttttttttttttaatgcaatggtgatcatccttgtacaggcatttttacatgtcaggcattttatctccttgtctttgctcccttgctccctctgtagaaaggcccttttcctccttctctctcttctctttttaaactttttttgtgggttttatccctcacttctgtcaagtcacctgaatcaaggcacagcccctatttgcatgctaatgttccattaaaatgtttcctatcccatatttatctttgacagttcagggagactgggctgttttccagccatctgtgattagttgtatttgtgggaaatttccgtgtgcagcttcctgtaactgtgctcctgtgcatatatgagcctgtgtatgtatgcgctgataactcgtaggttgatgacgtgtgggtaggcacaagtgtgcctgtatttgtgtgtgtcctatgtgtgatctggggtgggtgcatgcaagtagtgactgggctgttgaaaagggctggaacttgtttccccacgaggtctgctcttcagtcctgaatgctgtttcctttgtggagaaactcatttggtattcttcctccctttggtattcttggctggtcctttctttggtcttctttataatttaagtcattcactctgtggtgattaatgaccccttcctataattacacccagctggtatttgcttctttgcatgactatgcaaggacagtcaaaattactgtttaggggacagtctgagcttgtgatttaccaactcaaagacttcctgggccagttgggttcatctgtgtcatcgtggatggaagagagaactgttatatagaaaagaaatagtggctatttattctgaagaagaacaactaaaggacaactaagtctataaatagtgactgtgttttaccgattgattgctgtcttaaccactagtattagtggcaccccatggcttcaattaaatttggtctagcctgaggggaatcatactggaagcgggtttttttgttgttgttgttttgtttgtttgttttgagacggagcctccctttgtcacccaggctggagtgctgcggcatgatctccgctcactgcaagctctgcctcccggattcacgccattcttctgcctcagcctcctgagtagctgggactacaggcacccgccaccacacccagctaatttttttgtatttttagtagagacggggtttcaccatgttagccaggatggtctcgatctccagacctcgtgatccgcccgcctcagcctcccaaagtgctgggattacaggcgtgagccaccacgccccagccaggaagtggtttttaaagttggaaacaatcagtctggtgctctgtgcctttggatactcttcttcagagccctcctctctctgacacatggtgaccttgggaaggcttgttgaccatcaggagcagtgaacaggactgctggcttgccaacttcagaaattgtctgcaagggtgttttaaagtggagctcgggccgggcgcggtggctcacgcctgtaatcccaacactttgggaggccaagtcagggatcacttgagatcaggagttcgagaccagcctggccaacatggtgaagccccgcctctattaaaaatacaaaaattattcaggcgtggtggcaggcacctgtaataccagctacttgggaggctgaggtaggagaatcacttgaacccaggaggtggaggttgcagtgagccgagattgcagcatttcactccagcctcggtgacagagcaagagtccatctcaaaagaataaataaataaataaagtggatctcactagcaagctattggaaacaaagaaattgatgcaaattattacagaaaaatttaggttagggccaaacaccgtggctcatgcctgtaatcccaacattctgcgaggctgaggcaggcagatcacttgaggccaggagttcaagatcagcctggccaacatggtgaaaccctgtctctactgaaaatacaaaaaaaaaaaaaaaaatagctaggtgtggtggtgcatgcctgtaatcccagctactcgggaggctgaggcaggagaatcacttgaacccatgacgcagagaacccatgcagtgagccaagatcacaccactgcactccagcctgggcgacatagtgagactgtctcaaaaaaaaaaaaaaaaaaaaagacaacagaaagaaagaaaaaatataggttagccattatatttaggttagacgttataaattcctaacctcagatattcagatatgagatatttcaaatcactgaagataaccttagcatgatgtatttttctttaactttttataaaggaaatttaacaagtataaacctattaacaacaacagcaacaaagcctacaattctcctcacatgaaaaagtacctgtttataagcaaagatgaataataatgagataaataattagaaattattcttttgtgtttcccaaacttgtatctggggtgcttcttaaaagcacagatttctggctaggtgtgatggtatgcactcgcagtcccagctactcaggatgctgaagcaggttgcttgagcccaggaattcaagtccagcctgggcaacacagcaagactctggctctaaaaaatatatatttatacatagaaagaaaaaaaatcacaaatttctgttcataagcaaaataaactcacgactttagtatcatctctaaatcagactttattaattcatcctgtccttttttttttcttagcgtcttgttctgtcgcccaggctggagtgcagtggtatgctctcggctcactgcaacctccacctcctgggttcaagcagttctcatgcctcagcctcccgagcagctgggactacaggtgccggccaccacacccagctaatttttttgtatttttagtacagacggggtctccccatgttggccaggctggtctcaaactcctgaccccaggtgattcacccacctcagcttcccaaagtgctgggattacaggtgtgagccaccactcccggcccttgttctttttttttttcccatagaggtgggaccttgctatgttgccccagctggttttgaattcctggcctcaagtgatcctcctaccttggcctcccaaagtactcctcctgttctttaacaagataacattcatccagtctttgatatgtcagatactgtatgatgtgctagaatatcataaagagagagagagaggaaaaaaagattaagatcatttttcttcctagtttgaacattaactcatgtgaccaggacacatcacttcacacctcggggcttatttccttcttgctgaaataagaatgtcaggctggatggtgtcacgcttccttctagttccaacactcaatgactgtctgaaattagttgaatttcccagcataatatggttttactggatttattcactgagaatgttgtaacagtctttgcctggagttcgaaagggacagctttgcctggacccagagacagagaggcctgattagaggctctgccttccagattcctgagcctcctatttggaaaggattgctggcagtttttttaattcactgaaatagttacattctagaatgtcaagcatagagaatcattctctaaagcatcctattttttcctcccaacttctcccagaggtctatagttggaagtgcactggggggaaaatgccccagccgactgagctgcaagctcttcccaagggaagaggctaaggcggcagtcacaaatgtggaaaggtgggagaggccatccttaccatcatccgcctcaatttcccatgctgagatttgttctcgaattttctctcacctttctccctgcagttggaaaggtctttcaagttcatgagagaagctgaggaccaactgaaggccattccccagttctgttttcccgatgccaaggattgggttcctgtccagcagttcaccaggtacgagctggcttctccccttcgcagccccaaagactaaggcgagacttagagacggggttacaggtggcagaccacatgagtcattcccaccgttaagtaatcctgatgggcctggcctagagctttccccaaggggtgtttttaaagcttccctgaaggtgaagtcacctgcccagcatgcagacctcccgggcttcccactcaatctggggatacttgtttcagaagcctcccggaagataattcttagcctgggaaaagttagggcaacattgcccttccccgttctcatcctgaaacatctcttcagtctcctatccagatgtttcttggattgggatccgtttacatttctgcttcatcccgagtaattagacaccagtgtttttattatcagatgtttccgcatttggccaaactcagtaggctgcgggtcctgtctttaaggggtaccgcgttccttgagggtggctcagcagtctttaaggaccgtccaagccccggggctgccctgtacagaccatgccctgagagagctgccccagggcaattccaagaggggcacagaactgtccccatcttccgctgctccctcaccgagtcacatccctagatgagcagatgtcactgcactcacacatgctcagttccctgaggacagcaccccaggctcttccctctctttagcctccagagtaaatgacagttgtgttttgtacaatggggcagctcaggtgattgaatgatgggagagcccttagctaggcatggtggtggcaggcgctggggcaggagaatcgcttgaacccgggcggcagaggttgtggtgagccgagatcacaccactgcatcccagcctgggcaaccgagtgagactccatcttgaaaaaaaaaaaaagagaaaatgacaggatagcccaggatggaaacaaagcaccacattttgtctcaggccacagcgacactttaggtctcagtctcactgacttttttttttttttttttttttgagatagagtctcgcttcttcccccaggctggagtgtaatggcatgatcttggctcactgctacctctgcctcctaggttcaagcagttctcctgcctcagcctccccagtagctgggattacaggcatgtgccaccatgcctggctaatttttgtatttttagtagagacagggtttcaccctattggccaggcgggtctcgaactcctgacctcaagtgatccacctgcctcagcctcccaaagggctgggattacaggcatgagccactgtgcccagcccagtctcactgacatttactatgaagctatgggtgaccagtgtctcagcatggacagggacaggtgggacagggagtggcctttcctacagcctcctgcagtgtgtcccatggctgctcactgccaccccttgctgcagagtgatgaggtgtctttggttttgttttgctttatgatacatttgtgttttcccaaccacagtgaaacattctcatttgtcttaactggagaagatgggagcagaaggttcggttactgccgaagactgctggtgagtacattctgctttcagcctgcaagagcctcgtggacttcctagtcctggtgcaagagccaggtctggcttcccagtcccgtgagactgagattccctgatgaggcacaggaggagaaggagcagggggagtggcaggtgaatcagcatagttaaaatcacagaaaaaatctggcatggtggctcatgcctataaacccagcactttgggagtatgagaaggacagatcacttgagaccaggagttcgagaccagcccgggcaacaaaatgaggccctgtctctattttaaaaatatatacggccgggcgcggtggctcacgcctgtaatcccagcactttgggaggccgagacgggcggatcacgaggtcaggagatcgagaccatcctggctaacatggtgaaaccccatctctactaaaaatacaaaaattagccgggcatggtggcacgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaatatatatatatatatatatatactaaaaaataaaacattaaaaaaacaggaattgagggggctcacctgagtcttattggtaggtgggaatgtccgtttccatcagaaagaaaatacttttatttcattttgagacagggtctcactctgctgcctgggctggagtgcagtggatcatgtttcactgcagcctcgacctccccagctcaggtgatcctcctgcctcagcctcccgagtagctgggaccacaggcatgtaccaccacacatggctaattttttaattatttgtagagacaggatcttgctgtgttgcccaggctggtctcgaactcttgggctcaagtaatcctcccacctcggcctcccagtgtgctgagattacaggcatgaaccaccgcaactggacaaaaatactttctccattatttttcctgccaaataaaagacctttctctctttaagcgaatttttttttttctaataaaacatgccaaacagaccctgatcacttagagagaacattcagaatggttgctaaggagagaagactcaaataattcaagaatgtccccttcagaatagtcacctttcaaagtcagaaacttatttcagtgcaatgatcctgctaaagcattttagaattgtcattttcaggcccattcttttgaaaatcttcagtaatggtgaatctttttccactgagaatatacttgagtctctgaaataggctgaaaaactttagggtcaagtataatgcgtggcacatagtaggtgttcaagaaacattttttgaattaatcagtaaaataaaaagcatggataattgaaaaaggtaagtgagataataattttgttgatcaaattactttagggttaaagtattgagactgaggtcgggcacaggctcacaccagtaatcctagcactttgggaggctgaggtgggcaggttgcctgagctcaggagttcaagaccagcctggccaacatggtgaaaccctatctctactaaaaatacaaaaaaatagctgggcgtggtggcacacgcctgtaatcccagctattcgggaggctgagtcacaagaatctcctgaacctgggaagtggagggtgcagtgagctgagatcgcgtcgctgcactccagtctggacaacagagcaagactccgtctccaaaaataaataaataaaaatttttaaaagtattgagattgggcagggtgcagtggctctcacctgtaatcccagcactttgggaggaggaggcaggcagatcatgaggtcaggagttcgagaccagcctggccaatatggcgaaaccccttctctactaaaagtacaaaaattagtggggcgtggtggtgtgagcctgtaatcccagctacttgggaggctgaggcaggagaatcgcttgaatctgggagctggaggttgcagtgagccaacatcacaccactgcactccagcctggtgacagagtgagactccatctcaaaacaaaacaaaacaaaacaaaaaaagtattgagattgatttttttttgtttgaaaattagcttaaaactgagttttcagaaagatcttcagaaatgatttctcacttgaaattatcattataataaacatatagggatacaaaacaattataacaaacattataataaacacaatgggataacaacttactttattgggttttccagagctatgatatgtggaaacatctggcacatgatagtctcgcaaaaaacatgtgggttcctttcttccctgaggttgtcaacactcataattcccttgtgtttctctccgaaaagcctggaggcaaagggaagcgccttcctgaagtttactgcattgtgagccgcctgggatgcttcagcctcttttcaagggtgagaacttggacctcagagaaagaggaagggaaggaacgggagggctctagagggctccagggaatacccccatgtcctgggccttctatcatcttattctctacctacttcccttcccatttcttcactcctctcctcatcacccctctattctctcaccattggttcaggaaatgagagttgataggcccggtgtggtggcggggtggctcatgcctgtaatcccagcagtttgggagtctgaggcgggcggatcacttgaggtcaggagttcgagacaagcctggccagcatggtgaaagcccatccctactaaaaatacaaaaaaaaaattagccaggcgtggtggcgggcgcctgtaaccccagctactcaggaagctgaggcaggagaatcacttgaacccgggaggcggaggttgcagtgagccgagatcgtgccattgcactccagcctgggtgacagagtgagactccgtctcaaaaaaaaaaaaaaaagagttaatgaagagccaggttcagaaagtgtgtgtggtgcagggatggcaagataattgaagttgagaaagggaggggtggaagaccctcccagaatattccaggtgttttatttttcttcttctgagaattgccttttgtcatatgagctttggcgtgaaaaaaggctactgtaatagatggataggtgtgtacccacgtacatatgtgtcatgtatatataacagttttgtggaggggggattaattattttaatagtgctctaagtttatcaaaatattcatataatttggtcttcttttctggaaaatgagccaacatatgaacgcataggaattgccgtattgaattagctcatctaccccggtattctggattggtatataggagagaattactatcctatatgatgctgatctcaaaagctaggtataatccaacatcatttcctgtattaaccagacatgagtgtctaattcataattttttttctttttttgagacagagtctcactctatcacccaggccggagtgtagtggtgcgatctcggctcactgcaacttacacctcccgggttcaagcgattcttgtgccacagcctcctgagtagctggcattacaggcgcgtgccaccacgcctggctaattttgtatttttagtagagatggggtttcaccatattgcccaggctggtctcaaactgacctcaagtgatccacccacctcggcctcccaaagtgctgggattataggcgtgagccaccgcgtctggcctaattcataaatttattttcaatccttcttgagtatatagctctgtctgagctttcttttggggaattgaagttcctgcacctacggtccatgaatgttaaagcagtactccctaaaagcattttttttttttgagacggagtctcgttctgtcgccaggctggagtgcaagggtgcgacctcggctcactgcaacctctgcctcctgggttcaagcaattctcctgcctcagcctcctgagtagctgggactacaggcacatgccaccacacccggctaatttttgtatttttagtagagacggggtttcaccatgttggccaggatggtcttgatctcctgacctcgtaatccgcccacctcggcctccctaagtgctgggattacaggcacaagccactgcatccggccccttgtggggaaaagaaagagagatcagactgttactgtgtctgtgtagaaagaagtagacataggagactccattttgttctgtactaagaaaaattcttctgccttgagatgctgttaatctataaccttacccccaacgccgtgctctctgaaacgtgctgtgtccactcagggttaaatggattaagggcggtgcaagatgtgctttgttaaacagatgcttgaaggcagcatgctcgttaagagtcatcaccaatccctaatctcaagtacccagggacacaaacactgcggaaggccgcagggacctctgcctaggaaagccaggtattgtccaagatttctcctcatgggatagtctgaaatatggcctcctgggaatggaaagacctgaccgtcccccagcccgacacccataaagggtctgtgctgaggagcattagtataagaggaaggaatgcctctttgcagttgagacaagaggaatgcatctgtctcctgccgtgcctgcgcaatggaatgtctcggtataaaacccgattgtacgttcgatctactgagatagggaaaaaccgccttagggctggaggtggaacatgcaatactgctttgtaaagcattgagatgtttatgtgtatgcatatctaaaagcacagcactttattctttaccttgtctatgatgcaaagacctttgttcacgtgtttgtctgctgaccctctccccactattgtcttgtgaccctgacacatccccctctcggagaaacgcccacgaatgatcaataaatactaagggaactcagaggctggcgggatcctccatatgctgaacgctggttccctgggtccccttatttctttctctatactttgtctctgtgtctttttcttttccaagtctctcattccacctaacgagaaacaccaacaggtgtggaggggcaacccaccccttcacccctaaaagcatttctataaaaaagccttcctcctgcccaccctccacctaaactcagaggaaacctgaattatacaaacatagtacaatctcttcccatggtagaacttgtacttctctgtaaatctgttagaaagaattaatgcctggtcaggaggctgaggccagtagatcacttgagcccaagagttcgaggctgtggtgagctgtgatcgtatcactgcactccagcctgggaaaactagcaagaccctgtctctaattaaaaaataaaacacaaaagaaggccaggcgcagtggctcacagctgtaatcctagtactttgggaggccaaggtgggaggatcgcttgagcccacgagttcaagagcagactaggcaacatggtgaaaccctgtctctacaaaaaatacaaaaaaattagccaggcatggtagtgtgcacctgtagttccagctacctgggaggctgagcggtgggaggattgcttgagcctaggaggctgaggctgcagcgagtcatgttcacaccagtgcactccagccttggcaatatagtgagaccctgtaaagaaagaaaagaaaaagaaagaagaaggaagggaaaggagagggagagggagggaggaagggagagagagagggaaaggaaggaagggaaaatgaaagaagggaaaaagagagaaaaagaaagaaagaaaatgaatgctatcagtgtaatctgagccaaggtctcccctcccctccaccagaagtgctcatcactttatgttggggttggccattggcaaggtctagcagactaggcattactgctcaggccaggctttcatgtgatttgtttacatgtgaagtaaggttataggtcatagcctttgttgttgtcagaatgcttatgaacaccagaagtaaaacagctcatgtgagttaggccagcttccaagtggaggctttgaagttcacgtaagcttcactgctgtcatgggcaggggacgtggagccagtaaatgtgctaacatatttctgtgatgcacagtcctttgttttcatgtctgttttctgaccagggatattttaggagtgcagtgtaatgacttgccgaagaccacacagcagttattcaggacagaaccagaaccagagctttagctaactgatcccaggaacttgagctatttctaggcgtggagcaaggatggccaaaatgcatattgtcctttagaacagaaaggagtcatggagaagaagagcaggtctcagaatttctgaagaaaagggtatcagttaacaattgctatagtaatactgtctagtgaaccacagaggcttcaagattcaatcatttgttctcccagctgtgaggtcagctggggtttgggcttggcaagtattgtgaagaggctgggttggctgattgaggctggtctagctgctctagaggctacaagtctgggcgcaggcctggtccacatgtctcccatgctcctagacagtgagatggcccacatgtgctcttctcgtggcaatggcagaggcacaaaagggcacacaaaacacgaaggcaggcctcctaaggcctggccagagaacccgcatggcaacgcttctgcctcgttctgcccagtgtcccaaaggctttttttcttttcctttttcctttctttttttttttttttttttttttgagatggagtcttgctctgtcgcccaggctggagggcagtggcgtgatcttggctcactgcaacctccacctcccaggttcaagtgattctccttcccagcctcccgagtagctgagattacaggagcccgccaccacacccagctaatttttgtatttttagtagagacgggatttcaccatgttggccaggctggtctcgaactcttgacctcaggtgatctgcttgcctcggcatcccaaagtgctgggattacaggcatgagccactgtgcccggccacaagcttttttttcattactgtccccctaagcagccttttcaggtgtgttttccctaactgtctcccccaaaattctttttatttttgttcatattattgtctttttcttgtgctaaaatatatacataacaaaaaatttaccatcttaaccattttaacagttcggtgccattacactcacattgttgtgcaaccatcaccaccatctatctccagagctttttcatctcccccaacagaaactctgtacccattgaggccaggcgcggtggctcacgcctgtaatcccagcactttgggaggccgaggtgtggatcacctaaggtcattagttcaagaccagcctgaccaacatggtgaaacccgatctctactaaaattacgaaaattagctaaagctggatgaagtggctcacacctgtaatcccagcactttgggagactaagaggggcagatcacctgatgtcaggagttcaagaccagcctggcaaacatggtgaaaccccatttctactaaaaatacaaaaattagccaggggctgaggcaggagaatcgcttgaacctggcaagcagaggttgcagtgagcccagatcgcaccactgcactccagcctgggcaacaacagcgaaactcaggctcaaaaaaagaaaaaaattaagtgagtgtggtggtgggcgtccgtaatcccagctactcgggaggctgaggcaggagaatcgtttgaacctgagaggcagacgttgcagtgagccaaaatcatgccattgcactccagcctgggcaacaagagcgaaactctgtctcaaaagaaaaaagaaactctgtacccattaaacaatagcttcccattccccctcccctaaccccacccctaaccccacccctatcccctcccctaacccctcaccatcgccattctactttctatttttatgaattccaggattctaggaatgttacagaggtagaacgatcaacagttgtccttttgtgactggcttcgattcacttagcataatattttcagggttcactcatgtcgtagcatgtatctgtacttcattccttttgtggctgaataatattccactgtatgtatgtacaacattttatttatccatttatccattgattgattatttatccatttatccattgatggacatttgggttgtttccacgttgtggccattgtgaattattctgctaggaacataggtgtccaaataaatatctattcaagtccctgcttcaattcttttgggtatacacccacaaatagagttgctggatcatatggtcattctatttagttttttgaggaactgccatactgtctttttaattttaataataaattttatttaacacaatatgtacaaaatattattttatttcagcatatagttaacatgaaaaaaatcattgatatattttatgttattaattgtctatttcgagggccgggcatggcggcttacacctgtaatcctagcactttgggaggccgaggtggttggatcgcctgaggtcaggagttccagcctggccaacatggcaaaattccgtctctactaaaaatacaagaattagctgggtgtggtggcacatgcctgtaatcccagctacttgggaggctgaggcatgagaattgcttgctaggaggcagaggttgcagtgagccaagattgcgccattgcactccagcctgggcgacagagcaagactcattctggaaaaaaaaaatgtgtattttgaaattccattggtattttacactttttttttttagatggttttgctcttgtcacccaggctggagtgcaatggcgcgatctcagcccaccacaacctctgcctactggattcaagcaattcttctgcttcagcctcccatgtatctgggaatatatctgggaatatagcctgccaccacgcctggctaattttgtagttttagtagagatggggtttcaccgtgttggcaggctggtctcaaactcctgacctcaagtgatccgccagccttggcctcccaaaatgttgggattacaggtgggagccaccatgcccggctggtattttacatttaacaatacatctgggccagcacagtggctcatgcctgtaatcccaacactgggaagccgaggtgggtggatcacctgaggtcgggagttcgagaccagcctaaccaacatggagaaaccccgtctctactaaaactacaaaattagccaggcgtggtggtgcatgcctgtaatcccagctactcgggaggctgaggcaggagaattgcttgaacccaggaggcagaggttgcagtgagccgagatcatgccactgcaccccagcctgggcaacaagagcgaaactctgtctcaaaaaaaaataaaaaataaagtaaaaaaacctctgaattcagactagccatatttcaagggctcaatagctacatgtgatacttttataaatggcagtttttaaaaatagagactgggtctcactatgttgcccaggctggagtgtggtggcatgatcatagctcattgcagcctcaaattcctgggctcaagcaattctcctgcctcagccttccaagtagctgggattacaggtgtgtgccatctcacccagcttcataaacggcattttaatttagactcttcaatttacaattagattgtggagagtttggaatttttttttttttttttagttttttagtagtagctttattaagatataattcacataccatgcaattcattcatttaaagtacacaatttgctgagcacagtggcaagcgcctgtagtctcagctactcaggaggctgacataggaggacacttgagcccagaagttgaaggcaagcctgggcgacctagcaagactcccatctctaaaataataaaaaataaaaaatatatacagttcagtggctttcagcatattcacagagttatacaaccatcaccacaattttagagcattttcatcaccccaacaaaacaccctatacctattagccgccactccctaactctaagcaacctccaatccactttctgtctctctggatttttctattctggacatttcatctaagtggaatcatacattagatggccttttatgactagcttctttcatttagcataatgttttcaagagtcatccaagttatagcatgtatcagcactttgatggccaaataatattccattatatggatatagtgcattttgtttatcacttcatcagttaatggacatttaagtttcttctgtgttgtggctattatgaataatgccgctacagacaatcatgtacaaatttttatgtgaacatatatgttttcacttcttttgggtaggtacctaggagtgctatgtgctgggtcatatggtaactctatgtttaaccttttgaggaactaccagactgttctccagagtagcttcactattttacattcctaccagcagtgtatgagatttctaatttctccatgtccttgtcaacacttgttcttatccatctttttattagagtcatcctaacgggtgtgaagtggtatctcatggtgcttttgatttgtattttcatgatggctatcccctcccatgacattttcatttcataaataaactgtatatctgtttatgtactgtgacctcttagagggctacaaaccactgtaatatctaagttttttcattcctcccaaaaaccagttcttacccccttggggttatattaccttcattgagaatgcatgtattagtacaacctgtcacatggccaaaccctaggtcaaaggggcaaggaagtggacttcactcctgagtaggagctgcaacattgcatggcaaagggtgtggacacacagaggagagaagaattggggacaatcatgtgtagggtcaaagggcctgttttggcctcatggggaaagcagggcttccccataattcttgagtcaccatggcaggcccacttcacctagaactgagctccaccttggtgctttggcttcggaatagctaagctgcttttctgacccttgcagatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgagttgtcagactccttccttctccctggggaggcagtggcccagacagccgagtctccgtgctcagaggggctgcctttcagtgagcagtccaattccttggtgtcttctccccacccctagagctggcccagatcactcatcatgagttccaccctcaatccatccagcctaggactctgcccaatgcggcaagcccaagaactatgctatggcagctggggtgttcctttgcatgatgttggcctcaggttagggatctgcactgaacatccttaatttcttttaatagcccgttttctttcatacattttattgaaacctatttacatttcaagtctgtatcacctctataactttattttttgtttttgtttttgagacaaagtcttgcactgtcgcccaggctggagtgcagtggtgtgatctcggctcactgcaacctctgcctcccaggttcaagctattctgttgcctcagcctcccaagtagctgagactacaggtgcctgctgccacacccggctaatttttgtatttttagtacagacggagtttcaccatgttggccaggatggtctcaaactcctgacctcattatccacccgcctcagcctcccaaagtgctaggattacaggcgtgagccaccgcgcccagcctgggctgggattttatgaaggagtttgttttcatccctcccaccccctttgcatggcttggtggacatcagaagaaggaccccatttagccttgagtcttcagtttcagagaccctcagcaaaccagatcacctctggaaacaaaggagggaggagaataggcctggaacactctggaacaacctagtttcccagcagagagaacagcaatctctgtgttgctagagaacctgaaaccatcccataccagatgcagtggcttggccatggggatgtagcagggaggttactggagaggaagcctcaccgttggggcagcaccaggcggtgcaacactaagagtgaaatccactctctgctcaccgggagggaggcagctatttaaagagaaaaaaacatgcacatgggtaccaacttgagggaattcaggaacatttcaacaagtgcagaataagaagatatacacacaggctgggtacacggtggctcacacctgtaatcccagcatgcctgtaatccctccctttgggaggccgaggcaggtggatcacttggagtcaggagttcgagaccagcctggccaacatggtggaaccctgtctctactaaaaatacaaaaattagccaggcatggtggcgggcacctgtaatctcagctacttgggaagctgaggcaggagaatcgctcaaacctgggaggcggaggctgcaataagccaagactgcaccactgcactccagcctgggcaacagagtaagactccatctcaaaaaaagaagatatagacacaaagcacaaaagctgaaagcacatatcatcagaaatggagtgggatggtgtcagggttacctaaaaaacaccttcttgaggtggcagcgagtctccgaagtgctgctcaggcctgctgggcgttccatgctagtctgggatttccacctagcaggtaacagttcctcaagagacagagatgctctccactgggactctcagggacagaaccgttttcaaaagtcctataaactctccatggggagtacagatatgctgttgccagagagagccccgcaaccatgtggggccggaaaccattgattttgccatcctctgtcatcccgttcgtccacactgtcctcagtctcatagctgagtgtgagacgcttgcttccctaccaaagctacctcctccgccccccgtcttctggcatctttcttttcccccaatccttttgttttgctttttttctttcccttttcccccaccagtgggtcacccctgatgaggacctcagagccctgggactgcgacacccgtgagaggcctggctgcgtagctgggcccctccttcatggctgctcctgttccctggcaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcaggtacccgccttggctacttctgctaaagcgtttgaatgacagtcgctcttggaccctctagtctgtagagcaggtgaccgcctagcattgaagagtaagcccttctgagataaggatggaataggctgggcgcggtgactcacacctgtaatctcagcactttgagaggctgaggtgggtggatcacttgagaccaggagttcgaggccagcctgtgcaacatggtgaaactccgtctctactaaaaatagaaaaattagccagccatggtggcccacgcttgttatcccagctacttgggaggctgaggcacgggaatcgattgaacctgggaggtggacattgcagtgagctgagatctcaccactgcactccagcttgggcaacagagggagaccttccctcctgcccccacaaataaaggatggccaggcacggtggctcatgcctgtaatcctagcacttcgggaggccgaggcaggcggatcacctgaggtcaggagttcaagaccagcctggccaacatgatgaaactcagtctctactaaagatacaaaaatcagccagtcatggtggctcgtgcttgtaacaccagctacttgagaggctgaggtacaagaatcgcttgaacccaggaggcagaggctgcagtgagctgagatcgcaccattgcactccagcctgagcaacagaatgacattccatctcaaaaataaaaataaaataggccaggcgcagtggctcacacttgtaatcccagcactttgggaggccgaggcgggtggatcacaaggtcaagagattgagaccatcctggccaacatggtgaaactccgtctctgctaaaaatacaaaaattagctgggcatggtggcgtgtgcctgtagtcccagctactcaagaggctgaggcaggagaattgcttgaacccaggaggcagaggttgcagtgagccgagatcatgccactgcactccagcctggtgacagagcgagactccatctcaaaaaataaaaaataaaataaaataaaggatggaa

SEQ ID NO: 72 - DNA, 144103 bp, Homo sapiens
agccaggcttggcggtcctcagaggggctgataaatcggcgctcgactggcctaggagctgtccgcagggaggtgaggagaggggcccggacgcccgcggggaaggtggggacgggggcccgacgcccgcggggaagtggggacccagccgagccgtccgggcagcggtcgatctctagagccgtctgccgggcaggcagcggacgggcgcggcgagttgttggtcaccaggcgtctccaggccgccggcccgcgccagcgcctcagccgcatttccagtcagaaagcggtgaggcctgcggcgcgctcgggcgcagggcgggcccagctccccgcgaggtgggaccggctgggcgtccggcccgcccctaaagtcggctgattggtgttcggttcctgtgtcttgtgttccggtgtgtggcgccccctgagcgagcgctgggggggacgtacccatctgtctgagccgcgggtttcacagcggtgggaggaaacgggacccggggggtggagtgacgcgccccagcgccccgttcttgtgccactctcggggccctaaggcctctgccttggatttaggatattctccttaggaaatccacagagctgttattttgctttaggtgctgattcggtccccagccggacccttccagccagccctgttggtgcctggggagagggggtgagatctggggctccgacaattgtatggtcctttcccaggccgagcctcggagtaatttgttcccgttgatttttccttctttgtcagattctctgcagttatttgtgacggtcggttattcccgtaaatgttggtccctacttcttccttaactcacaaaaatttctagcaaatcaataatttttatctgagtttctgtacttttaaaataaggagtatgtttctgagtaaaaattgtaagaagtaataggcctgcaattttatacaataagtttatacaataattgtatacaataattttatacaataagtaaagattacagaagacaaaatggtgaattgtcattaatataactaaagattaattgtatctagttgtattaatatttaactagagattgtcattaatataactagagaaggtcggcaccgcaaattatgtagactcaaaaatagcttaagtattttaacagtgattatagcagagcagacacttaaaactacctgggatgatattgtttattgtgtttggcaatctaattttgtgccacgtgctgaaactaaaactttaataataaataataggaacttaaaaaatctgaatctaaacctagaactttaattaatttaaaatagcatcccctcacatcacaaactcatactgaactgtagcaaggtcccttttaggacctgtgtttcttttttaaaaaaagatttacataatgaaagtgccaaattcatcatcttttagaaccttcatgattttatttacataaatcctgaactagaaaaaaatttcacattttttaactgaacgttgaagattggggctcaaattttaagtttctaaattaacagaaaattatttttatttgacactatttttataaactggttcttgctaatgcatttattccacaatgcattcttatggaccatttactgtgtgccaggcactattctgggttattggaacacattaatgagcaaaaagtccctgcttgctctaaagggagaaacataataaacaactaagcatatactataatgttagttatcagttcatgctatgaagaaaaataatgcggaatgagaggatgcagttttagataaggggtgttttttcacaggagtatataagaactaaaatatgtacatgatatttttattctgaacccaaacaagttatattcttgtatgctagaactagaaatcaaaaattcttttgaaaatatttgctgtttgtataggaggtttttgtcagtttatgcaacgcttttcttcccaaatgttttaaatttgtagttttgttgtctatttgtagttgctttaggaagaaagtattcaagtgtataaatgttagccttaagatttttgacttaaattctgaggtagcaaagccatatgaaactggtctggtgaggtttattttaggaaaagtttcttttgtttgaacatagttttcctaaaactagaaagggaacattttatttgttactttttgggcaatataaaaacatgattaacattttcatttatactttttcagataattgttttcaagttctgaaattgtttacttaaagctgttaaagacttcgcatatttctgaatgactccctctacctcctgccctattatcctaggcttctatttttcgtatagtcaaattgttttagacatttatagaaccacactagtttgtttcatttttactacttgtttttgttggtaactgattaatagatagagaaaaatgaagagggcaattatattaaacagatggaagggggaagaacccaataacgaaaacagtgaaaaaccccacaatattctatatcagtaagaacagccctgaagtatatatacaggtttagttctcatacagtagcatttgtcaagtgttgtatgtggaaacattctcccttccccatatcactcccacttgtatctcatccccacatcaaggaggattcaaaattggagagacataatctgacttggtaatgcgtatttctccactagatggcattaatagaatttctttgattgtagtttctatcttgaggacaaatttacaatgtattaactaaaacagaagaaacagaaatgtgatttatgttttacagtttgttcgtctgattttatggtttgtcatatagaatgttctatgatgtttaagaatttagaaaaaaataggatatgcagggaaaaataattctaatgggagcaatgtatgtatctagagactagtttttttttttaatcacatttgcatctttgttcagccccagatttttgttatgttcaaaggtggccaatgctgaatgtttttatcctttatgtttagataatatctctgagtgcaaaaattatcttttaaaaaagaatgtaaacgtgtgtagtatatgcattaactcatataaataaatatgcatatgtatgttaaacttgtaatttttttattttgaaaaagttcaaacctatgaaaaaatattataatgaaccccatgtacctattacatagctttagctttgatcaactcattgtcaatattatttcaatactccttcatctctcccctttattttgaagcaaatccctgcatatgtacatagtatattgttagaggtgcacacattcacaataaaatgtgctgtcctaacttgaaaataatggtgtgaacaaagtattaagagcccaagaagactgattaattctgccttgaggaagaagacaaattcagaaaagcctttgaagaagaaatgacatttgacctataacttgaaggatggttaggaatttgccagttggagaatggcagaaaacacattccaagcattggagcactatgaagagaagggagcaagtgtgaatccatgaatgaatggaaaacagagaataatgtatgtgaatattgaggtgctttgaaggaagttgcagacgatgaagctggaaggatagtctgtggttatattttacaggagactgtggaaaattagtgattatacagaaatatttttttacatctttataaataaaatataaactactttttccatattttgtagatttatgacaaagtccagttttcaacaatgctgaaatcaaatgattgcctgttttctttggaaaatttgttttttgaaaaaccagatgaagttgaaaagtaagtctcccttaaagattgatagcatagtatattactttagggttttttgaatttgggtgagttttagctttctctctggtaaatatacaaataaaaatgaggaatcaacagaacgatatttcagttacatatttggtaaacatggaattctcttaccagtagtataggggagtaactgaagtttaacatcttaaatgttataattttaaaaatagaatagatttgggccaggcgcagtggctcacgcctgtaatcccagcactttggaaggctgaggcgggtgaatcacctgaaatcaggagttcaagaccagcctagccaacatggtgaaaccctgtctctactaaaagcacaaaaaaattagccaggcctggtggcgcatgcctctaatcccagctacttgggaggctgaggcatgagaattgcttgaagcccggaggcggaggttgcagtgagctaaggtggcgccactgcactccagccagagcaacagagtgaaactctatcaaaagaaaaaaaaaaaaaaaagattcttgcctatttggcttgcatttatttgtatttctggtttgttcagattatttttggccaagctaaagatgggaaataatgctcaaagagtagctcaggacaaggaatgacgtcaccatctggaaacagaatggacagtatgccaaaggcaaagtatgataggcacattaaatgctggcaggaagtaggggcgggaataaagatgtgagaccaaagaaaacaagactagagagtaggtagtatgttaaatactggcttttatggattttcatgtgcattgttcaattttgaattttctgtgtatttttagtgtattgtattatcctattttaatgaggtgtattaattgcctcattattttacttgttcattcaaatattgattgaaagttgaaagggttataaaaaggatgaaacagacttttacttacaaagtacttaaaatctagttgaagagattaaacacacaaatggaaagacattaataagtaataggaccatgtaaataatcatctatactgtgacacttttgagagtgaaagagcacatccaactggggcaacatgtgttaatcaggtctggccaatgcaaattttgtaatatacggttgtttttctgaaaatatggtcaaaaatatgtgcaaagcaaatgacaagcatatgttcatgcaatgaaatttcagacttggaaggaaggtcgtcttggagtacacagtcaggtcaggctttttgggtagtagggggagacttcaggaggctttgaaggatttgataattcctatagaaagagaagaagtgggcatttgaaggcagagtgttagagcaagagaaaaagaatggagataggacattcatggtacttttaagggataacatgtagagaagtttcctggaatagacaattcatgaaggaggaactttgggacataaagttagaaattctaagttgaggttagatggtgatgtgcgttgaatgctggaataaggattttggatataattcactgtgggttaaaagccattgaattaaatcaacaattatttattgaaattatgtaaaggactttgctaagtactgctgatgtaaatggacgtaaaaataaaactgtaggtataatctagagggagtatcaaatatctatctgtcaaagctatccatttgcttatctgtttctctctattatctatctgtacattcacacagctcaaggcagactataatacatattataggttccctctataagaagaagggaggagaaaatctttgggaacctagggagatttcttggaaaaggtaggatttgagccagcctttgaatataagctctagtgcctagaacaatacctggcacatagtactcagtaagtaattactgaatggattaatgaatgaataaaatagtagaacttctgcatgtagatatcggagtggggcagggcacaggggcaagctgagtaaatatctttgaatgagggtgaggagtgacgaggcacggtggctcacacctgtaatcccagcactttgggaggttgaggtgggcgaatcacttgagtcccggagtttgagactagcctggccaacatggtgaaacgccatctctactaaaaatacaaaaattagccagacatggtggtatatgcctgtaatcccagctactggggaggctgaggcatgagaatcacttgaacccaggaggtggaggttgtggtgatctgagatctggccactgcactccaacctgggtggcagagtgagactcttgtctcaggagggaaaaaaaaaaaaagatgaggagagacaatgcattatctatttgttatacaacagggagttcagtttagtttggactgtaaggtatgtgtaggagagttaaaactataaggtggtctaaggccactaggaagtttggcaatctttgaaagccattgaagaattttgaatggagtaatgtaatgaaaacaattccaaatgaatgtggtaggaacttgtaaaatagagagaaagcctggaggcagtgagggcagttaaaacaagttagtaagagccttgattatgataatgaccgtggaaacacaaaggaaatgataaatttaagaagcattacaaggaatatacagtaagacctaatatgtatctagatatagttagtaaaaaagatactatggtttggattctgggtgactgggatgatgatgtcacctctggaaaaaaattgggaaattataaggaagatttgattttattaagaggcagaatagtacagctattattcctctttcttaggttttctgaaatagtccttgtgtagaaaagagttaatatagcagacctaaactgctgttcttgaaaaggcctgtttgcgagggcggctttggctagagtctgagaacttagatttcaggaagatcccttccattaactgacaacagtggcttactatgtgtaaactgtttatacaaatagtgtggtttatgttgaacacctgctttttttctgagattctggaatttaggtgtgtgccagacaggggatgcttatgttaatgttagcccccaataaaaacctgggcattgggtccctgaagagcttcccttctttggcaacatttcatgggtattgtcctaagtcattactcagataattaagtgcctcccgcagagtctgctgggagaagactcttgaaagctcatgcctggttttccttggacttcgtcctggtagccgtgagtaggactacatgctgagtcttatgagtcattttaggatattattgaactgggggtgatcttggggaccctctgacacagtcctaaattttaaaagatctggcttgttattaaacagtctgttagacgttgccagataatgtgttgtagattttttacttggaaaatatggtcagagtagctatgtgctaggtgctcggagagacagaaaagtaaaagactgagtttctcactttagagagcgtaacatcctaaatgactagatcataaaatctttgggacttggtatagacaaaatatatgatgctcttctcaactttatttcctgtcacctaacacttatctttttgtcctaatgaagaacaagtcaactttgatgggaaaggaaccattaaagcagtatcagttaacacgatcacagttgaaagatgaggaggggtagttaatgatgccaacagggtggcaaaaatatcaattactataggttataaagaggtcatcagtttcaaatgatttcttggatttttctgtagtttgtagatggtttggactaagaatatttcggttaggacattaatttgtaataatgttataggaatactctagaacaacggtccccaaccttcttggcaccagacactgaatttgtggacagtttttccacagatggtttcgggatgaaactgttccacctcagatcatcagacattagttagattctcataaggagcatgcaacctagagccctctcatgtacagttcatgatagggctcgcactcctgtgagaatctaatgtcgttgctgatctgacagaagtcagagctcaggcagtaatgctcacttgctcactgctcacctcttgctgtgcagccgggttcctaacaggccagcatcagtctgcggcccaggggttggggatcccagctctggaataccagtaatggtatcgtttacacattgatgacccgtgattagttgtgagatatgtcaagtaatttgttacttgtaatagttaaaatgctaaagtttgagaatgatttactactttgtttttatattggagcagatttaagattcctgttactggcatttgaattggagaaaaggagatagagttattgccattatttaggtagcatatctcacacagcggtatcattaatcctatgatatataagggtaaaaggttgagaacactgctgtatagggataaatcaaagtgctgacagaaagttaatttatagaatgtttaagagtccaattgagtaatgtttaataaacacatagcttctcatgttatatctttattaacatatatactcacatttttatattttatatagccatccagacaatgaaaagtcattggattggtttctccctcctgctccattgatttcagaaattccagatactcaggagttagaggaagaattagaaagtcataaactgttaggtaaattatcacatatttgttttgaagccaaacccatacagttcatggcaatatttttttaaaaaaccctgatttgattgttacacgttgtgtatacatgtatcaaaataatgcatatgcccccaaaatatgtatactcatattgggtattgatttcagaaatttcagatactcaggagttaaaggaagaattagaaagtctgggaggccgaggtgggcagatcacccagcctggccaatatgatgaaaccccatctctactaaaaatacaaaaaaactagctaggcgtggtggtgtacacctgtagtcccagctactcgggaggctgaggcaggagaatggcttgaacccaggaggcagaggttgcagttagctgagattgcaccactgcactctatcctgggcaatagagggagactctgtctcaaaaaaaaaaaaaaagtaataaactgttaggcaaattatcacatatttgttgtgaagccaaacccatacagttcatggcaatatttttttaaaaactctgatttgatcattacacattgtatatgcatgtatcaaaatatcagatacccccccaaaatatgtatactcgttatgtaaacaattaaaatttctttattttaatgaaataaaatgaaagtcagatccttcttttattaaaaagagtgctcaccaagctggatgcagttgacacctgtagtcccagctacttgggagtctgtgaatagccactgcactccagcctgggcaacatagtgggaccctatctctaaataaataaataaatatataaacaaacaaacagatcctcctcatctctaaatacatacatacccccaaaaacaaaatagtgcccaccaaatcttaaaatttaaaatatttttcttctctatacatataatacacatacatacgtgtacataaatgcacataatacactactacatgttttgatttttgttttatgaatattttttctgtgactattaaactcctatcactgctgttcagtttttgccttgccatttcctaaaggtaagatcgcctggtaaccagatcccagaaatattgagtgaaaaaagctagatgcagaagattaaatatagggtgataccatttttaaaaagctcaaaaacaagcacactcaaacaatgtatgtgacctaatgtaatattagtaaaattttaatttttaaattgggtcataggttcatgcacattcattttattattaagctttgtaatttacatatatgttatatatatacttatatcaaataatatatagcatagtgtataatgtagatacatagatgctaaagcaaatttaagttctagtaagacgtccaaattccccctaaacttccctaaaaattcttgcaaagcctctaaagaaacctttaaacttctgtcactctgatgaaaacattcctttattttgattttagaagcaagattgcaaacttaaaagcattagatatgttaataatgaattgtgtttggtaacattttatataattggtcattgtatttctgtgtgtaaatcatttatataaattttaaatcttcataattgtataattatatcatttgttatgggtcagaaagaaattaaatctattttataatgcagtgccatataaacttcaaatttaattcaatacttccacattaatttctgagtgtctgttaatgatgtaatataccataagtgtaacaatcacctatattttaaaaccgtatatggtattacagatgagcttattactagtgctttgcttttggctttcatacttaacttggaatttttattaaagtttttcatcatcattttgaaaatttcctttaatggagaacatgtaataattaagatattccttttttgtaggtcaggaaaagaggccaaaaatgttaacatcaaatttaaagataactaatgaagatacaaattatatttcactaacacaaaaattccagtttgcctttccttctgataaatatgaacaggatgatctaaatttagaaggggtaggtaataatgacttatcacatattgctggcaagctgacatatgcttctcagaaatataaaaatcacattggcactgagatagcacctgagaagagtgttcctgatgatacaaaattagttaattttgcagaagataaaggagagagcacatcagtattccggaaaaggtaattattataattaaactaaataatattctgtgaataaagttgaatatttgtacatataaaagtattaaatatggtacaatgtgaatgagaaaaacagcaaaattctatctcctaaataattccttactttctccattcctggtgtcatagtcctggtcctacacataaaaataaccataattgtaatatataactatctactataaatggtaccacaacagtccaggtgggacacaggaatcttcatttttaacaaattttctaggtgattattatgcacacaaaagtttgagacccattttcctaatgccttgggtttgaacagaggagtgaaattagactttcttttctttaagagttcattttggccccagtatggaggataaattataatagaagggagttaaaatatgaaggtccacttgaaaggttatcttattagtctagatgggagaaaatggtagcctgacctaggacagtggtatcaggaatggaaacaatccagaattatttaggagataaaatcccacaggacttaagtgattattggatatgagatctgactcctaggtttttggtttgagccagaatgatgaaggttggtagtgcccttttttgatttaaagaactataaagtaagaacaggttcgggggaaggtgatgagtacagatatggacatgttgattttagatatttataaatagttcagatattcagttgggtatgtggattcaagattcagaagaagtttagttgattgtttttgttttctgtgacataggagatgtggttatctgtggagtttgagagagaaagtgagagtattgagcaagaatgagaagaatggaataaattatggagaatgggaaagcagtctaattagaataatggtaggactgatggacactgtaaagggtccagctgaggttgatttctataatgtttgtaataacagctttattaagatataattcacataccataaaattcacctttttaaagtgtagaattattttattttcttatttttttcattcttatgtatttacccacgttggtttttataatgcatacttttgcaaccatcattattaactaattttaaaacattttcacctcctgcaaaataaattccttactaattaacagttactcttcatttctccctttccacagcacctggtggccactaatctactttctgtctctatcatctctatggatttatctattctaaacatttcatataagtgcaattatacaaaatatggctatttgtgcctggcttctttcacttaacgtaacatttttttttggaggtgaatatttttcttttctttttaaattatacttcaagttatagagtacctgtgcacaacatgcaggtttgttacatatgtatacatgtgccatgttggtgtgctgcacccattaactcgtcatttacattaggtatttcttctaatgctatcccttccccacccccaaccccatgacaggccccggtgtgtgatgttccccaccctgtatgcaagtgttctcattgttcaattcccatctatgagtgagaacacgtggtgtttggttttctttccttacgacagtttgctcagaatgatggtttccagattcatccatgtccctgcaaaggacatgaactcatccttttttatggctgcatagtattccatgatgtatatgtgccacattttcttaatccagtctatcattgatggacatttggttggttccaagtctttgctattgcgaatagtgccgcaataaacatacgtgtgcacgtgtctttatagtagcatgatttataatcctttgggtatatacccagtaatgggatggctgggtcaaatggtatttctagttctagatccttgaggaattgccatattgtcttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgattttcatttctctgatggccagtgatgatgagcattttttcatgtgtctgttggctgcataaatgtcttcttttgagaatcgtctgttcatatcctttgccaactttttaatggggttgtttgatttttttcttgtaaatttgtttaagttctttgtagattctggatattagccctctgtcatatgggtagattgcaaaagttttctcccattggttgcctgttcactctgatggtagtttctttgctgtgcagaagctctttagtgtaattagatcccatttgtttattttggcttttgttgccgttgcttttggtgttttagtcatgaagtccttgcccatgcctatgtcctgagtggtattgcctaggttttcttctagggtttttatggttttagtctaacatttaagtctttaatccatcttgaattaattttcgtataaggtgtaaggaaggaatccagtttcagctttctacatatggctagccagttttcccagcaccatttattaaatagggaatcctttccccatttcttgtttttgtcaggtttgtcaaagatcagatggttgtagatgtgtgatattatttctgagggctctgttcttttctgttggtctatatctctgttttggtaccagtatcatgctgttttggttactgtagccttgtagtatagtttgaagttaggtagcgtgatgcctccagctttgttctttttgcttaggattgccttggcaatgcgggctctgttttggttccctgtggactttaaagtagttttttccaattctgtgaagaaagtcattggtagcttgatggggatggcattgaatctatcaattaccttgggcagtatggccattttcacaatattgattcttcctatccatgagcatggaatgttcttccatttgtttgtgtcctcttttatttcattgagcagtggtttgtagttctccttgaagaggtccttcacatcccttgtaagttggattcctaggtattttattctctttgtagcaattgtgaatgggagttcactcatgatttggctctctgtctgttattggtgtacaggaatacttgtgatttttgcatgttgattttgtatcctgagactttgctgaagttgcttatcagcttaaggagattttgggctgggacaatggggttttctaaatatacaatcatgtcttctgcaaacagggacaatttgacttcctcttttcctaattgaatacccattatttctttctcctacctgattgccctggccagaacttccaacactatgttgaataggagtggtgagagagggcatccctgtcttgtgccagttttcaaagggaatgcttccagtttttgcccattcagtatgatattggctgtgggtctgtcataaatagctcttattattttgaggtatatcccatgaattcctagtttattgagagtttttagcatgaatggctgcacttaatatttttaaggttcatgcatgttgtgttatgtatcagtctttcattctttccctccctgcctccctccttccttccttccttcctttctttctctctttttttttttttctttgggagtcttactctgtcacccaggcttgagtgcagtggtgtgatcttggttcgctacagcctctgcctcccaggttcaggcaattctcctgcctcagcctcccgagtagctagaactacaggcgtgcgccaccacacccggctaatttttgtatttttagtagagacggaatttcaccatgttgaccaggatggtcttcatctcctgactgtgtgatctgtctgcctcggcctcccagtattgggattacaggcgtaagctaccatgcctggccagtatttcattttgttttaatggccaaataataatccattaaatggatatatcacattttgtttatttacttatcagttgatggatgtttgggttgttttcactttttgtctattgtgaataatattgctatgaaaatgcatgcaagtttttgtgtgaatgtgtgttttcaattctttggatataaacccagaagtagaattgctgggtcatatggtaactttatatttaacttttctgaggaactgccaaattgttttccaaagtggctgcgtcactttatagtcccatcagcaatatttgagagttccagtttctccacattctgtccagtacttgttattttctgtcttttttattatagccatcctactgggtatgtgaagaggtatctcattgtggtgtatctcattttcttaatgactaattgtcttagttattttgagctggtataatgaaatactgtagattgggtggtgtaaataacaaacatttgtttacacgattctggaggctggaagtcagaaatcagagtgccagcattgttgggttcttgatgacgaccctcttcctagttatgttctcccatggtttttctttggtgtgtgtatgaacagagagagctcatgtttcatcctctttttataagggcattaattccatcatggggaggtaccctcatgacctcatctaaacccaattacctgccaaaggccccacctccaaataccataacattgggaggctgaggcgggcagatcacaaggtcaggagttcgagaccagtctgaccaacatggtaaaaccctgtctctactaaaaatacgaaaattagccagatgtggtggcatgcgcctgtaatcctagctactcaggaggctgaggcaggagaatcacttgaacccgggaggcggagcttgcagtgagccgagatcacaccactgcactccagcctgggtgacagagcgagactccagcctgggtgacagagccagactcaatctcaaaaaaaaaaaaaaaaaaaaaacccaacaaaaaaacccactggggattagggcctcaacatatgaatctggagggagggacattaatatccagtctgtagcaataatgttaagaatattttcatgtgattatcagccattcgtatgtcttctttggagtaatgtcttattcagatcctttgtccatattttaattgggctatttgtcttttaattgttgagttttaagagttctttattcccaataacagtctcttatcatctgtatgatttgcaagtatttcccccattctgtgggttttcacttttttgatggtgttcttcgcagcgcaagttttaaattttgatagagtccagtttatctaatttttcttttatgcttatgcttttgctttgatgtaatactgatttggcgtcactttggttgcttatggttttggtgtcatatctaagaaactattgcctaatccaaggtcatgaagatttactcttaagttttcttctaagggtttcagagtttttagctcttatgtttacatttgtgatctattatttcatattttaaatatttgtgtgaagtaggagttcattctcattctttttgcatgtagatattcagatgttccagcctcatttgttgaaaagactgttctttccctactgaatgtcatgacactgtcattggaaatcaactgaccataaatgtaaagactgggtgttgactgacaccgactgattctctgacaccaacttggcatctaacaatttaaatcaatttgaaacttaactcctggaattagcgtcagaccccacaggttgaaggctcagttctgtaagactgacctcactttgaattccagctgaaaatgagattcccaggctacccacatttctgtctggccaactacaaatttgaggcttcccatgaccccatcttaggtttaataatttgctagaatgactcagagacctaagggaaacactttacttacatttaccagcttattataaagggtacaactccaaatgaaagagatacatatggcaaaatatgagggagggggtgcagagttcccataacttctctgagcatgacactctgtcagcaccttgatgtgttcaccattccagaagctctcagaaccctgttgtttaggcattttaatggaggttctatttcttttttttgtttgtttgttttaaaaatcttttttttttttttttaattttttttttttaattatactctaagttttagggtacatgtgcacattgtgcaggttagttacatatgtatacatgtgccatgctggtgcactgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttccggggacagtgccaggtggggagtttgactggggctgtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctggaggttctatttcatagacaagactgatgaaatcactggccattgctaattaaacttgatcttcagcccctgaatggataagtcatctccattacttattctataagatgtgaatgttttattaggaaccttaacggttacttcatcccttagggatattgtgaacaagttacttcgatagattgtcttttgatcaaatataatacagtacagtcataaagtgtttccttgtttttagaactttgcagagaagtagttcttacattgaaatggttattggatatagtgtttgggatgatttaatctgctaatatacttagtttatatcttttcctttttggggggatacacaatgctgatttgattggctaggaaaactgtcttatctggtagcttctgtggcgtgaaatgcagttgctgacaacttttaattcataacaagtctgttaacttattcctataaattgaatatgttaatataattcagtaacttgaatcacttcagttaaatttaaatactattaggtgttatgaaatttactatttactgtgactatatttagtggctttttctctctcttaagcactttactgactttaaatggaacattagttatctgttgttgtataataaaattatcccaaaatgtagtagtttaaaacaacaatgaacattattatctctcacagtttctccaggctaggaatttaggaacaacttagctagtagttctggcttaggctctcttgtgagaatgcgtaaaggtattgggggcctctcacaagaaggccacaatcaaaatgttagccatgctgcagtcatctgaaagcttgacaggagctatcaggtctctcttcaaggtggcttgctgtccttgactgaaaagtcagtgctggttgttggcaggagacctcagtacctctccacctgggcctcttcatagggttgtttgagtgctttctttatattgtgactagctctccacagagtgagagatctaagagaccatggggaaggggcaatgtcttttattacctagccttgtaagtcaaacatttacacttctgcagtactctgctagttagacaggccagtcctgattcagcgattcaatttgtaggagactgtaaaggggtgaggagcaggcaaggatcattgggctgttttggaggatgactgccacaaatggatttatctgagttttaggaaagtagaaagacatacttcagtggtaaactagcaagttatattttaggagaatgtttagcttttttgtttgagtaaaccataatctatgagtgtttttaagggggccaattttatgctagtttttcatattccaagcaagtgttacacgtgagaaaatatgtgggtcttttttttgtttgcagattatttaaaatatctgacaatatacatgggagtgcttattctaatgacaatgaattggactctcacattggctcagtgaaaattgtacaaacagaaatgaacaaagggaaatcaaggaactatagcaatagtaagcaaaaatttcagtattctgcaaatgtgtttacagcaaataatgctttttctgcttctgaaatcggagaaggcatgttcaaagcaccatctttttcagttgctttccaacctcatgatattcaaggtaatttcttgctttttcagttcattttatgagtacagactaaaccacatttcttagcatgggggaaaatgtaaaaatatagtaaatttgagtaaattatctctctgtgcaatttctgcatttttttattatattgcattattttctaagctgtgctgtgtgttaaaatattttatcctgtgtgctaaaaatatttttaactttgctctcaataaaaagttgtgttagttttattgaaacagtttttatggaaaggttaaaaatattcatttcaggtcctagcttctgaccattaatttttttttgatatttatataaatatgtagcatttttttttcagaggtaacagaaaatggtttaggttccttgaaggctgtcacagaaattcgtatcctttaagttatttacaatagctgctttgtatttattaaatcataattttaaaacatttgtttaattgtgtttgtttattttggttgatggagaaaaagagggaaaaattaatctttttggtgttgtaagaggtacatgtggccgggtgcggtggttcacacctgtaattccagcactttgggaggctgaggcaggcagatcacgaggtcaggagttcgagaccagcctgactaacatggtgaaaccttgtctctactaaaaatgtaaaaaattagctgggcctggtggtgtgcacctgtaatcccagctactcagggggctgagggaggagaatcgcttgaacctgggaggcagaggttgcagtgagctgagattgtgccattgcattctagcatggcaaaagagtgagactccatctcaaaaaaaaaaaaaaagatgtatgtgtgtgatagtgctactcagggtgtgattgcagactggtgccgatttgtgacctgtttgttatcagtttatggcaaattaagtacagaagtcagatttgtattattggcagaactctgagcatatttacttacaaataggtacagataatttctcatcctttgagaaagagcagccaaattgggttgaactgggtaggggaaatggatgagaatgggatattgtgtggattggggacatttctacagatctagtatttttgaaaatctaatttggagtttatacctagaatccaattttcatgtctggacatttccagtgtaaatattttgagtatgtttgtgtgttctggaggtaacattgtttttgcttctttaataccctgtgtatgcctatgatagtgcacttattttgttttaattcaccagcagtttatgtgactgtttccccatgatctatgaactctttgaaggcaaacatcatgacttatttacctgcctatttccaaatacattgaaaggcagataaagtaaggcaggtaaagtaaggaaattgttctggcaaaagtagagacataagcaagggtggaggtaaaaaagtatgaaatacatttggaaagaataagctttccagtttggctaaagtgacagatatgattaaagaagtaataagaaatattagatagttatcttagaatcatatcatataatgtcatgaataccaaggtcaaaggtttttttattttatttttattttttattttttcccccagctttgttgaggtataattgacaaataaaaatggtatattttttaaggagtacaacatgatattttttaatatgtaaacattgcaaaaataattaccacaatcaggctaattaatgtatctatcgcctctcatagttacttcttttttgtagtgaaaatgcaatctctgtaatgaggagaaaccatgcaatattttttaagcagttcaaatatcatttaaactatgctttaggaatatataattagtgactcaatgcttggcaatgctctagcatccacaaaagttatggtctagttgacaaaatgaaaaatgaattccagatattgcatagctgtgctagagaaatctaggcaacaataactctaatcctgggcactcgaaggatcatctgacataattctgaagtatggttagaaaatacttgcctgacttctcatgaaaagttgcctccaatgcagatggctgatttgattaaaaatgagggagagggatcaataagagagttatacatgttgatatagtaactataaacatagccagtgtttagcactttattcagcatagtgtctcaatgctgccacattttcttttctgtggtgatcaaaataggatggaaacataggaaatatattagcagtaagctgttaaagatgtttaattatctgtacgatggctgattcttcttatcccttactggaaagcctttccataatatgacactggcttttaaagagctttgaggatttttatgctatattagcacagctgaagtgattctgttgtttaggggtctttattagttaggactactgcctacacttgtgtccactgatttattgtccaaaaagttcattttgtgtaaaactcattgtcctataccttattgtttccaagtatgtattttaaagtggaagactgaatgctatttgtgataatttgagagtttgtagattacttggacacaccttattttcttattctctttaaatattttactgcatttgaatcctcagggcaatagacgttttctcagattggtcctaccacagtagtcttgtcattttcagttctgcagacatttccccattatttcagtgacactgctgagagtttattgaatgtaaggaaaaaaattgatttcaagtgttgatagtgatgataaatgatgttagcagttgagttttcttatgagctgaaatactgattctatactctgaatcaaagattcattttgtgaatgatatggaactatctaatgagagaaaaaccaacatgatggcccactcgtgggcttgttacaaataaatatttgatagaaagagacatgttttgaaggaaaattgagattccttctaaagctgatggattttcaaactcaaaattacgtttttgttttggcacagatatgacactttgcacatcagaaagtaaaatgaggatttataaattaactgcttgatgtaataattgcaaacctatattaactgagttatgtgtcaggcactgttctaagtatttgggatatgtcacttaagaaaacagacaatgaatccttgcttttgaggagatgacattcttgggatgagggtggggaggaagctagatctcaacaactataataacatataaataagtcagagttttttagaaagtggtgactattatgggaaaagaaaaaagtagagcagggtaagcgggttaaattgggactgctgggatttgtggctcagggtgtagaattaaacagtacttagggtagaccttgagaaggtcagatttaagcacttaatggagggaaaagagccaaggaaatatggaaggaataacagtctaggcagagggaaggcctcatggcaggatcgtagctgatgtttttgaagaacagcagagttcagtatagctagaggagatgagtcagggagaaagagtagtaggacatgatgtcagagagataaaggcaggggctgatgcggggagggagtggcagtggggagacgatcatgtggagccttatagccatacactttgagagaaagggaggaatttgatcagagaagtaatatgatgtaagtttaaacaggatcactacagcaatccatcagttcttgtatatctttataaaaatccagttgtttaagtaactgtgtacttgtgttctcagatatgttcttaaccatcttataacttctaatagattataacagtctcaattgtaggaactcattttcttctttatttatagcttcccacagctttctaaatctagtaatgtattctgtatatagtgttcaatgactgtagttgatatattgtaagaagaataccatgtaaatacagatatctcccaatctgtcaatagaccctcaccttggagaggggacagtttattcttcatatctgttaatatttttgaactttcttacaggggaaggatgatttaagttcttcctgtcaagccagtatgttgatagttataattaaacccaccacttaacacaaccaaattatcaaaaacaaagagatttggtattaggtaaccagaaacacatcagctaatgaagtacaatcaatgcttaatgaaatagttgagtgaaattctgtacattaaagaagagataaaaatcaagtggccttgtcaaggtaaataagaaaaagcactactctggaaaagataaactagaagtgtagttctgatttacttgccattatgtacttgcatctcttccatcatatttagcactcaggtataacccttatataatctcttatttccctataagaactttgcaaattcttttcagaatatggagtgtgactggagactagaataatttatgataattcttttcctaagatgccagatagcaaatgttaaaacctcatcattaaatattgtcagaatctatattaatgtaacttagttttaaaataaaagtaactaattttttaaattctgaaatatttgactccttaatgttattgtaagcggcaaaatttagaagtattttcaaagaatttccatatttcaactatatacagtccaaggcctttgatgatgtaagtattttattttacttatttatttttctacctttcactaggttatgatcactagattgggacagctgggatttactagatctttatgtctgcactgccacactccatgtctagcacatttaggagctcagaaaatatttggtaaatgaatacatgtgattttcataggtggatttgtttgtatttgagtgcagtggtgaaatctcagctcactgcaacttctgcttcccaggttcaagcgattttcctgcctcagccacccaagtaactgggattacaggcttgagacaccactcctggctaagttttctatttgtagtggagacagagttttgctctgttggccaggctggtctcgaactcctgacctcaagtgatctgccttccttggcttcccaaagtgctgggattacaggtgtaagccatcgcactcagccaggaatgattttctcctaggtctacattgacaaataaaacagcatgataaaatactaatagtgttatttttcgagagtggaggctctggagcaaagttacaatttttataactttagaggaaaaatgtttgaactattattccttagattcttactaagactttttttttaacaaattgagaatgtgtgtgaaaaagtctatatgttacatgattgattactttttattttttagcttctttacacagataggaattttgtgatttgtgctccaactggttctggaaaaactgtagtgtttgaactagctataacaagattgttaatggaagtaccattgccatggttgaatattaaaattgtttacagtaagtatttattataagagtgatgactaattataataatgaaaaaccattgaagcaaaatgaagaaataaattcagtttctggcctcaggaattacttgattttctatatatttctagtaaagtctggtcttatttgtcattaaatttaaaacacattttccaaaattataaataaaaagtaatatttgaattgagaatttgacttttacatgcttattttttaaaggacaggcaaaatgaacaaataaaatcaaatattttgtaattctagaaatttgcataggaacttttactctcctttcttaggtatgtatttaaaaaattttttttaatcaaagtaatatatgtatatggattaaaaatcaaatatcagtaaaggccttatagtgaaaagcaataatcttctgccctacctttctccacttttagttacacttgcctgagaaatcatttctatttctatttttagttctttttggctattaccttgatatctctaaatcaagcttgtctaacttgtggcctgcaggctgcatgtggcccaggatggctttgaatgcggcccagcacaaatttgtaaacttacgacaaatttgtaatgtttgtaaaacattatgagaattttttttctttagcttatcagtcatcgtcagtgttagcatattttatgtgtggctcaatacagttcttcttccagtgtggcccagggaagccaaaagactggacacccctgctgtaaataatgtgcctatattgttcatttttaatttatcaatattaggagtatgtagatgtgtattttttatgctaactttattaaccaaagtttgtgaaaagaattttaaaattgaactgatgttcaaagtaaatattttatattgttacagtggcaccaataaaagccttgtgcagtcagcgttttgatgactggaaagaaaaatttggaccaataggattgaattgtaaagaacttactggagatacagtaatggatgatctatttgagattcagcatgcccatattattatgacaactccagtaggtattatttatactttatgatttctttagtttgttagaaaatacctatttttctttactgagataaaaagtttaaaaaatataaactagaaacatatatttacaatgcaaacaaacaaacattaaaaaaatactacaattcaaggtacagacagaatacctacaaatcagtaagtaaaagacaaatgaccaaattggaaaaattgacaaagaataggcagtttgttattgtggatactttgtaatcatatttattgcttttttcttttacctaagtagtatgttttatagagggaggtccttggtagaatttaaaaataggtaacaaaacttggactttgaatattttgtggttcagtgtaaaaacaattgagggcccagttttaaaaatacctttaagactgtaaaaattctttaagtattttttaattttaaaatatttttcagaatactcttaagggatcaaccaaaattgcctattatttgtaatacgtcatgttaaaaatgtttttgatatcttaatatttattataattccttatcacattaaactacttgtatgcttttttttctctctaggaaaaatgggatagcatgactaggaaatggagagacaactctttggttcagctggttcgactgtttctcattgatgaggtaatgaatgcattcgctttcagagataaacataaaaggataattagaataagacagaaagaaaaaagacattgcaaccaaactatatgtttgttttatcccttcaagtggaaaatgctcattttctcaagcaagaatgttaatattattgaatattttaattgattaaatgtatttttaattctatagctaatgattttttcttgatttcctgcttaggtacatattgtaaaagatgaaaatcgtggtccaactcttgaagttgtagttagcagaatgaaaactgtacagtctgtttctcagactttaaaaaataccagcactgctattccaatgcgatttgtagctgtatctgcaacaattccaaatgctgaggatgtgagttacaattttaactgagctcttaggttttttatgacttgtgaaatatttagtcatcttgatcatagagaaaagtgaatttttttgtcctttcctttaataggaaagtatgttgtagaaagttgtggctagatctcataaatataacagtattaaggccataaaatttggttaatcaggtttaataaaacattttttgtggacatgtggacatctcgtttgctagtatctaacagtcttagtttcctgggtttcaggtgcctcatagtaacttcactaacaatatgtgatggttgttgtaactagctgactctaattgtatagcaaagtatggtggagaataaaaataattgcttagatgattaccacttgctcctcaattctgtatgcttggcattgtggtaagcactaaatatagatgcaaaagtgaaaatatatggactccgtccttgaggaggatctcatggttaatggggtacatggacatgtaaagaaataatcatgtgcactattatactttccataatgaatatatgacttaattttttcttcaatttttaagtaaacgtcttgaaaaataatagtctcactctactttctcactcctacttacttctcagcctactataatactggttttcccctactacttcttagaaattgttttcacaaatagccactatattgtctattccaatggaatattttgtctttatcgttaatttggcacaattaatcattttcttgttcttgaaatgacaacttgttttgttcatatttttcaagaataatatagaaaaatttaaagtttattacaacaacaaaactaaatcctagcgtttatctttacacatgtaggaagcataatgtacatacttttttttgtaagcatgtaggaatcataatgtacatactctttttttgacctgcatttcacctttaaacatttttatatcattaaatattcttcaatactatttttgtggttttattgtaatttatttatcaaacactataacaatggaagattaagttatttccaatttttgctattgtaaacagtgaaattaatgtatctgaaacatccatgattatttccttaggatgaacttctagaatgaattaactgaatcaaaggatatataaaactctaaagaagtgcttctttcaataaatgttatattcatttacacttctaccagaggctattttcctgtatcctaacactggatagtataataatggaattattattgctattattatttttaaatatttataggatttattgttgagtgtagtatctcatttaaaaattttttacttctttgatttctactaaggtaaaattttaaatatatttatcaactactttgagttctttttttaaaacttgccaggttatgtcatttgcctttttttcacattggaatactaaatttttcttaacttatttgtaagcaattattatgtactagtactgtctaattcttgaaacttttcccctttgtgataaacactacttgtgtgaatgctgtttctgtctcttttgtcagatcttcttcctccgtttttccctaaattaaggtttttattcttggccttctgctcccctctgtctgtaaattcttatgtgatcttatccctactcatgataaccttgagattattttaatgttttctacctgtcaaaacaacagtcaatttcatagcagagcatggagcctgattattaactgggctatgtaaagataaggattgcttaccacagttccagaatctagcttgagtctgaagtttgcttttggcactggcatctctcaagtgtttgttgtttgcttaaaaacttgtcaacccttgccaacctaaaccaactattaatttgctgctatttatctaatatttaggacaacacaaaagagatgtcagccattttgaggcgtagttttcaaaaatagcaaagaagttaaaataatagtgagaaatttggcctctatgacaaaattgataatttttctttggattcttatgaaggaaaataaaacaaaataataataattaattggaagtttaccatggtgaaaagtgggtataatcttgaaatactactattggtagtgttgaccactatatcaacagaataatattaatggaatatgtaatattgaaaaagacagcatacttgattaaatacttttatagcttgaccttaaagtgctttgtaattgggttgtttttagcaataaaactttactagaagaaaattttaatgcacatatttttgtgtttcaaagattgcagaatggctttcagatggtgaaagaccagctgtgtgtctgaaaatggatgagagccatagaccagtgaaacttcagaaagtggtccttggatttccctgcagtagtaaccaaactgagtttaagtttgatttaaccctcaactacaaaattgccagtgttatacaaatgtactctgatcagaaacccacacttgtggtatggattgttgatagcttattttttagtatattcagtttttaacatgattaatacaaacgttatgaatttattttcagttttgtgcaacaaggaagggtgtgcaacaggctgcttctgttcttgtgaaagatgctaaatttattatgactgtggaacagaaacagaggtatagtattttattttttcatggaagtagaaggacttttagggctcatctagatgacatgagaaaattaggcttgtcccataaccttggggtaaacctcagtgtcctcatctataaaataaggataatgataattttgaggattaagtgagatagtgaatcttcgtacaggggtgatccagatttcttgaatgataaagattatccatactactatctattttttttaacctaatttcaatccagcatcttttatagtctttcactaaagctgatcttgcgaattaatctttaaggactctctatcatatttggccacttccaccttacttaaacactctggactctgtgcttccatgatcatttctactgattttcttcctcctttgcaggctgttcgttctcagtccccttttcacctcttctacccaactcttaaatgttgacattcgagtgagtatacctgaggttcattctttctaatgccacactcttaggtgtttgtaagtactcacatgaagttcagataatatttatgcatgtctatgaattcccacatttatgccttcggcccagacttccttactgagctccaggcctatagtccatctgtgtaactgaatccagttgtatgtctaccaacagttatctcaaactcactatgtaccaaatagaaccttggttcttgctctcagaccagctccttctccagtgttccccatcttaattatacattatctccttagttactcatagcagaaaactatgattgatatcttcttcaccttataccccacaatcaattacgaagtcctgtttattcttacttctaaatatatctcaaatatgtcattttgtctccatcaacactgccacttccctaattcaagtcactagtaatctcttgcctaggctgtatccttttctttaatcactacacacacactctcttatccagctttattctctacatagcatagattgtgtaagattgcaaatctaaatggcagtttcctgcctaaaaccctttaatagattcttattgttctggggattaaatgctaaatccttagtgtagcctgcagtagcccatgtaatgtgatgcctagccaattctccagacttttcatgaccattctccccctttaatcatcacggtcaagctgtattagcctctgtgttctgtgaatacaccaaactgttactctgtacagcattgtcttgcatggtgcttgcttttactggaatggttttcacctaactcctatttatccttcatgtctaaactttaatatcagttttccatagccatcagtttccctgtatttacttttataagcaacctgtacttgatttcatagcacttactataattataatatccttttgtttaatagttattttaatatcttttctattaattagattatcaacttcttgaggaaagggggactcatgttcatcctgcttaccactcaatcttagcaggtgtattaggtcattcttgcattgatataaagaaatttctgagcctgggtaatttataaagaagggaggtttaattggctcacagttttgcaggctgtacaagaaacatggcaccacatctgctcggcttctggtgaggccttgggctgcttacagtcatggcagaaggcaaaggatgagttggtgtatcacatggtgagagcaggagtaggggtcggggggtaccatacacttttaagcaactagatgtcacaaaaactcactcactattgtaagaatagcaccaagccatgaggatctgcccccatgatccattcacctcctaccaggcctcaccttcaatactggagattacaatttagcatgagatttaaatggacagcatccaaattatagcagaaggtctcagcagagtgctagcacatgattactatgtaatgaacattaacttattattattgttaataacttctggaaatcagtaaatatgtttagtggtagacctcagactaaaattggacatgtggatatgagcagatacttattttttctgcctaattttgtatggtgggggaatatacttctctccgctttgggtcagatcagctttccaattaccagtctgttcctttgccaccacctctggttgcttgtcaaccaaagatatgtagcaagcctagaggagccaatttagtcttctttacattctttgtttttttttaatccactaaaaaggtagactataaagatagtctattaaagaattacaaacatagccacttattcaccctctagatactattttgacacttttccttccatttaaaggatttaacttgatcttcttagttactaccatatgaaaaaaaatctctagggtgtgaagcatgtagagtagttcttttataatacacgtcaacaaagcaagattaagcaataagaaacagtagagagcaagacagaatgagaaaaaccaacaaagagctcacagtcaaaaagtagatgaagtctgagaggtagaaagaaagggagaaagtgaaattattgctaataagaataccatcaaaaaatgattaataattttcataccaactgcatgtagttttatagcattcttatgaattttcttttttttattatactttaagttttagggtacatgtgcacaacgtgcagttttgttacatatgtatacatgtggtgttggtgtgctgcacccattaactcatcatttaacattagggatatctcctaatgctatccctccccattcaccccacccacaacaggccccagtgtgtgatgttccccttcctgtgtccatgtgttctcattgttcaattcccacctatgaatgagaacatgtggtgtttggttttttgtccttgcgatagtttgctgcgaatgatagtttccaggttcatccatgtccctacaaaggacataactcatcattttttatggctgcatagtattccatggtgtacatgtgccacattttcttaatccagtctatcattgttggacatttgggttggttccaagtctttgctattgtgaatagtgcctcaataaacacacgtgcacatgtgcctttatagcagcatgatttgtaatcctttgggtatatacccagtaatgggatggctggatcaaatggtatttctagttgtagatccccgaggaatcgccacaatgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgattttcatttctctgatggccagtgatgatgagcattttttcatgtgtctgttggctgcataaatgtcttcttttgagaagtgtctgttcatatccttcacccactttttgttggggttgtttgtttttttcttgtaaatttgtttgagttcattgtagattctggatattagccctttgtcagatgagtagatggcaaaaattttctcccattctgtaggctgcctattcactctgatggtagtttcttttgctgtacagaagctctttaattagatcccatttgtcaagtttggcttttgttgccattgcttttaatgttttagacatgaagtccttgcccatgcctatgtcctgaatggtattgcctaggttttcttctagggtttttatggttttaggtctaacatttaagtctttaatgcatcttgaattaatttttgtataaggtgtaaggaagggatccagtttcagctttctatatatggctagccagttttcccagcaccatttattaaatagggaatcctttccccatttcttgtttttctcaggtttgtcaaagatcagatggttgtagatatgtggcattatttctgagggctctgttctgttccattggtctatatctctgttttggtaccagtatcatgctgttttggttactgtagccttgtagtatagtttgaagtcaggtagtgtgatgcctccagctttgttcttttggcatagaattgacttggcaatgcgggctctttttcggttccatgtgaactttaaagtagttttttccaattctgtgaagaaagtcatttgtagcttgatggggatggcattgaatctataaattaccttgggcagtatggccattttcaggatattgattcttcctacccatgagcatggaatgttcttccatttgtttgtatcctcttttatttccttgagcagtggtttgtagttctccttgaagaggtccttcacatcccttgtaagttggattcctaagtattttattctctttgaagcaattgtgaatgggagttcactcatgatttggctctctgtttgtctgttattggtgtataagaatgcttgtgatttttgtacattgattttgtatcctgagactttgctgaagttatctatcagcttaaggagattttgcgctgggaacatggggttttctaaatatacaatcatgtcttctgcaaacagggacaatttgacttcctcttttcctaattgaataccctttatttctttctcctgcctgattgccctggccagaacttccaacactatgttgaataggagtggtgagagagggcatccctatcttgtgccagttttcaaagggaatgcttccagtttttgcccattcagtatgatattggctgtgggtttgtcatagatagctcttattattttgagatacatccaatcaatacctaatttattgagagtttttagcatgaagggttgttgaattttgtcaaaggccttttctgcatctattgagataatcatgtggtttttgtctttggttctgtttatatgctggattacgtgtattgattttcgtgtgttgaaccaggcttgcatcccagggatgaagcccacttgatcatggtggacaagctttttgatgtgctgctggatttggtttgccagtattttattgaggatttttgcatcgatgttcatcagggatattggtctaaaattctctttttttgttgtgtctctgccaggctttggtatcaggatgatgctggcctcataaaatgcgttagggaggattccctctttttctattgattggaatagtttcagaaggaatggtaacaactcctccttgtacctctggtagaattcggctgtgaatccatctggtcctggactttttttggttggtaagctattaattattgcctcaattttagagcctgttattggtctattcagagattcaacttctcctgggttagtcttgggagggtgtatgtgttgaggaatttatccatttcttctagattttctagtttatttgcgtagaggtgtttatagtattctctgatggtagtttgtatttctgtgggatcggtggctatatcccctttatcattttttattgcgtctatttgattcttctctcttttcttctttattagtcttgctagtggtttatcaattttgttgatcttctcaaaaaaccagttcctggattcattgatttttggaagggttttttgtgtctctatttccttcagttctgctctgatcttagttatttcttgccttctgctagcttttgaatgtgtttgctcttgcttccctagttcttttaattgtgatgttagggtgtcaatttttatctttcctgctttctcttgtgggcatttagtgctataaatttccctctacacactgttttgaatgtgtcccagagattgttacattgtgtctttgttctcattggtttcaaagaacatctttatttctgccttcatttcattatgtacccagtagtcattcaggttgttcagtttccatgtagttgagcggttttgagtgagtttcttaatcctgagttctagtgtgattgcactgtggtctgagagacagtttgttataatttctgttcttttacatttgctgaggagtgctttacttccaactatgtggtcaattttggaataggtgtggtgtggtgctgaaaagaatgtatattctgtttatttggggtggagagttctgtagatgtctattaggtctggttggtgcagtgctgagttcagttcctggatatccttgttaatgttctgtctcgttgatctgtctaatgttgacagtggggtgtgaaagtctcccattattattgtgtgggagtctaagtctctttgtaggtctctaaggacttgctttatgaatctgggtgctcctgtattgggtgcatatatatttaggatagttagctcttcttgttgaattgatccgtttaccattatgtaatagtcttctttgcctcttttgatctttgttggcttaaagtctgttttatcagagactaggattgcaacccctgcctttttttgttttccatttgcttggtagatcttcctccatccctttattttgagcatatatgtgtctctgcacgtgagatgggtttcctgaatacagcacactgatgggtcttaactctttctccagtttgccagtctgtgtcttttaattggagcatttagcccatttacagttaaggttaatattgttatgtgtgaatttgatcctgtcattatgatgttagctggttattttgctcgttagtggatgcagtttcttcctagccttgatggtctttacaatttggcatgtttttgcagtggctggtaccagttgttcctttccatgtttattgcttccttcaggagctcttttagggcagggctggtggtgacaaaaatctctcagcatttgcttgtctgtaaaggattttatttctccttcacttatgaagcttagtttggctggatatgaaattctgggttgaaaattcgtttctttaagaatgttgaatatttgcccccactctcttctggtttgtagagtttctgccgagagatcagctgttagtctgttgggtttccctttgttggtaacccaacctttctctctggctactcttaacattttttccttcatttcaactttggtgaatctgacaattatgtgtcttggagttgctcttcttgaggagtatctttgtggcgttctctgtatttcctaaatttgaatgttggcctgccttgctagattggagaagttctcctggataatatcctgcagagagttttccaacttggttccattctccccgtcactttcaggtacaccaatgagatgtagttttggtcttttcacatagtcccatatttcttggaggctttgtttgtttctttttattcttttttctctaaacttctcacttcatttcatttatttgatcttccatccctgataccctttcttccagttgatcacatcggctactgaggcttgtgcattcgtcacatagttctcgtgctgtggttttcagctccatcaggtcctttaaggacttctctgcgttggttattctagttagccattcgtctaattttttttcaaggtttttaacttctttgccatgggttcaaacttcctcctttagcttggagtagtttgatcttctgaagccttcctctctcaactcgtcagtcattctccgtccagctgtgttccattgctggtgaggagctgtgttcctttggaggaggataggcactctgatttttagagtttccggtttttctgctctgttttttccccatctttatggttttatctacctttggtctttgatgatggtgacgtacaggtgggtttttggtgtggatgtcctttctgtttgttagttttccttctaacagtcaggaccctcagctgcaggtctgttggagtttactggaggtccactccagaccctgtttgcctgggtatcagcagcggtggctgcagaacagcggatattggtgaaccgcaaatgctgctgcctgattgttcctctggaagttttgtctcagaggagtacccagctgtgtgaggtgtcagtccgcccctactggtcggtgcctctcagttaggcttgggggtcagggacccacttgtggaggtagtctgtccgttctcagatctcaagctgcgtgctgggagaaccactactgtcttccaatgtgtcagacagggacatttaagtctgcagaggtttctgctgccttttgtttggctatgccctgcccccagaggtggagtctacagaggcagggagccctccttgagctgcggtgcgctccacccagttcgagcttcctggctgctttgtttacctactcaagcctcggcaatggcgggtgcccctcccccagcctcactgccgccttgcagtttgatctcagactgctgtgctagcaatgagcgaggctctgtgggtgtaggaccctccaagccaggcgcaggatataatctcctggtgtgccgtttgctaagaccattaggaaagtgcagttttagggtgggagtgacccgattttccaggtgctgtctgtcacccctttctttgactaggaaagggaattccctgaccccttgcatttcccgggtgaggcgatgcctcgccctgcttcagctcaagctcggtgcactgcacccgctatctgacactccccagtgagatgaacccagtacctcagttggaaatgcagaaatcacctgtcttctgcattgctcacgctgggaggtgtagactggagctgttcctatttgtccatcttggctccacccacctcttattaattttctaagtttttaaaacaaagatggggtttcaaaaacattgaccagttcattataaaactagtaatagaataaaggtaaactgggatttttttaaaacgtgtaggtatagggtagagaggctgtaagtaggtctaaacaatttgaagctttctacttgttgggtgaataaactagatgatcaagttggttcatatcactttttgtcagaaacaagatgtggggatcaagtaatgaggcttgtttgcttgctcataaacttaactctgaaggcagttttgagagacttacggaattctttgtgcaatggcagcatgattcacatagaaatatctggtgtcctaaggtgaatacataataaacatttttgagctgaacttatctatatgagtagggaattgaaatacactacaagttcctttaaaactaatttacaatttatcctctcccttttttctgttgtgaacaaattagctaattttgtttcagataatcatttttttgcaaacatatatcttaattccttttctcatttcccactcttacctagttactaatggaaagtttctctctcctttaactctcctctcttctttcttcagtctttgccccttattttttctttatctctttttattcctgtttttttttttttttcaggaacataccggagttagagactcagatttgaattacagtgctgctacttttactagctgtgtactattggacatattacttaacttctttcaacttcaatttcttaatcaatattgtatatgtgagaatcaatcatctcaccatgtttctatgataattaaataagcgacatttctaagatacctaacagtgggtagcagagtttgtacttaatagtaacatgcctttcctcttgccttatcttcattccattgtgaatccttaaaaaaagtcatgagtgttatcataaaaataattcatcctagtgtcatatctgcaacaaggaagtagaaaaatactagatgtttttatatacttaagaaccaagcctaccaacttccaaaatcttttaatgtacccagaattcattttcaaattatcaacacactttcttaacttcctcttgtcttttcacctagttttcttttttaaaaaataaattttatatggcatatttgaggtttacaacatgatgttatgtgattcatatagctagtaaaatggttactgtagtgatgcaaattaatatatctctcatctcacatagttttttttttgacaagagcagctaaatctacttacttaacaagaatccctaatccaaaataatttttattaactatagtctttatgttgtacattaggtctctagatttgttcacactatgtatctgcttttctgtatatcctttgacctacatctccccatttcttcccccgttcccacccttcctgcctctgataactactattttattctctatctctgtatagttgactttttaaaaacacgtttcacatgtgagtgagaacatacaatatttttctttctgtgactggcttatttcagttagtgtcttagcaatgtactccaggtccagccatgttgtggcaagtcgcagaatctcattcttttataaggctgaataatattccattgtgtgtgtgcatgtgtgtgtgtatgtgtgtgtatactatgttatatatatatacacaccaggcgcggtggctcacgcctgtagtcccagcactttgggaggccgaggcaggcgaatcatgaggtcaggagatcaagaccaccctggctaacatggtgaaaccccatctctactaaaaatacaaaaaattagccgggcgtggtggctggtgcctgtagtcccagctaccctggaggctgaggcaggagaatggcgtgaaccccggggggcagagcttgcagtaagctgagatcgtgccactgcacactccagcctgggcgacagagcaagactctgtctcaaaaaaaaaaaaaaaatatatatatatatatatatatatatgtatatgtatatgtatatatacacacacagataccacatttttcttatgcattagttcatcaacagacctttaggctgtttccatatcttaactactatgaacaatctgcaaggaacatgggagtgcagatatctttatgaggtaatgatctcttctttgggtatatacccagagaagaggttgcttggtaatatggtaattccatttttaatatctttagaaatctcaatactatttccataatggctgtaccaatctgcattcccaccaacagtgtactaggattcccttttttccacaccatcacctgtatttgttgtctataatatagtggttttaatttacatttcctgataattagtgatgttcaacaccttttcatatacctgttggccattcttatgttttttttttccttccacttttaagtttaagggtacatgtgcaggatgtatgggtttgttatataggtaaacatgtgacatggtggattgctgtacaaatcatcgcataacctaggtattaagctcagcatccattagctattattcttaatgctctccctccccaacctccccaacaggtcccaatgtgttcccctccatatgtccatgtgttatcatcattcagctcccacttataagtgagaacatgtggtgtttgcttttctgttcctgtgttagtttgctgaggataatggcttccatctccatccatgtctctgcaaaggacatgatatcattcctttttacggctgtgtagtattccagagtatatatgtgccacattttctttatccagtctatcactgatgggcatttaggttgattccatgtctttgctattgtgaataatgctgcaatgaacatatgtgttcatgtatccttataaaataataatttatattcctttgggtatatacccagtaatgggattgctaggtcaaatggtatttctggttgtaggtctttgaggaattgccacaacgtcttccacaatggttgaactaatttacactacaaacagtgtaaaagcgttcctttttctctgcaacctcgccagcatctgttttttttttttttgactttttagtaattgccattttgactgacatgagatggtatctcattgtggttttgatttacatttctctaatgatcagtgatgttgagctttttttcataatattggttggccacgtgtgtcatcttttgaaaagtgtctgttcatgtccattgcccgctttttaatggggttgtttgttttttttcttgtaattttgttcaagttccttgtagactctggatatgagacctttgtcagatagatagattgcagaaattttctcctattctgtgggttgtctatttactctcatgatatttcttttgctgaatggaagctccttattttgattttaatttgatgccatttgtcaatttttgcttttgttgtaattgcttttggtgttttcttcatgaaatctttgcccgtgcctatgacttgaagggtattgcctagattttcttctggggtttttatagttttcggttttacatttaagtctgtaatccatcttgagttaattcttgtgtagggtgtaaggaaggggtccagtttcaattttctgcatatggctagccagctctcccagcaccatttattaaatagggtgtcctttccccattgcttgcttttgtcacatttgttgaagatcagatgtttgtaggtgtgtcgtcttatttctgggttctctattcttttcctttggtctatgtgtctgttcttgtaccagccccatgctgttttggttactataatagtatagtttgaagatgggtagaatgatacctccagctttgttcttttgcttaggatcatctcagctatttggttccatataaattttacaatagtttttttctgattctgtgaataatgtcaatggtagtttagtgggaacagcattgaatctataaattactttgggcagtatggccattttcacaatattgattcttcctatccatgagcatggaatgtttctctatttgcttgtatccactttgatttctttgagcagtggtttgtagttttccttgaaaagtttctttacctccctagttagctgtattcctaggtattttattctttttgtagcaattgtgaatgggagttcattcactgtttggctctctgactgcctgttgttggtgtataggaatgctagagatttttgcacattgattttgtatcctgagactttgctgaaattgcttaatagcttaagaagcttttgtgctgagaagatgacgttttctaaatataggatcatgtcatctgcaaacaaagataatttgacttcctctcttcctatttaaatacctgtatttctttctctttcctgattgcccttgccagaacttccaaaactgtgttgaataggagtggtgagagaagggatccttttcttgtgccagttttcaaggggaatgattccagtttttgcccattcaatatggtattggctatgggtttgtcatatatagctcttattattttgaggtatgttccttcaatacctagtttgttgagagtttttaacatgaaggagtgttgaattgtatcgaagtccttttctgtgtctattgggataataatgtctttcattctgtttatgtgatgcatcacatttattggtttgtgtacattgaaccaaccttgcatcctggggatgaagccaacttgatcatggtgggtaagctttttgatgtgctgctggattcagtttgccagtattttattgaagctttttgcatcagtgttcattaaggatattggcctgacgttttccttttttgttgtatctccaccaggttttggtatcaggatgatgctggcctcataaatgggttagggaggagtccctccttttcagtcttttggaatagtttcagtagaaatggtgacagcttttctttgtacccatggtagaatttagctgtggatctttctggtcctgggctttttttggttggtaagctagttattactgtctcaattccagaactcattattggtctgctcagggattcaatttcttcctggttcagtcttggaagagagtgtgtgtccaggatttcatccatttcttctagattttctagtttatgtgcatagaggtctttacagtattctctgatggttgtttgtatttctatggggtcagtggtgatatcccccatatcatttctgattgtgtttatttgatccttctctcctttcttctttattagtctagctagcagtctatatattgtgttaattttttcaaaaaactagctcctggatttggtgattttttttttttgaagggttttttcatgtctctatctccttcggttcagctctgatcttcgttatttcttgtcttctgctagctttggggtttgtttgctcttggttctctagttcttttagttgagatgttaggttgttaacttgggatatttctagctttttgatgggggaatttggtgctatatgtttctctcttaacactgctttaactgtgtcccagagattcaggtacattgtctctttgttctcattagtttcaaagaacttcttgatttctgccttaatttcattatttacccaagagtcattcaggagcaggttgttcagttttcatgtagttgtgtggttttgagtgtatttcttaatcttgagttctaatttgattgtgctctggtctgagagactgtttgttatgatttccattcttttacatttgctgagaagtgttttacttccaattatgtgatcagttttagagtacatgccatgtagctatcagaaaaatgtatattctgttgaatttgagtggagagttctgtagctatctgtcaggtccacttgatccagagctgagttcaggtcctgaatatctttgttaattttctgtctcagtgatctgtctaatattgtcaatgggttgttaaagtctccagtattattgtctgggagtctgagtctctttgtagatctctaagaacttgctttatgaatctgggtgctcctgtattgggtgcatatatatttaggatagttagctcttcttgttgcattgatccctttaccattatgtaatgcccttctttgtcttttttgatctttgttggtttaaagtctattttgtcagaaactaggattgcaacccttgcttttttctgttttccatttgcttggtaagttttccttcatccctttattttgagcctgtgtgtctttgcatctgagatgggtctcttgaagactgcataccagtgggtcttggctctttatccagcttgccattctgtgccttttaattggggcatttagcccatttacaatttaagattggtattgttatgtgtgaatttgatcctgtcatcatgatgctagctggttatttttcagacttgtttatcctttccatatttagtgcttccttcaggaactcttgcaaggcaggcctggcgacttccctcagcatttgctgtctctgaaaagaaccttatttctcctttgcttatgaagctttgtttggccagataggaaattctgggtcagaaatttttttctttaagaatgttgaatattggctcccagtctcttctggcttgtaggttttctgctgagagatccactgttagtttgatgagtttccctttgtaggtgacctgactttctctctggctgcccttaacatttctctttcatttcaacgttggagaatctgatgattatgtcttttcaggttgatgttcgtgtggagtatcttcctggggttctctgcatttcctgaatttgaatgctgggctgtcttgctaggttggggaagttctcctggaagttctcttgaagtatgttttccagtgtggttttgttctccctgtttctttcaggtaccagtcagttgtaagtttggtttctttacttaatcccatatttcttggaggttttgttcattccttttcattcttcttcttcctttttttttttttttgtattcttgtctgcctgtcttatttcagaaagataatcttctagctcagagattctttcctccatttggtctattctgttattgatacttgcgattgcattgtgaagttctcgtgttgtgtttctcacctccatcagatcagttatgttcctctctaaactggctgttctggctatcagctcctgtactgttttaccatggttcttacctttttttgcattaggttataacatgctcctttagctcagtgaagtttgttattacccaccttctgtagcctacttctgtcgattcagccatctcagcctccagcccagttcttagctggagaaatgttacagtcattaggagaagagacactatggctttttcagttttcagtgtttttacgttgactctttctcatctttgtgggcttatctacctttgatctttgatgttgctgacctttgaatgaggtttttatgggatcttttttgttgttggtggtggtgttttctgtttgttttgcttttaacaggccactctactgtagagctgccgcagtttgctggggatctgctccaaaccctagttgcctcagtttctcccgtacctggaaatatcaccagtgaagactgtgaaacagcaaagatgacagccagctacttcctctagaagctccatccccagggagtactgacctgttgccagtctgcatgtacctttaggaggtggctggaaaccccagttgggatgtctcacccagtcagtggaacaggatcagggacccccccaaagaaacagtctgactgtttttttggtagagcaggtgtgctgcattgccaaggccaatatcaaggtgctttgccctatgttctcttctgggagttttatgatttcaggtcttacatttagatcttttgtcaatttttgagttgatttttgtgtatggtataagggtgcaattttattcttttggatatggaaattgtttttccagcctcatttatagaagaaactattgtttccccattttttttggtgccctaatggaaaattagttgactgtgtatgtttggacttatttctgggctctctgttctgttccattggtctgtgtttctgtttttatgcaagtactatattgttttggttagtccagctttgtagtataattttaaatcagaaagtgtgtagctccaactttcttttccttctcagttttgctgtcactatccagggtttattgtggttccatactaattttatgaaaaaaaattttttttttgagatggagtcttgctctgttgcccaggctggagtgcagtggcgcgatctcggctcactgcaaggtccgcctcccaggttcacaccatttgtatttttagtagagatggggtttcaccatgttagccaggatagtcttgatctcctgaccttgtgatccacccatctcggcatcccaaagttaattttatgattttttcttctatttctgtgaaggatgccattggaattttgatagggattgtattgaatctgtacttctttgggtagtatggacattttaacaatattaattctttcaatccatcaacacaggatatctttccatttatttttgtcttggatttctgtcaccattgtttgatagctttcagtgtacagatcttttacctccttaattaaacttattcctaagcattttatttttttatgctgtcataactgggattgttttctagatttctttttcagttaaattattatttttgtttaaaaatgctactaatctctgtatatggattttgaatcctgcaactttactgaattattagttctaacagttttttaatgaatctttgaggtttttttacatgtaagataatgttgtctgcaaataaagatagttttacttcttcctttcaaatttgaattccttttatttttttcttatctgattgctcttggtagtacttccagtactgtgttgaatagaagcagtgagagtgggcatccctgccttgtactgtatcttggtggaaaagctttcagttgttccccattgattatgatgttggctgtgggcttttcataaatggcctttgttacattagttgagaagttttccttatatgcctgcgtgttaagagattttatcaagaaaggatgttgaacttgctgtcaaatgctttttctgcaccaattgagatggtcttgtgttttttatctttcattctgttaatgtgatatatcacagtggttgattggcatatattaaaccagccttgcttgccaggaataaatccacttggccatggtgtataatcctttttgatgtgttgttgaattcagtttgcatatattttattgaggatttttgcatcaatattcatcagagatactagcctatagttttcttgtagtgtctttatgtggcctaggtatcaacgtgatagtagcctcacaaaatatgtttggaagtattccctgtagctgtattttttggaatagtttatgaagtattggtggtaattcttctttgaatgtttggtagaattcagttgtgatgctgtctggttctgggcttttccttgttggaagattcttcattactacttcaatctcattatgtgttattggtctgtttaagctttctatttcttcctgattcaaacttagcaggttgtatttttctaggagtttgtccatttcctgtaggttatccaatttgttagtattaatatataattgttcataatagccccttatgatctctttgatttctgaggcatctgttggtgatttctccagtttcattttttattttatttgtttcttctttttttttccttagtctagctagatatttgtttattttattttttcaaagaaccaagtcttggttttattgatcattttctatgtttttttggtggatctctatttgatttatttctgttctgatctttattatttcctttcttctgctaactttgcatttagtttgttcttttgctagctcctgtaggtataatgttaggctgtctatttagtatcttctttttttaatataggcacttattgcataaaatttcctcttgagttcaagaccagcctgaccaacatggggaaaccatgtctctactaaaaatacaaaattagccaggcgtggtggtacatgcctgtaatcccagctactcaggaggctgaggcaggagaatcgcttgaacctgggaggcataggttgcagtgagccgagatcatgccattgcactccagcctaggcaacaagagtgaaactctgtctcaaaaaaaaaaaaaaaattcctcttagaaccacttttgctgcatctcataggttttggtgtgttgtctttccattgttacttgtctcaagatattttttaatttcccttttggtttctttgaccattgattgtttaggagcatgttgtttagtttccacatacttgtgatttttttcaagatttttcctgttattgatttctagtttcatattgttgtggtcagaaatgatactacatatgatttcaatcgtcttgaatttagattaattaaaaatagttaaatctagttttgtggcttaatgtatgatctgtcctgtagaatgtttcgtatgctctagagaagcgtatacattctgctgctattgaatgcaaagttctatatttgtctgttaggtccatttgactcaaagtacaattcaagtccagtatttctttgttaactttcggtctggttaatctatcattattgaaagtgggatattgaagacccctcctattattgtattgttgtctatttctctcttcatgtcctttaataatgttttatatatatgttatgcttcagtgttgggtgcttatatatttacaattcttatgtgctcttgatgaattgacccctttgtcgttaaattatgaccttctttgcctcttgtaacagtttttgacttaaagtcattttaactgatgtaagaatagccaccctgctctcttttggttactatttatgtagaatattttcttttaccccttaactttcagccggtgtccttatagctaagatggatctctggtaggcagcatgtagttggatcttggttttttttttttcttctatcaatttagacactatatgtcttgattggagaatttaattcatttgccttcagggttattattgatagataaggacttactcctgccattttaattgttttctggttgcttggtagatcagttgttcctttcttcctcttgttgtataagtttgtgatttgttgtttttctgtagcgctaagctttgattcctttctctttctcatctgtatcttctgtagcttcttgctttgcagttaccacaaggcttacgtaaaatatcttagagttataatagactattttaaactgaacttcagtcacatacaactactctagatttttgccctccccccacaatttatgtttgttgacacagtttacatctttttatattcagtattccttaacaactcattgtagctgtatttttgactattttgatttttcaccttcataatagagatttgaaagatttgcacaccaccattacagtggtggcacattctgaatttgactgtgtatttacctctaccagtgtgttttatgctttcatatgttttcatgatactaattatcattcttttgtatctggtagaagaactgctttaatcatttcttataaggcaggtctagtggtgaatttcttcagcttttatttatctggctgagactttatttctcctcatttctgatgaacagctttgctttgtatagtattgtttactggcaatattgtcttctttcaggactttgaatgtatcatctcatgctctcctggcctgcaaggtttctgctgagaaacactgatagtctaatggagattcccctataaatcacttgacacttttctcttgctacttttaaaattctctctttgtctttgactttccacattttggttataatgtgcctcagtgaggacctttttgggtttgaacgtgtttggtgattttgagattcatggaactggatgtccatgtctctcccaagacttgggaagttttcagcaattattttattaaataaactttctatgccttttcctcattcttctccttctggaacctccataatatgaatacttgtttgcttaatggtgtcccataagtcctataggctttgttcactcttttttgttcttttctctttcttttttttccctctgactaggctatttcagaaacctaacttcatttcacagattctttcttctgcttgttttggtttgctgttgaagctctctatttttgatttcattcatttaattctttagctccaagatttctgtttggttctttttgaataactttcttgtgcagataatgaattgttttcctgatttcattgacctgtctatctgtattctcttgtatctcagtgagttttcttaggatcattactttgaactccttttcagacagtttacaaatttctgttttttggaatcagttactggagaattattgcgttcctttgttggtggtgtatttcctggttttttggttggttttttttttttttcatgtttcctgtgtccctctattgatgtctgcacaactagtggaataatcacctctttcaaatttatagagaggcactttcctttagtcattctgttcaaaatgtagttagttgtttattcattgttttgctcttttttgtggggaagatgagcattaggcatctctagttgaccatcttgcttcctcctaacctagtttttttaaatgccatgtctcagagcactggaaacactatggtttatttccatgttttttttttttttttttttgcttatttactagtaatatagtagttttagaaatggttacttcttataattttttttaggcaaattatgagagtagacttttatactgacttgttaatcaccaattatgttgttttcttggggaaagtgagttttccaaattcttggtttaaaagtgagctttaatattgtagctcataagtttagggacttttgaatatgaaagttggatattttctacttcttaaaatagttttcagataatgatattgtgaaaattttttgatatctctaagttttaaaataataaactgtttcagagttctctaatgttactgggagtaactcaataattttatggtatttttaaataggttacagaagtatgcatattccgtaagagattcaaaactgagaggtaggtttagagataatttttgaatagcattttcacatatagatgaaaggtgccaattattgatgaaatattaatagtaacagctgatatatttctattacagatatcttaaaagatggtgctgcttatcatcatgctggtatggagctgtcagatagaaaagtagttgagggagcttttactgttggagatttaccagttctttgtaagtaaaacatatttctcgtggatactataaaatattttggaaaattatttttaagaggaaaaaaggaaaaagcgcaagtgttctgcttgtttctgcttttcttctgagaatataaaattaagtggttacctatgcatgtagatgctacagtaaattctttggtagtgtttagttctttatcatattgttgaacatggtgtaatttgaaaaacaagaatttaataggtttttggatttaaggtgtgttactattttagattgtaatgctcttttttcttttctaaatttcttatgtatgagtttttattacatttataagaatgtcttttattaaaaaatgttcctgaagcaacaaagttaaatggctcaaaattactatgtcttaatctgatgcagttactaccagtactttagctatgggagtaaatttgcctgctcacctagtagttataaaatctacaatgcattatgctggaggactgtttgaagagtacagtgaaacagatattctacagatgattggtagagctggtcgacctcaagtaagtgacaataactttgctttttatacttaaaaacatgataaaaacaaaaaaattgtgtattttttgattagcatgtcataattgtatcaggcttaaaagtaatatagcagagaaaatttacctttagtggaggaataaaagtaagacaagcctcaccaactgggacatacttccttcattctgtctaagcttgtcttggctgatgaggggatgggtttatgaatgggtatgctgttaaaggtctttttgattttgactgtttttttttttttttaaattctgaatgggggtactcttagcattttggatggaacaggttttccttgcttagggctgtcacattacagaacatgaaacatccctaggtcctagcactaaatgctaattgtgttcccaggaattatgacaaaagtccaaatacatttcaaaacataccctactctgacaaatacatgaataagtcatttttataggtattatgggaacatcaggaagattatattttcaaaacatttgtaaatattatgttgtacagttctacaatttcatagagtaaatcagattatatgtaaattataccaaatcttacaacttttatacagttaccaaagtttgttttgattttaacattgccaaaattatgttacattgaaaccaaagtgatatttacagctatactcttggaaggcttttaaattaaattttaggttaaaaaaatgagagcatttttaaggcctttttgaagtattatttcagacaaggagactgtttaatataaaatggaagtcttcagttattgaagaggactgctaccaagatgtgctcttcttcactaaatttctgtttgttttctccccagtttgacactacagctactgcagttatcatgactcgattaagcacaagggacaagtacattcagatgttagcttgtagagacactgtagaaagcaggtagtataaaaaaaagttccaaaaagatactaatgctaatatagcttattttatttccttttaaaatatcaaagggaaatttggtttggagatttttttaaggcaattttctgtaaagttttcaactatttaactagaaagtttgtgtcattttagggaatttaataatttttttaaaaggtactagttttattcagtggtatttcttggcaagcatgtattcttgtttataacaaaccctaatttgtaataaagccttagtaattatgattatgttataatttatatatgaaattatgtaaatttataattactaatttgtaataaaggagaaatatcattttcacttcttattttaacttaataatagaggaaatctggaacctattagtaaagtatttaatgtattctcttttggagaaagtaggatataatttacgcttcaacttttgttaaagcaataacctgtcttctacagccatagagtagagaggtatatctgaagccttttagaagttgaactgactttttaaggttttcttttatgtttttggaaattaagttatatttcatgaattagtaaagtagcaatgggtatattctatattattaaagttaaaaagtaagagttatggcattgaactgcatattcataatgcaaagttttttttcattagtttgcacagacatcttattgaacatttaaatgcagagatagtactgcataccatcacggatgtgaatattgctgtggaatggatacgatcaactctgctttatatcagagccttgaaaaatccatctcattatggtttgttactttgacttggaaaagtagtaattttttcaagccagctaggcctgtatttatactaataagttacaggatagatagattacagaaactaataggtaacaaaacaaaaggtaacaacagtcccaaatacatttagagacaagagtagacaagctgagaaatttttatctgttttacttctagtgtttcaacaaggtttgaaatcaacaccattaaaaatagatctagtagaaaaaaattcagctccaataaaaataacagaaatgtctaaatcattgaaaataagttagttacaaaaagttttgaattttttctgtacttagtgttcagctactcactttttctgagtttatgactgtttatttttcagtttataagaaatgaaagtatatagtactactgttgctgccacaattttcatcttgcttctaaagctaacccacatctggttatgtggcttccagagggttttttcactcattcattcaacttggggttgttgaaataccaaattaaagcctgacttgttgaagtatcattctaatgtacagaggttcaaaactttcagatctcaaagagtaattaatataagcctatattaaaagaatatctatataaatactcatatcacttaaaaacttatatttcaactaggtaatacatttacttagttcaaaaatcataaagtgaaggaatatatacaactaaaattcttccatgtatatccccacccacacagttgttcaattcctatctcttgcctttccttcccctagttctgtaatcattggtatatcttttttgtataattcttgcatataaaagtaaataagaaaatgtaattttagtttcgcaccttttaaacacaaatcgtggcatattgtattagttttccattccttttaacaaattaccctgaaacaaatcatctagaaacaaccagaatttattatctcacacagcttatgtgggttaggaatctgggagtgtcttagctaggtggctgtgggtcagatgctctcttcagattgcaacatatgtcagctagggctgcagtcatctgaaggctttcctgggtcttgaagattcacttgtaaattgtctcactcacagagctataagttagaggcctcagtttctcacagttgttggcaggcctcagtcttttgccaggtggatctttcctcatagcatggcagctgacttttctcaggatgaatgatctgagagagaaagagagagagagacagagacagagacagactaaatcagaagcagcagtacttttttataactttgtctctgaagtcacacatcattacttctgctttattctgttttttagaagcaagtcactgagtcctggtcacatgaaggcgagagggattaagttcatctctcagagggcagaatatcaaagaatttctgggcattttttttttttttgagatagcctctcttgattgcccagactggagtgcagtggcacaatcttggctcactgcaatctccacctcacaggttcaagcaattctctgccttacccttctgagtagctcagactacaggcacgcaccaccacacctggctaattttttctatttttagcagagacggcgcttcaccatgttgaccaggctggtctcaaactcctgatctcaggtgatccacctgccttggcctcccaaagtgctggtattacaggtgtgagccaccatgcctggccttgtggcatatttttttaaacctccattattttagtcttctgcacattcctttttttcttagtatgtcttggaagcttttttgagacaggctgtcactctgttgcccaggctgaagtccaatggtgtgatcacagcttactgcagcttcaaccttctgggctcaagtgatcttctcacctcagccaccagagtagctggtactacaggcacatgccagcacacctggctaacttttgaaaaaaaaaattgtagaggcagagcttccctatgctgcctaggctggtctagaacttgtgggctcaagcaatcctctgatttcaccctcccaaagtgctgtgattatagctgtgagccaccatgcctggctggaagcttttttttgtaatagctaaataatattccatttacttatgtatcacttatttaaatgatccccaattgatggacatttatactttgtctaattgtttgctcttacgaacaatgcagcaaaaaaacccttcattttttacatgtatgaatctatccgtatgataaatctctagaaatgaaattcctgtgtcaaaggatatatgcatttataaatttgatacctgtggctaaattggtaccttagtagctcatatatctaccagcagtgttcaaaagtgccatattttgtttctccagcctttccttcagggtgtatgcttgtgtatttttatcaatattatgtatgaatattggtatcttttcatgttttaattttcatttcttccttttcatagttactttattttctgtagttacttttttgtattgagatatcacttatagtaaactgcacaaatatgaggtgtagaggtcaatgaagttttatatatgtgtttatacacacatatacacacatgtaaccacagcccagattaagatatagaacattttctagatgttccctcatgctccttttctgtcagtatttgcccccagaagtcaatgctattctgacttacataccataggctagctttatctattcttgaaaagattccgtttatatgaatataaatcttttgatgaaaggaaattattaattttaaataatgctgctgtgaacattgttatatgtatatcttttgatacacatgtatatgtatatctgtgggtatgtgcctaggagtgaaattattgtgttaaagggtatgtgtagtttcagctttagtgaatagcacaaaatggttgttattaccaaacatattttcctaggaacattcatgttataatgaaagttcattagaagatattaatcacttgatagatacttgctatgtataaaacatttggaaatttattccataccattcttgttaaaatatgatattcctgttcattgtttctgtggatatttaagccttgtttgaactcaatcagctgagatttttttttcttatataagatttcattagactgctcttcactagttaactggggtataaactgagcctgtaaagatgagctaaattctattttactttttcatgacatgcaggttttgcatctggattgaacaaagatggaattgaagcaaaattacaaggttagatgcatttcattctaaaaattagattctatatattttagtgaaaaagttcagttattgtgaaagtaagaatatgcttttgtaaatcattttttaaaaaggaaacttgtctgcagaaaaataatgtgaactatttctttttcacacaaaaagcttggcatatatacttttttgctgaattaatcaatttattctatcagaatatctttctttgtataatatgttaacttggtttatttggtttttatttctaacatcaccctggtctttgaaaatatgcctacagatacacactctgtattttttcttttttttaaaagagacagtcttactctgtcacccaggatggaatgcagtggcgtgatcatagctcattgtaaccttgaactcctgagctcaaatgatcctcctgagtagctgggactataggcgtgagccaccacaactggttaattttgtattttttttagaaaggggttctcactgtattttccagcctggtctcaaactcctggcctcaagttatcctactacctctgccttccaaaacactgagaatgtagctgtgagcgaccatgcccaacatgtatttttcttttctacttaattttaattgaaaaatataagcctagattgattatgggctttgtatcccaacctgtgccaaagatgtattcctatccaacctcagctttgttatttagttaatcaactagtgtttcttacttgttttttaaaatataaaatattgttaggcatttattcagattagaaattgctaccttttcattgtgttgaaactgtctccttagtaaaagaaaatatgttaggtcctctaaaaatatttagccaatttaaatttattctctacttggatatacatgtgtggcaaataaaaatgcagagataaagataaagcagtaaaattgtcttgcttaaagaataaatatgttcttaaaacatggtcataaccaatagcatatattcataatgctgctgtattcacgttgaaatacagattataagttgtgttatcttcaaggtattgataaattttgtaatggaatttttaattaaacatatattttgaaaataatgatcaaatacactcaagaaattagacaaagagatatattgctatattcagataactttaatgttttatctcttgttaaattagcagaatcacagctcatacttgccttgtcttcagtcagtatagggttagcaaagttttgccttataaacaagaatagctaaatataactgaatattaaggttttggaattgtaggagagaaaaaaagtaacatcttttcctcattcattgcaatgttcacagctgacactcctgtaacaagacagattaacaagagaaaagcataacaaatttatttaatcaaagttgtgtatgatatgggagccttcagaaattaagacccaaagacccagggaaaactgaatttctctggcaattctaatgaaaaaaatggatagttgttgagaaacatgactggacaaaaagggtattatctaatgttaataaactgggaggaacttaacaaggcctgtttgttcagattcttcttggcctctctatgtagcattctttcttctcgggcatgagataggaccattccgtgggtatgagacaggaccattccaccctggaatgagggtcttagacttttagacaaggtaggtcagagaattcctttatgaccatgcttcacacagaaaggcagggaaagatcagagtgactttcttgtttctgaagtcctcttagtcttattgagttcgaaatgccttgagtcagcattttctgagccctgctattatccttggagctctgccttaaatctgtcaggaaggatccttagcatagtatatgctgtttcctaaacttgattatactttcttgcttagtatactcttaatagcttccccgtcactcttagaataaaatacaaactttcaccacagcccacaaaatcctgcttgatatctccctgcctatttctctaactacatctcttatcactttctgtctcttttattctactctcaccaaattggccttcttgctattccttaaacacaccaagcttgttcccacatcaagtcctttgcacactttgttccttatttttggaacactccttgcatattttacaccttcattttattcaggtctctgttcaaatattaacttttagagaggtcttcctgtggtatcttactgagaggaagacaaaatgattctatgatgttgttgttttccttgtttttagaaaaggtaatgtgtttattttgacaattagggtgaggatagccttactctatatcaaaatatgtagcgtttatgagaaatacatataggttgggcatggtggttcatgcctgtaatacctttgggattccaaggtgggcagattgccttgagctcaggagtttgagaccagcctggacaacatagggagatcccacctttacaaagtttttaaaaaaaatgagctggtgttgtggtggtacatgcctgtagttccagctactcgggagactgaggtgggaagattgcttgggcctgggaggttgaggctgcagtgagctgtgatcatgctactgtattttagcctgggcaacagagtgagaccaagtctcaaaaaaaaaaacaagaaaagaaaagaaatgaaaataaaaagaaagaaaaagaaaggaaaggaaataaagataaggtttagtaaaaagatttaaaattacacagtcattctatataggttcttagccttatgtttctttatagtatatgtgaaaccttattatttatttgtatgttaattgctttcttctgtaaaatataagttctaaagagaagaaccttatcttgttaactgctgtaaacatagagcttagaatcatgctcagcttatggtaaagtaagcatttttcattgacttatcgagtagtgagtgggtaatgaactgatttaatagtgggtaattaagaaaattagaaaagacttcaaaatctttacttaaccaaacgcttaacactatcaagctgtctaaagagtgttgcttaaactaaaatatttcccaaagaactccaagggtgtttttttgagtggctgctctatttaggattgaactattacagtattcccactgtctgctctgaactatcttatatctcctggactatagcatgaggcagagaaggaactgtcagcagcagattactacaattgctctgatccccatcaatagtgagcatgaactagcattgcttcctgtcagagaaacaaaagtaaacacctaaaagcatcagttaaaacagttttaagtttttgcttcaagaaagtggcaaacagggaggaggggaagaactggtggtttttggaataatctttgcagaactatttgacttcttataatttgtgcatacattaatatatctttgatagaagtttaaagaaaaaagaaaaagaaaactattgccttaatggagggcagatagcaaagtggttacttagacctggagcaagttacttagcctctattctttagtttcctaacctatatatgaaaatatcggtgtctaccttattgtgatgttttgaagattaaatgaggtaatacatgtgtatcatttaaatactccaagttttaagtgttatttctacttactgaatgttatttttattacttgtattcttgttacttttagaaaatgtttttagcatattagttagcttttttatttaaatgagctttctcttactgcttaagtagggactatggttcttctagaacagttacacagtaatagcacaactttagcatatttaataataaattatttttccctacttccctattttactaaaattaaaatgtgttttctataattaaacagaattatgtttgaagaatctgaatgatttatcatccctggacttaataaagatggatgaaggtgttaatttcaaaccaactggtaatttcttatcattgtcagtaaatttagcaattgtttacttaagactaaattaaaattttgttttactaaaatttagatggtgataaaactaaattgtgatctcagttctcaacagggtatcatcattattagccataggcatgataaatttaaacaagtcctatttgtaatagtttttttttttttttttttttttgagacagagtctcactcttttgcccaggctggagtgcagtggcgagatctcagctcaatgcaagctccgcctcccgggttcatgccattctcctgcctcagcctcccgagtagctgggactacaggcgcctgccaccatgcccggccaattttttttttgtatttttagtagagacggggtttcaccatgttagctaggatggtctcgatctcctgaccttgtgatctgcccacctcgggctcccaaagtgctgggattacaggcttgagccaccgtgcctgggcacaggtgcacagaatttgtcttcactgattctggtgacttttggcagaggaatgaaatgcttgaatctttgggttgctttaaacctgttataactattatagatatacttttattggtatgcttttaatatgctttttatattcttaaatattcaaccattgataatctggtggttagacttctgtaaggttagtaaaaatatcttttccttctactcatcttaggttcattaactgggactcatataacaaaatgtattaacaagagaaaagcatacaactttatttaatatgttttatgtgacatgggggcctttataaggaaatgaagacccaaagaaatggttaaacctgaatgtttttatgccaggtgtgatgaagattgaaaagtcatggagaaatatgataggacaaaggggatatgaactaagtgtaataaattgggggaaatttagcaaagcctgttcattcaaattccactctgtgtctatggagataaagatgctccattctttaggtatagggagggcacctctcacatgatggtgttattacttgcttcagggaaaggccagaagaattcttcctgtacatgttgtttctcaaattcctacagcttaaaatattcaataagccaagatgctccattttgggatagcgtgtcctgaatcctatctctctctctttctctctctctcacggtggattagctttttgatgtgcttctggatttggtttgctagtattttgttgaggatttttgcatctatgttcatcaggaatattcgcctgaattttttttttttttttttcattgtgtctctgccaagttttggtatcagaatgatgctggcctcatagaatgagttagggaggagtccctcctcaaatttttggaatagtttcagtaggattggtgccagctcttctttatatatttggtagaatttggctgtgaatcagtctggtccagggctttttcttgttgatagtctttttatttctgattcaattttgaaacttgttattggtctgttcagggtttcagtttcttcctggatcaaccttgggaggttgtgtttccagcagtctatctccccatttcttctaggttttctagtttgtgtgtataaaggtgttcataacagtttctgggttttttttttgtatttctgtgagattggtggtcgtatcttctttgtcatttctgattgtgtttatttgtctggtttctgtttttttgtttgttattctagctagcagtctatcaatcttatttattctttcaaagaaccaatatctggttttgttgatcatttgtgtggttctgtgtctctcaattttgttcacttcagctctgattttggttatttctattcctctgccagctttggggttgatttgctcttgcttttctagttcctctaggtgtgatattagtgaggttgctaatgtgatacttctagctttttgatgtgagcatttagtgccataaacttttctctgaacattgttttacctgtatatcagagattctgctatgttctgcctttgttttcatcagttacaaagagtatcttgatttctgccttaagttcattattttcagaaaagtctttcagaagcatgttgtttaatttccatgtaattgtatggctttgaaagatcttagtattgatttctgtttttactgcattgtggtctaagaatgtgcctggtatgattttttttgaatttgttgagaattgctttatagctgaatgtgtggttgattttagagtatgttacatgtgcagatgacaagaatgtatattttgttgttgttggatagagtgttctgtagatgtctgttaggtccatttggtcaagtgtcaagtttaggtcctgaacatttttatttgttttctgccctgatgatctgtctaatactgtcagtggggtgttgaagcctcccaacattgtgtaggtatctaagtctctttgtaggtctataaaaacttgttttatgaatctgtgtgctctagtattagatgcatatatatttaggatagttaaatctttttgttgtgttgaactttttcatcattatcagtgtccttctttgtcctttttgatagttaaggtgtaaagtctgtcttgtctgaaattagaatagcaacccctgctttttttgttttccatttgcttggtagatttttctccatccctttaagcctatgggtgttattgcatatgagatgggtctcttgaagacaacatacagttgggttttgcttctttatccaacttgtcactctgcgccttttaagtggggtattatagtctgtttatattcaaggttgatattggtatgtgtagatttgtcattgtgttgttatgtagacttgttatgttatgttatgtagttgctttatagtgtcaatggtctagatactaaagtgtgtctttgtggtggccagtaatggtctttcatttctatgtttagtactgtcttaaggacctctcataagacaggtctgatgcaaacaattcccttagcttatctgaaaaggattttgtttctccttcattgatgaagcttattttggctggatatgaaacttatggttggagtttcttttctttaagaatgccaaggctgggcacagtggcttgtgcctgtaatcccagcactttgggaggctgaggcaggaagattatttgagcccaggagtttgagaccagtctgagcaatatagtgacaccttgtctctacaaaaaatttttctaaaaattagctgagcatgatggcatgtgtctatagtcccggctacttaggatgctgaggtggcaggatcacttgagcctgggaggaggaggttgcagtgagccaagattgcaccactgccatccatcctgggtgacagagtaagaccctgtcaaaaaaaatgcttaatataggcccccaaactcttctggcgtgtaggatttttgctgaaagagctgctgaaagatctgctgttagctttatatgtttccctttgtaggtaacatatacctttctgtctagttgccctgaatattttttctttcccattgatcttggagaatgtaatgactatgtgtcttgggggatggctgttctatatagtatctcactggggctctctgaattttctgaatttgaatgttgacccctctagcaaggtcagggaaatgttttgaactgtattctcaattatattttccaagtttcttgctctctctctctctccctctctttcagggctaccaatgagttttaaattttggtctctacataatcccatatttcttggaagttttgttcattcttttttattcttttttctgtatttttctctgactgagtagacttgaaaacctggtttttgagctctgagattgtttcctcagcttggtttattctgctgttaatacttccaattgtattatgaaattcttgcagtgagtttttcagctctatcagatcagtttggttctttgttaaaatggcgattttgtccttcacctgttaatcattttactgggttccttagatttcttggattggacttcaactttctgatgaatcttgatgatcttcattgccatccagattctgaattctaggtctgacatttcagccatttcagcctggttaagaaccattgctggggagctgtgtggttgtttggaagtaagaaaacactctggtattttgagttgccagggttcttgctttctggcaagaacatcagcccagacagactaattgtttttcgtctgtctgggctgatgttcctttaatatttgaagttgctgtccttcagatggggctttttcttttatattccttgatgtcattgagatttactgtggcataagttgggtttagttgactggctttgtttctggatgatttcagagggcttgggctcagctcagtgctcctgggctgcatgctcatggctttgtttgctggcccctcgaggttaagtacctgctgcactggagggttagaggtgttcctggttcactggcaatcacacttaaatggggcagtggcagaaggttacgcactcatgtgtaatgccaacagtggctgtatagtagcatggtgaggtctgggtatgtgcaccagtggtggtggcacagcagggtccatgtttgcagtgtatcagcagtggcaagacagcagcatagtgggatccgcatgtaccggtggtgcactggtggggccacggccgtggtgacaaggtccgtgcaccatgtgcatgctagcaaagtgatgtggggaggccatggttgagtgcatgccagcagagtggttgggggaggctgcagacaggtgtgtgttggcaaagcagtgtgaggaggctgttggtgggtgcacatcggcagggtccatctaatggttcagtggcatctgctggctaaggagctatggtggtggccactaggcggtgccccagttgggcaactgaggccacactgcaagtgagcttggccatggagggaccccagaagaggctggcagtcagggggcactcagataagactggccccatcacatggacaagactgccctgctctgtctaggtccaacagtcaacaaaggccaaaaccacttagaggagcatggcaggccttgggggattggcattcctgactgtactccactgtagccattcctgtgccaaaccctttgggctccacacagggtggagtcctgtccctgccatttctccaggcagttctctctgccaatttaaatgtctgtgggggtcatgaggtcttctgcagctaagattccagaggtccgtgacaagagtgggccactcctcacctgtttaactcacccttccccaggagccaccaggggctgggaatgagtcctggtgctttgaagcccactgcagtgttcccagcttctacctagggtctgtgtcttccctccaaccaccctcaatgacttccttctgaagatctgcttcgagtgtgctggtcttcctgatggtctggtcttttggtgggagatgctcttcctggctgtgtccagttggccctcttggttctcctcctcctttctcagttcctgaaggatggaagcctgagttaagtgtgctgacatggtcagattctgttgagggttctcttcctttgcacacagtcatcttcatgctgtgtgctcacatgatttcttatttgtacatgtaatttcttggcttttctggtgttccagagttctccctatggatctcccagtatctgcaggtcacagggtgacagaggctgcagccaagttacctgaggcctcccggaaaaaaggggatgcagtactggagacgggactctgagcttccccatcaaattgtggaagatgctgcaccatgctgggtttgtaatttcttagcctgttattaatgtagatgtaattttcttacatagtatttctaattaattcatttttatgacttcttattccttcatattactaatactttattttgtctctttgagtttattttttgtatatcagtttttagtttgtatgttcctataattctgcttcatatagtttttgctttttaggttgtaatcataatactcaagtatctaggtattttcatctgtatgtttgcattgaggtttttacctgtttgccagataatgtgtactgagagaagggctcaaaaggccaattttttcccgcttcaactgttctggtatatgagcagatgtgcaggttcgttacaggtaaacatgtggcatggtggtttgctgcacagatcataccatcacctgtgtatcaagcccagcatccattagctattcttcctgatgctctccttcccctcgccctccccaacagaccccaacgtgtgttgttccccacaacgcgtccacgtgttctcattgttcagctcccatttataaatgagaacatgcggtgcttggttttccgttcctgtgttggtttgctgaggataacggcttccagctccatccattttcctgcagaggacatatctcattccttttcatggctgcatagtatcccatggtgtatgtgtaccacgttttctttatccagtctttcattgatggggatttaggttgattccatgtctttgatattgtgaatagtgctgcagtgaacatacgtgtgcatgtatctttacaaaagaatgatttgtattcctttgggtatatacccagtaatgggattgctgggtcaaatggtatttctggttctaggtcttataggaattgccacactgtcttccgcagtggttgaacttatttacactcccaccaacagtgtagaagcattccttttaatctgcaatcttgccggcttctgttgtttaatttctactgtgaatttaagaaagattaaccttctgaagataggtggtaactgcaatagtctggaagagtcactaaactgggatgcagatcttacctctttgaaggatagggatagagggaaagaagaaaggacaggatggagggaagtaggaaaagaagggatggaggtaaggagggaaaggggaggagggtaggaaggaatgcagggggagggaacatggtggggcagagagggagaaagtatgagaggaaggaaggatgggatggaggaagggatgtttttagacaacttataattgaatcccataactctggaaggaagggaggaaggaagggagggagggagggagagagagatagagatagatcttagcctgcaaggagggaggcagggatcttagcttgcaagaagggaaggaggaggggagggtaggagggattttagcctccaaggaggatgggacagagaaagcccttggaggatcttagcttgcaagaagggagggaggaggggagggcaggagggattttagcctccaaggaggatgggagagagaaagcccttggaggatcttagcttacaaggagggaaggagagagggagagagggagggagagaggggtcttagcctgcagtgcaatcctaagaacatttggcaaagttgataggaactcttatagatgtaccttagcatccctgccatgctcagtcattgactggggccatctcatgaaagtatgatctcggtgtaaacatgatgatgattcagagcacagcagctggggccatcagtcactgacacgtcttgcagtaggaggtctgaaaggtacattctcatgtcctccatgctccctaccactgtattttatgaaatatcctgaatttcctgttagaatattaatctttgaaatatcctgaatttcctgttagaatattaatctttgaaatatcctgaatttcctgtaagaatattaatcattcagtagctatattaatagcaagttgtttctttatttccttgctttacttgcaaatctttaaaaattacttttcattccctctgctttgactcattttccttatgctttcctttctaggttatgtttttctgtcttacctaggaaagcttcatctctattaataagccaacaagtattaagtcttttcttaaaacctttcattttctctatcaggaagagaccttatattaacttataaatatttagggtaagaggaccatctttaaatatactgcaatggttaactagttctcgtggtaattataatcttgatatttcacacccttctctcagaagctcctttttataaactaatccattattcacatgttggctgaacatattcaccaggatcctaattgagagcctggctacttctctattcctgattgttagttttatctattgtaccatgtccttggtgcttgtaactctgttggaatgccaaaaatcttttcttcttcagcaaaacatttagcacatacgtaaatgttagccctttccttgagaagcaggatgctactttcttcttcccagctgttttctatgtgttcataaggcttgaaattctttggaatgtttttagacaacttatcgaatccagtaactttttttttttttttgagacagagagtcttgctctgtcacccaggctagagtacagtggcacgatctcggctcactgcaacctccacctcccgggttcaagcgattctcctgcctcagcctcctgagtagctgggactacaggtgcccgccaccacgcccagctaatttttgtatttttagtagagacagggtttcaccatcttgaccaggctggtctcgaactcctgacctcatgatccacctgcctcggcctcccaaagtgctgggattacaggtgtgagccaatgcgcccggccgaatccagtaacctcttaagtgaattccatttcatcagttagttacccccatttctcccatactcctacccacaaccaatctgctgttctatttccggaataacttattttcagactccagtttaattaaaatattgctcaagaattttaagtggtcacctgttattttataaatcaaatccaaaatataacctcttttaatatcatttgagggctctttcagggcctctctatcatttgtcatgttttaataataaaaataggtaacacattaaatattaggcaccatgctaagtactatatatccatttttaattgcacttaatcttctccacaacaaacttctgaggtgtgggtagttttattattcccacattacattaagaaactggtcacgtaacttgtgcatgatcacttgcatacccaataagaggaggagcagcgattctaatcaactcagtctgatcaggactcataatcactgtcaagccatatgtttttccagccatcattacagtattctaaagatagtctttttaactttactctttggataaacaggattttccccaacgtcataatggcattatttcctctctactaaagcatattagtcactttaaaaacccttctcaagatccattatttgtagtaggccactctacactgaccattcctcttaggtttgatttcctccatactcaagtttgtatgtaaatactaacattagctgattttttgtcgtctaggtacttagcatgtagttatcttcctagccaacctataaattctagagattgtgtcttctacattttttggtatgtcttttgtgcctggtggcattacaggcacaaagtacatgttaagaaaatgttttaaattatttttaaatttttgtcggtaaatggtaagtatatatatttatagagttcatgagatattttggtgcaggtatgcaatgtgtataatgatatcatggaaaatccatcccctcaagtatttatcctttgtgttacagacagtccaattatactgtttaagttatttttaaaatgtacagtcaaattattattgactatcgtcaccctgttatgctatcaaatactaggtcttattcattctttctgttttttttttatttttgtacccattaaccatccccaccaaactcccctccaccctcccactacccttcccagcctctggtaaccatctttctactctctatgtccatgagttcaattattttgattttcagattccacaaataagtaagaacatgcaatgttggtctttctgtgcctgtcttatttcactcagcataatgacctggggttccatccatgttgttgcaaatgataggatctcattctttctgtggctgattaatactccattgtgcatatgtaccacattttctttatccattcatctgttgatggacactaagttgcttccaaatcttggctattgtgaacactgctgcaataaacactgagagtgtagatacctctttgatatactgatttcctttcttttgggtatatacccagcagtgggattgctggatcatatagtagctctctttttagttttttgaggaacctccaaactattctccatagtggttgtactaatttacattcccacccacagtgtacaggggttcccttttcttcacatcttcaccagcatttattattgcctgttatttggataaaagccattgtaactgcggtgagatgatatctcattgtacttttgatttgcatttctctgatgatcagtgatgttgagcaccttttcatatgcctgtttgctgtttgtatgtcttcttttgagaaatgttgattcaaatcttttgcccatttttcaactggattattagattttttcctgtagagttgtttgagctccttatatattctaattattaatcttttgtcagatgggtagtttgcaaatattttctcccattctgtgggttttcttttcactttgttgattgtttcctttgctgtgtagaaagttcttaacttgatatgttcccatttgtccattttttgttgcctgtgcttgtagggtattactcaagaaatttttgcccagaccaatgacctggagagtttccctaatattttcttgtagtagttttgtagtttgagttgttagatttaagtctttaatccattttgatttgatttttatatatatcaagagatagggggtctagtttcatttttctgcatgtggatatccagttttctcagcaccatttattgaagagactgtcttccctaatgtatgttcttggcacctttgtcaaaaatgagttcactggatgtgtgtggatttctttctgggttccttattctgttccattgattgatgtgtctgtttttatgccagtaccatattgttttggttactatagctctgtagtatagtttgaaatcaggtaatgtaattcctccagttttgttctttttgcttagactagctttggctattctggatcttttgtagttccatataaattttaggatttttttttccctttctgtgaagaatgtcattggtattttgatagggattgcactgaatctctagattactttgggtaatatggaaattttaataatattgatttttccaatccatgaacatggaatattttttcattttttggtgtcctcttcaatttctttcatcagtgttttatagtttttgtgtttctttgtttgtttgtttttgagatggagtctccctctgtcgcccaggctagagtgcagtggtgcgatcttggctcactgcaacctctgcctctcgggttcaagtgattctcctgcctcagcctcctgagtagctgggattacaggcgcctgccatcacacccagctaatttttgtatttttactagagacagggtttcgccatgttggccaggctagtctcaaactcctgacctgaagtgatctgcctgcctttgccttccaaaatgctgggattacaggcatgagccactgcacccaaccagtgttttatagttttaattacaaagatctttcacttctttcattaattcctagatatttaattttaattgtggctattataaatgggattacttttttatttctttttcaggtttttcatggaatattttttcattttttggtgtcctcttcaatttatttcatcagtgttttatagttttaattacaaagatcttttacttcttttattactttctagatatttaattttagttgtggctattataaatggattactttttatttctttttcagagttttcactgttggcatataggaatgctactgatttttgcatgttgatgttgtatcctgcaacattactgaatttattatttctgacagttttcttgtggattctttatgtttttccaaatataagattatttcatctgcaaacaaggataatttgacttcttcctttccaagcgaatgtcctttattaatttctcctatctgattgctctagctaggacttccaatactatggtgaataacagtggtgaaagtgggcatccttgtcatattccatatcttagaggaaagcttttccgtttatccccattcagtatgatactagctgtgggtcatgatatatggctttattattccttctatacccagctttttgagggtatttatcatgaatggatgttgaattttatcgaatgctttttaagcatcaattgtgatttttgttcttcattgtcttgatatgatgtatcacattggttgatttgtatacgttgaactatccttgcatccctgggataaaccccacttggtcatgttgaataatctttttagtgtgttgttgaatttggtttgctagtattttgttgagggttttgcatcaatattcatcaaagatattggcctgtagtttcccttttttgatatgtctttgtctggttgtggtatcagggtaataacgtcctagtagagtaagtttggaagtattccctcctcctctattttttgaaacagtttttgagcaggatttgtggtagttcttctttaaatgtttggtagaattcagcagtgaagccattgggtcccaggcttctctttacagggagactttattatggtttcaatctcattacttattatttttctgttcaggttttgggtttcttcatggttcaatcttagtaggttgtatgtgtctaggaatttgttcatttcttctagattttccaatatattggcatgtagttgctgctagtagccactaatgatcctttgaatttgtatggtatcagttgtaatgcctcctttttcatctctgattttatttatttggatattttctttttcttcttcttctttttttttacttttataattttattgacttttttctttataactttaaaacaaaaacagcacatgaaaaccagtgtcttatcccaaagtctcaactcagctgattgccagatgaacatcaccgtcttactcctctgaataactagacacaaattacatagcaagttcgagtgtctgcccacccaagacacagccagcaatcagtcacagacatagacacagtcaactccaggggctccagctctctgcctatcttctctcagcagttcctcccatctgctaagatgcgccttcctgatggctgtctctcaaggtgggtcaaggctgaacaagacagaaaagcagtctaggtccaccatcacctcccactggccaccagttggccagccaggaaatcatttttgtacatcttttgtctcccccttttatctccctctctcttctccaaaacttgttgctatctatcactttcatgtaacaatggacttattgtccatccactaaactgcctgagaagtggtttgagcctgacatattttcctgagctaaaaaaggaaaagtacctctgtggccttcttgccattaagatcaagtaaaaaagggactagcactactgaaaagggtcacgctagaaaaaccttagaatgctctctccacccctgtgaaggtttctctagctgtagctcttaagggtacaagagggcaaatattctggtgtcaaggaggtataatggggaaacacatttattttccccttttaaacttccttgctgccccagtctttgccttcttcttagtggatccctttgattctggctccttgcacttagctgaagagagtgagccagtcaccttgaagaaatcatccaggcggccctgggtgctgccttaatgactcttactcagcctcttgaccccactgtggattcgctcctcagagaactgcttttcaccacacacgaacttgaccagctcttcttcatttggctcgctccacttcagctccacagactctgggcccagcacctcaggttccaagaagagctggtaagcctccttgtggagccgattttctggcaaagggtacttgttggggtcaagtcgctgcacgatctcctcgatgctcttgtgcttctggattagatccacagcccgcttgggcccaatactccagatactcttacagtagtcactgcctagcaggatgcacagatccacaaactgttcctggttctagctcctgcagaatccagctcaggtggaattcctggattggcagctttttggcttcactggcagtcaggtgttgcattagcacagggctgccgaaggtgaagcagtccatgtcctcggtagccacaggatagactttgccagccttcaccagggcagcacagctggcctctgcctcgatgggtgcatcaaggtaagggatgcccatgaggctcagcagatgtttgcacttatcgttgtgctgcttagtgaccttcaccagccacttagtgaatttttccaccacctgctcggccccagcagcctgagcctgctgtagctgcttctctgcctcagccccgcagttcactgcatttggccagctcgcctgacttgtgctgtggtggcgtgccctcaaagacatacatgggcttgatgccgttctccatcacgcgaatagtgcggtagaacatgcctatcaggtggctggtggtctcaccctcctcgttctgcagcacatccccaccctggcgaacagcaatcaggaactgataagtgctcatagaggcatcaatggccaccttacggccaaagtagctcttgatgtcattctcccgggtggcactgggggccacatcagcaattagtttggccaggccttgaatacccatggcaacacagaggagggatgactggcctttgggacacgaggcctcggcggctaaagcttgattcagggttgccctgggcaggcggtcctaagcccactttcccccctcagcttagctgcgggtcgcctgacactcagcccttctttttcttcttagtctggctaaaggtttgtcaattttgttaaccttttctagaaaccaacatttttgtttcattggtcttttgtattgttttcttcatttcaattttatttctgctctgacatttattatttcttttcttctactaattttgtgtttggttagcacttgcttttctagttctttaagatgcatcattaggttttttatttgacatttttcttcttttttgatgtaggcacttgtagctataaactttcctcttcatactacttttgctgtatcccattggttttggtatgttgtgtttccattatcatttgtttcaaaaaatttttcacttttcatctgaatttattcattgacgcgctggtcatttaggagcctgttgtttaatttccatgtatttgtatagtttccaaaattccttttgctatttatttctagttttatttcagaagatgcttgatattatttcaatttttaaaactgttttaagacctgttttgtgacctaacatatggtctctccttgaatgatccatgtgctgatgagaaagatgtgtattctgcagctgttggatgaaatgttttgtaaatatctatcaggtccatttggtctatagtgcagattaagtttgatgtttctttgtcgattttctgtctggatgatctgttcagtgctgaaagtggggtgaagtctccagctatcatcatattggggcctatctctctctttatctctaataatatttgctttatatatctgggtgctcctcactataacctccacgtcccaggctcaagtgaccctcctacctcagccccccaagtagctgggatcacaggcacatgccaccattcctggctaacttttttgtatttttggtagagatggggttttgccgtgttgctcacgcttgtctcaaagtgctgagctcaggcaatcctcctgccttggccttgcaaattgctgggattataggcatgacccattgtgcccagcctcagtctatgtatttttattggagactttagcccatttacattcaatgttattattgataagtaggaacttactcctgccattttgttatttgttttctggttgttttacagtcttctcttccttctttctgtcttcctgtcttctgttcagtgaaggtgattttctctggtggcatgctttaatttcttgctttttattttttgtgtatctgttgtatgtctttcaatttgaggttaccatggggtttgcaaatactgtctcgtaacccattatttcacactgatgataacctaacactgattgcctaaacaagcaaacaaaaatgtaaaaagaaaactaatagacactctacactttaacttcatccccatgctttttacctttttcttgtttccctttacatcttattattctgtgtcttgaaaagctgttgtagctattatttttgattgcttcatttagtctatttaagtcaagagaagtttacacaccacaattacagtgttataatattctgtgtttttctgtgtgcttactataaccagtgagttttgtactttcaaatgattttcttcttgcttattaacatccttttctttcagattgaagagcttccttgaacatttcttagaggacacgtctggtgttgatgaaatccctcagcttttgtttgtctaggaagctctttatttctccttcattgttaaaggatattttcagcagatatactattctagagtaaaagggttttttttttctttagcactttaaatatgtcctgccactctctcatggcctgtaaggtttccactgaaaagtctgctgccagacacattggagctccattctatgctgtttgttttttgctgctcttaggatcctttctttatccttgacctttgggagtttgattattaaataccgtgaggtagccttctttgggttaaatctgcttggtattctataaccttcttttacttgaatgttgatatctttctctgtgtttgggatgttctgtgatactatgcttttgaataaactttactgccatctctttttgtactgcttctttaaggtcaataactcttagatttgcccttttgaggctattttccagatcttataggtgtacttcatttttttaaaattattttttcttttgtctcctctgactatgtattttcaaatatcctgtcttcaagctcacttactgtttcttctgcttgatcagtgttgctgttaagatactctgatgcattgttcggcatgtcattgcatttttccaactctaggatttctgctttattctttttaattatttcaatctctttgttaaatttatctgatagaattctgaatcctttctctgtgttatcttgaatttctttgagtttcttcaaaacagctattttgaattctctgtctgaaaggtcacatatctctctttttctaggattcattcctgctgccttgtttagttcacttggtgaggtcatgttttcctggaggtgttctttggtgtctgagcattcagcagctaggtatttattctagtcttcacagtctgggcttgtttttgcctgtccttcttgagaaggctttctaggtattcaaagggactttggccataagcccgattatgctgtggtttttgcagattcgtagacctaccaccttggtgttcatggataagatggagaagaattctctggactatcaggcaaagactcttgttcttttcccttactttctctcaaaaatacagattctctctctctgtgctgagccacttggaattggggctatgctgatgtaagcactcctgtgggctgggactgtgctgggtcagacctgaagccagcacagcactgggccttcccaaggcctttcacttcgggatggtgagttcccccaggtcctgggtgtgtccagagatactgtctgagagactgtctgagagccagggattggaagagtctctgcctgtggccacgaccttcactggtcctcagggggttgtgccaagtcatcactgatgttcacttaaagcccaagggctcttctgtcagcttatagtgaatgctgccaggcctgggactatgcatccttcagggcagtaggctccccctctggcccagggcaggtccagaaatgctgtcttaagagcctaggcctggactcagagaccccaagagcctccttgttgctctacccagccatggccaagctggtacctgatttttgattcttgtgacagtacttttctgtgtgcagaaaagcaattagagtgcttttgtgtgtgcagattgttgttaaaatttggtgttcctgcagtgaggaccaatggtctaggcttctgttctaccatcttgcttctcctcccctcaggaaatgtttgttaaacataaaaaaacagttggttcagctgatgaggggaccgttcatttttctgtcttttcttacagaagcaggaagattgatggcttggtattatattacatttgagacagtgaagaaattttatacaatcagtggaaaagaaaccttatcagatctggtaaattaattttcactagaaaaaaaatacatagtggtatagtataaaataatatttgagaaacaactaatttgtgtatctcatataatttaagaatgaatgagcagaaaagaaagcatttctaagatatatcctctggtataattctgatcatgagatatggaatagtctttcttagaatatattatattttctgttttaactcttatcagagctaagaaaacttatatacaaaactaaaataggtatggcaactactttacaacttaggtgataatgctaattaccttggtagtggctacacaatgtaataatatgtaagaaagattccaagatgatgtggtgtgatatattaggaaagtctaccatgagtgaaggacagtgagttgcatgcagcatgtgtgccacgtacttgcaacccttccctaaatattttgggtgagaacagtgagaacaatggaaatagaatagtattggtgatgacctagataaaagaactgattgtagaaaaaatgggaataataacaggttatgctaaaatatcaacaatggggcaactttgcagctgcagcagtgaatagaaccataggcatgtcattggtatatggcgactgcattggtcctttctccctttactcaggacatgaatatgaaacaatattcataaaagaaaatatttactctcaaatttaagccgttcatttttatttaaaatatctaatttgattactgtggtaagattattgtagtaaaaattgcacagtagaattccagttatgattgaggagtcacataaacaacaattgatgaaaaatagaaggtttgtatttttgtgtaaacattattcttaactaaggagaaatcaagagtcgaaaacacccactattaacattaactcatctgatcttgagtttagcaagtgtgtaagaaaattaaaacaagtgttagttccattttagatatgtgggaaaccaaagcacagagactgctttgtttgtcatctggtggaagtaggctctagaatccaaatttcctaatatctaaaacattctatgactaaattatcctcaattgagataatgatttgcaaactatagaacagtagaatagcagtagtagtagtattaggagtaggagtaacaaaaacagtgtttattgaggacttatttattactatgtgataggcactgggctagatattttaaattctatcttgttaatctttaaagttttattggtatagtcctggtgtctaatgcagtgtctggtatataataggagtttgtaagcatttgttagtgaatgaatgaatccttaaagaagcaaaatgtataaagcaggtttttaactctgttatgttcattgataaaactgtgatggtttaaggcagtatgaaaaataaataaatttggagaaaggatgagaggaaataaaaaatagacttcattaaatggacaactactgaaatgttataggttacattgatagctggctgcaaggaatttctagatatacagttaaggataaatgaaaagaaaacactgaatactttgaacaaagatccaaatcggataactatcaggtacagaaattacatatgttttaaataattttaagaggttttatttaattaaaataaataataataaatgttttgccatgtggttttatttacagatttccaatggaaggaagaattaaaacaagagaaatgaaagtaaattggtaaagatgattcatacttatgaaagttttctttttttggttttaaaacatttttaatttgtttttcttaatacagaaaagattacataaaaatgagtcagaatgtggatgtgaaattaatttcttacaactctcagactttaaaattgatgatttgtgaatgctttttcttagcaaacatttgttcagagtgtattctgttgaggcaaggtggacggttgaatgaagacatgcttcttatgcttctcattgtcaggagctttcaagttagcttgagtgagagtagtacatttaaaaataatggacagtatgaaaacctgtgtaataaatgtctactgaatggtagtggcattctgggagagacaaagagtaaaagcaaaatcatgagtaaaggcgtgtatatgtgacagtggatgactgttctgccaaaaatggggagtttgtacagagactagtaattgaaagagtaaattaaggttacactgtaacttgtgacttttagcagtttgcagtcacaaatgcaatgatactgttttctgctatactgagtgcttggctttctgagtatgtaggtcttagtgttatgtaatttaaggtgaaatgatctttttcaatgtggctcaataaaaccaattagccaaagaatttctttttcctccatagctagaggaggccattctttctttgggattcttcctgacatctcattaaattttatcttccaaatacctttacgtctataagacagtcttctcattgttgtttacaactcatcaggcagatttgtagcttgtaccacagaagttaatgtttattttcttagctgtacttctatattcaaatatttatttctataaattcatatatccttagagatcatagtaaacttaagagatcatatagcccaatcctctcattttacaaacgatgtaagtgatgcccagataagttatgacttcgccaaggttatgttgctatctagaactcttgattttctcattttttcccccagtatactgtgttgcataaattattgagtcaaattaaatcaagtatttttccacattcattttcttgggaacactttatttgcactttcagtgcttccattaactttgccttaaattgggtagtatattcttttgattgaagctgtcaaattttaaagttaattattatactttataattgtttttatacatatcataatttagattcccattatcatttcccgcctttgtgcatcttatttaagcataaccaagaagagagaatgtgtgtacgtgtgggatggaggggtcttaatccaaaatttatagtcttttggtaggtgatgatggctaatagttacctttttcatggctttgtcatatccctgttactttgctgaacttcaaatctgttcttctccaagtagatgttaatcctcttagttttaggattttatccttcaagtttctggtttcttccctttttattatttttatttatttatttatttattttgagacagagtgtcacactgtggcccaggctcaagtgcaagggcatgatctccgctcactgcaacctctgcctcccgggctcaagcgattctcctgcctcagcctctggagtagctgtgattacaggagcacactatcacacctggctaatttttgtatttttagtagagatggggtttcaccatgttggccagtcttgtcccaaactcctgacctcaaaggtgatccacctgcctcggcctcccaaagtgctgggattacaggcgtgagccagcgtgcctggctctgcccttttaatttaaggctatttttaaattcttcctagctttaattcctaggtcttccctcttcagcactagctctgttttctttaactggtatttttcagtgaactgacagggtatgatgtggagccaccatacgaagccctggacttcccaactctggattccccttttacacacaagaataaactgtttgtgtgtaaactgatatggtctggtcatgaacgtaattctaaccgaatcaatactttatctcatttaattcttttactaaccctgggttagtcataactaccatgtaactctgcccctgttagttgaggtggtagagctgccacctcacctgaggctgtggcacttctgtttttactgaggacaagctcaggggtaagatcataggacatcactgcttgccttatctggtgcagagaaacagagagccctgccatggttctgtacctactagcttaaatccctgtccttcctcctatccctgttttattactgcttcttgaaataagatttctgacagggaagtatgatgttgaaaagtgtcctatttattattagaagtattgctttttaatataaataaatattacttcaaaagtcttatttttactccagcaatttcttactccacatttgtgcatctctaggtagcttaacaaggagttttatttacccagcatttaaaagcaccccatttacatttttccatcagttccttctttgatagtatactgtgtatctttgtaactatttcttaatagatgatataaaataattttcagaagcatataccatagccaaaaaaagtgaatagtttaaatttcagctgtatacatccattccaggaagtgagttgattacttctttcaattttcatgtatcttgtgctaaacgaaatcatgaaatataactattctgccgtttttctttgtatagctgactgtttcggtcttattgagagacctccttctactgaggagtttaggaagaaatttgttttttaaaagagatccccttaagagagtaataataagtacagtaattttagttagaaccatcagtgatttgcatatcaatgcctgattaggtaagtttatgggcaaaacaggtagcaaagaacccgggatatactaggcacataggcactagtgtcttttttccccttgaacaactaacacctcaaatttagtagcccagcagctgctggttttgaataaccagctaatatgctactgaccttcatacactgaatagaattatcagcacctaatactatgcctggcacttaataagcatttaataaaaatgtgttgattaaacaaattgtattatttttctctaattctttgaaaagaaatagtagagccaaaagatagatctgtattggaggagaatatgaaaataatttgagatagttgaggttaaagtaacagtctaagtgaaagtctcctgtaatttgtatcaatctagagattataatgaaagtctgagaagaaatgagatcttttagagagagattgagtgaataaagaagagcaataaataaataaataaataaagacaactttgaggatttggggaaaaaggaatgaacttttattattgacctgcaataataattatgcaagataatcatgtagtattgcagaaattaaggcagagaaaagttttaagaaggaatacttcagtgagtgatatcaaatactgggagatagataacccttaaaagggagtaacaattttttttctttcccccagtcttattcaggctcaactaggatgcattcccatacaagattttgctttgacacaagataccgcaaagattttcagacatggctcccgaattacaagatgtatgttacaggattagtggattttaaatattttttccaataaactggtatattagatttaatactggaaactttttttttagggttgtcagattttgtagctgctcaagaaaagaagtttgctgtactattgaatagtttgattttagctaaatgttttaggtgtaaactttgggaaaactctctgcatgtatccaaacaactggaaaaaattggtaggtactgaatacaggcaggcagtttggccatgtctgcaatttattttgtattcactgttagtaaaattattctgtgatgattacagaccttcaaggaaggtatgtgtttgtaggcttaaataagtgctgtactttcgaaaatctgattttcctttgctcctgcttaaaggattccatttgaaatcaactgaatgatacatgagtacatgagaaacctaataaaaattaatgctgtcatttgaaaattttttctcataccaagagggaaatttggttacagtaattaggcaactatgtgatgccctctcttccacttttttgatgaatattttgttttgatctcaattacaaggtggagttagcagtcccagccattcctaattcattacagaaaattatgtcacctctttatgtcttaattttttttttgttttcaataacagtagggtattaatactgattttcatagagattctgtagacaaaagattgtgcctgattattttgtctatagggaccttgtgtagtgtgtgctatgagactgtagggagtaccatttacaaaggattttcctgtttggtacctgtgaccttgtgaccctattctttcttagatagctagaattctaaaaagagagttactatctcatcactgacagccttgttaattttacaattttgtatgcatcttgggggtatcaacaaattaaataatggatttttagggatgttttgttatttatttgaacaaagattaccaactgtttatgaagaagacctaccttttgtatctggaaatttgaaatcagtggggtggcagagggctgactaggaagtcatgggagctggggtgaagtggggattggctggtgaaagtaaggggagagattcctgatggaaaggctcaccttcttacagaagtcctggcaaccaaataccacatccatcccacaaaggcaagagttctcaattggaaaggtggttccatacaacatttagaaaattttgaaattcggctaagtgattactagtaaatttcattatacttgaaaaagccaatctttctggctttctagagtattgtcaatatgggcatccattgcattctgtcccttccagattgttgaaactaacctgttttcacacacactcattacagctgaacagaaaaaagcaaatattgcccagaaaaaaaaaatcatataaaagtgagagaatctaaacaaaaagtcaaatccaagttgttattgggcatcttgaaaaaaataatgcatacaaattaattttaatgttggctataaatgaaaaagttaaaagtcaataaacattttgaggggaaatggaaatgaacattaaggaattatgaatactagaagctgagtcttaagaagaactaagagaaattcccaagaacaagtaaatatatgagtaaggaaatagggtcataccttcaccagtaatacatgtaatatatgtgccttagacaaagtagtaatattttggaattttatactgttccgtgtcttctatttggggatttggataaattcattcataagcatataagaattgtaaattctgccttctgaaagtataaggaaataggaaagatccaaagaagaaaatgaacttgattttttttgttgtttgtttgtttgtttttgagatggagttttgctttgttgcccaggctagagtacaatggcacgatcttggctcaccgcaacctccgcctctcgggttcaagcgattctcctgcctcagcctcctgagtagctgggattacaggcatgtgccaccatgcccggctaattttgtatttttagtagagacggggtttctccatgttggtcaggttggtctcgaactcccgacctcaggtgatccgcccgccttggcctcctaaagtgctgggattacaggtgtgagccactgggcccaaccgaatttgatgtatttaaggaatagaatgaaagcaagtgtgactggagagtagtcagcaagaggagagttagaggaaattagatttgagacaaaggctgtagtcagattatataggtaaggaaatttggctccagtaaggaaattgccacttcattctaaatacaatggaaaagcattggaagttttaggcagtagattaaaatagtctggtttagttacagaaacatagaactgtatttctaagacagaaatggtcagagagccatagcttcataaagcagtattccctcgcttcattcaagcatgatccttgaatcatgttgcctttctttcaagcatgagtacaaaaatacatatctcttggtgattggactatggatgacgtatagtagaactaaacatccatcatgtggaccagagtttctctttcttttataaagcaaatgcatattttatttgtctgaataaatatgaataattgaataatgtcacaaacccaataatccaactgaaaactttttacaaaaactttaagttagttatttgactggatcttaaaattttttttttttactaatttagttgttaaatatttaaatatatgttttatttaaagtgcattatttttaagttgttgtttgattaattttccacaggtataacattgtcaaatgcaatcgtaaatgctggtttgacttcctttaaaaaaatagaagagacagatgcaagggaacttgaattggtagttatattcacttattcctaattccatctaaattctgaggcctacctttatttctattaaaagttattttccttctcatagttataagtatttcaacttacttttgggtgataagcattattaaagctatttattctaaaaaatattttactaaaagaatttcaagtgttgtggtaagaatataatgatgtaaatatttttagattttaaacagacatcccccctttggaacccagataaaagaaactgtgatgtatctaccaaaatatgaacttaaagtggaacaggtaaatattttctgtttcttagatattttattgtcttttcagaaataaagctacctataaataggcttcagctgagtatgagaagtaaggttatttttaacactttttatacttgtccttttttaaagattacaagatatagtgatacgacggcagaaatattagtgactgttatattaagaaattttgaacagctacaaactaaaagaacagcatcggattctcactatgttaccttaatcataggtgacgcagataatcaagtagtttatctgcacaagattacgtaagtgtgaaatttctgatgtttgatcttatttctaagcatatactgtaaaagaaaaattctactgaaaaaaaaataacaagatcattgtgggatcaactaaattacattttcctgacacaataatgggatggtttctctatttttctattaaagaagatattaacattgggtctgttgttttaaattgttatatttagtactcagatgaacaaagtataaaatctatcaccatgatctgaaacaagtgagtagattacctctaggaggtctttcttatttcactgcttttctccagtcatccatgaccctactactgtttggatgcagtctttctcctactgacctcaaaatataccttctacttccaaattaaaatctaacaaattactatagctccattgtaggatccaagcaaacaaagcaaatgtatagaggaggtaccctcccttatatctagttctgtagcatgccattctataatttttacttcagcatttttccaggtactattattttctcccaggatgtcataagcaatctctaaggatatcagttgcagctataactaatattatttagcacttagtaggttccaaatattgaattatttaatatttgtatgagacaggtgctgtccgtattctgtagaggaggaaattgagacaaaaagagtttaatgagtttgatttatgattaaccaaaccttaatcatggtcatatagctagttaatagcaaagtctagatttgaacccaatccagagcctagactcccaaccatattactgtacttgtaagttcaggaatggcagtgattctgaaatgggaatctcctaattgtgccagtatactggaagataccttcccaaaaagtcgcatgcaaggtttctgaagggactgcagtgaccaggatatccctttcactggtaactgctctcctgcagctaaccatgacccacttatagagaatatgctgttgtacaaatctttgttctctgtgactaataagtctatgactacatgagactaaaataagtttagtcataaaaatggttgctggcttgtgatgttattagatacaaaccattttatataaatttaaaaatactattgaagttgttctcataacgtatagccagtttaaaatggtagtgatttaggggcaagctcatgtgttattgatacaaagtatatattcttattgggactaaaatggtaaatgcaacttggaaacagctgtaattaaaaaaattagggattggatggagtggctcacacctgtaatctcagcactttgagaggctgaggcaggaggatcacttaaagcccagagtttcagaccagcctgggcaacaaagtgagaccctatttctacaaaaataaataaataaataatctgagcatagtgccaatgtgcctgtggtcccagctactcgggagaccgaggcaggaagactgcctgagcctaggagtttgtggctgcagtgaggtatgattgtaccactgcactccagcccaggcaacagagtaagattctgtctcaaagaaaattaattaattttttaaaaatcatggtcaagagagttccattgatactttattctccctccttaaaagttggggaaagcagttttcagtaattgatttcagtttactactagagagtatctttcttaagaacaatcagcccttcaagattaatatgtatttcattcagtgtttggatcactatttaaactatactatttttcagggattctgttttgctaaaagctggaagttgggctaaaaagattgctgtgaaaagagctcttaaatctgaagatcttagcataaatctaataagttctgaatttggtaagttaattgaagtaatgaagacatgaatataaataatataattgcatttaaaaattacatcctttatgctggtacagaaaaacagtataaatggtattatgcaaaaataatatatttagataatatgaataaacttcaaaggaagtttcatgtatttagatatgtaaaacataacatggaccagatgacataattaaaagtttatcttttcatttatagatattttattttcctagatagttaagttgcagttattgttggaagatttttatttttataatgataaatatataattttttagttgtcatattttttaacctttcaacatattttaactttctggacttcttagctctagaagttataaaaatgtaagagagataaaaagaaataagtgttctcatatgtggatttatatgacaaataaacatttgtgtacttttttttcattttccagttgggcttgatattcagcagaaacttacagtcttttacttagaacccaagaggtttggaaatcaaatcactatgcaaagaaaatctgaaacacagatttcccattctaaacattcagacatatctacaatagcaggacctaataaaggtaaatagctgtattaattcctattttatattaaagcaaagatatggctaggaaggagtatcagtgttatagtactgcaacactcagattgaggatactctggaataagatatttaagcttcatagtaatttcattaatagtatatagtagagattcttcaagttagtatttgtcaaattggggtaatggttgggggacaaatttttttattcatcttttggtatatgtattagtccattttcatgctgctgataaagacatacctgagactgggaagaaaaagaggtttaattggacttacagttgcacatggctggggaggcctcagaatcatggcaggaggtgaagggcacatcttgcatggtggtggcgagagaaaaatgaggaagaagcaaaagcagaaaccccgataagcccatcagatctcatgagacttactcactatcacaagaacagcgcaaaaaagaccagcccccatgatttggttacctccccctgggtccctcccacaacacatgggaattctgggagatacaattcaagttgggattttggtggggacacagccaaaccatatcattccacccctagcccctccaaatctcatgtcctcacatttcaaaaccaatcacaccttcccaacagtcccccaaagccttaactcatttcagcattaacccaaaagtccacagttcaaagtctcatctgagacaaggcaagtcccttctgcctatgagcctgtaaaatcaaaagcaagctagttacttcctagatataatgggggtacagatattgggtaaatacagtcattccaaatgggagaaattggccaaaacaaagggcttacaggccccatgcatgtctgaaatccagtggagcagtcaaactttaaagctccaaaatgatctcctttgactccaggtctcacatctaggtcacatggatgcaagaggtgagttcccatggtcttgggaagatccacccctgtggctttgcagggcacagcctccctactggctgctttcatgggttggtgttgagtgtctgcagcttttccaagtgcacagttcaagctgtcggtggatctaccattcgggggtctggaggatggtggccctcttctcacagctccactaggcagcaccccactagagactctgtgtgggggctctgaccccacatttctcttctacattgccttaccagaggttctccatgagggctttgctcctgcagcaaacttttgcctgggcatccaggcatttccatacatcttctgaaatccaggtggaggttcccaaacctcgattcttgacttctgtgtacccacaggctcaataccatgtggaagctgccaaggcttggggcttccacaagccttgaagccacagctggagctgtatgttgacccctttcagccatggctggagcagctgggacataggacaccaaatccctaggctgcacacagcacagggacctgggcccagcccatgaaagcactttttcctcctgggcctccaggcctgtgatagaaggggctgccgtaaacatctgtgacatggcctggagacattttccccatggtcttgaggtttaacattaggcttcttgctacttatgcaaatttctgcagccagcatgaatttctccccagcaaatgggtttttcttttctattgcatagtcaggctgcaaattttctgaacttttttttttttttgagatggagtctcactctgtcacccaggctggagtgcagtggcacgatctcggcttgctgcaacctctgcctcctgggttcaagcaattctcctgtctctgcctcctgagtagctgggactacaggcacccaccagcatgcccggctaatttttgtatttttagtagagacagggtttcaccatattggtcaggctggtctcaaactcctggtctcaggtgatccacctgcctcggcctcccgaagtgctgggataaattttctgaacttttatgccctgttccccttttacaactgaatgcctttaagagtaccatatcacctcttgaatgctttgctgcttagaaattttttccaccagatgccctaaatcatctctctcaagttaaaagttccacaaatctcttgggcaggggcaaaatgccaccagtctctttgctaaaacgtaacaagagtcacctttgctccagttcccaacaagttcctcatcttcatctgagaccacctcaacctggaccttattgtccatattgctatcagcattttgggcaaagccattccacaattctctaggaagttccaaactttcctacattttcctgtcttcctctgagctctccaaactgttccaacctttgcctgttacccagtttcaaagtcgcttccacatatttgggtatcttttcagcaatgtccccactctactggtaccaatttactatattaatctgttttcacactgctgataaagacatagctgatactgggaaggaaaagaggtttaattgtacttaacagtttcacatggctggggaggcctcagaatcacatggtgggagttaaaaggcacttcttacatggcggcggcaagagaaaaatgaggaagaagcaaaagcagaaacccttgataaacccatcagatctcttgagacttattcactatcaggagaatagcaagggaaagaccagcctccatgattcaattacctccccctcagtcccttccacaacacgtgggaattctgggagatacaattcaagttgagattttggtggggacacagccaaaccatgtcagtatacgtttttccttttccatacttatgccattgttatagccattgtcaggggagatcaagtgatgtacaagaatcaacagatttgttaaggcaaatcagagtgaaaatgaattattattttttattatgggaatttttcaaacatatacaaaagtagatagaagtgtaagatgaattttcatttactcattatccactttaaacagtgatcaattcatggctgctactgtttcatctatacctctctagtttttttttccatccatattttgaagaaaattttagatatcgtattatttcctctgtaaatgtttcaatatatctctatctaaatggtaaagatttttttaaactacattacttttacacataaaaactaatattatccaatattaagtcagggttcaaattgtctcataaatattgtagatgtattatcatcttcataccatctagatataccagattaactcctgagtccttttgagtatttctagtagatttgacagcttctttgctatgcagagtaatatgctgttctaggcttatctcgtatatctccagcttcagtcccaaacataataaaccctttgtccaagaagcctttttttttaaatgatagtagttttcagagatcacaatctgtgtcctagaggagctcgttgccattgagtgattatggtctcttagatttttttcatgcatggaggtaagtattatgtgattattttttgtcttaaaagacatcatgaattcatacttatcaaattcagagatgcagaatttatccttaaactcaattatctatatatgccttctatcatgctgagaaacttggttctcaatggctcaaaaataatagagtatcactaattttctatcctttatatacattacacacacaataaacagtctgagaatagcagcatcagactatcactcttaatatgatcataaaatttgagaattattttgcagatatttttgttcttaggctgtatcttactatcttagactgtatctcaatagtaaaattaatgtgtttaaaaatcacttggaatagatcctctgtatgtggccatgccactctggatacatatactttcatttgtttcattttattttatatttttaggactagctttcaaaaattaattttgttttataataatgtaaaacatttacatggctctgtaactaaatctacaaaacaagcactaaatatataaacacttgcagcataggcagtctaccttacagctctttcttattcagttggtcctgttttcacccttttgaccccataaggggagcagttaacagacactggggaatttgagagcagcagcatgattagacatgctctctgaatagtattggcaattatgataaatagtaactgcagtgagtagtgacaggaagaacgcatttagaactattctgtgagctcatgagccttcatcttcttccttttgaagaacacaaaagagcttccatttctgggtaggatatagttttgtggtaggccagtgcttccacagctacaactatgaaaaccttcataccttataaaattataatttttagggcatcagagatttgtggaagcactaaggactaaaggaactaaattcttaataaaaaggctaggtagaccatgccctgtaaaggggtttacatgatcagccactcaccatgtttgcctgacagagggaaagggaaacttcttctggtgaaatgtaatctggaaaccacagacacagtgtctgtcatatgataaaaaaattgtgaggcccacaaagagataagaccatatgactgataatcaactgtgtcaagaaacaagccagacatggtgacacacactggtagtcctagatattcaggaggctaaggcaggaggatttcttgagcccaggagtttgaggctgtagtgcactatgatcatgtctgtgaatttaccactgcactccagcctggaccacatagcaagaccacatctctttaaaaaaagtataaaataattatgaatattttaaagaaaatatagaaaaaataggtaaatgcatgaaaagatggaaagttttaccagataattaaaatctataaagagatttaaatggactttctagaattaaaaatgcgatatctgaaatgaagagctagttgggtaggcttaacattagattcaatataaccaaatataggatttgtgggctttgagacatatcagtagaaaatatctaaattgaagcccagagataagagaatggaaagaacacaaaggaatataatactcaaaaaaaggtctaacatatgcataattaaagtcccagaagcagagtagagagagaatgggacaaaattaacattcaaagagacaatggcagagtccatttcaaaataataaaagacaccaaccaacagatttagaattttggtaaaccccaaacagaggcaaatacagggaaaaccacacctggacatattgtagcaaaactgctgaaaatgttaaaattagacacatcatttatgcattaccttcaaaataacaacagtgaaactgacagctaacttctcaacaataatgatggaaaacagaagacaatggaatgtcatattcaaaatgctaccaacctaggtttctgcccagtggaaaatatccttcatgatgaaagtgaaaaaagaaagaagagaaagaagagaaagaaagaggaagaaagagaaagaaaataactaaatgactttatcactactagtatatttatcagcctgaattaaaatgaatactaaggccaggcttagtggctcatgcctataatcccagcactttgggaggccaagatgggcagatcgcttgagcccaggagttcaagaccagcctaggcaatgtggtgaaaccctgtctctacaaaaagttaaaaaaaattagtgagtgtggtgatgtgcaccagtggtcccagctacttgggaggctgaggtgggaggatcatttgaccctgggaagttgaggctgcagtgagctgagatcacactactgcactccagcctgggtaacagagcgagaccctgtctcaaaataaaaaataaaataaaataaatactaaagggatttccttagaggaaaatgatcacagatgaaaacatggacatgctggggggaatgaagaagagtagaaaggataactatatgactaaatataagtagactatgtaaaacagtaattgaaatgacttacagagtttaaaatatatgtggaaataaaatgcaaagcaaaaaaatacaagcttgcatctcaagagtataccatatcaaacataataatgtaacaagagaaaaacagaaatcagcgatacataggatgtaaatatacaacagagaaaaatcaacaaagctgagatttggttcttagaaaagataaataaaattaagaaccctctatgaatgaagactgatcaagagaaagaaagaaaacacaagtaacaatatcaagaatgaagaagaggatattacattgtatatcaaaaagttactgaagatattcaaaagcacaaaaacaagacattaacaattttataatgataaatttgacatagtttgggttaaaatgagaatatttattgagaagcaaagcttaccaaaactgacagaagaaaataaaatctgagtagtctgatactagtaatgaaattgaagcaattgttagtaaaaatttttccacaaagaaaacttgaggcatggatgacttcactgttaatttttcttaattaagaagaaataatatcaaacttacctaaacttttccagagaatagaaaaaaagagaatattttctaatgttttgtttttttaatgaggccagtgtgtcaaaacctgacaaggacattaaaaagaaagggaaattatttagcaacatatctcatgaacatagatccaaaagtctttaatgaaatattcacaagctgaatttggccatattttttaaaagcacaattaagtatggtttattgcatgtatgcaggagaggcttaccattcaaaagtagatcaatataattcactatgttaacagagaaaaaggagaaaatgatttgatcctcttgataggtgtcaaaaaagtttgacaaaattcagtactcatttatgatttaaaaaaactcttagcaaactagaaatagaagggaacttcttttgttttgttttgtttttgtttttgagacagagtttcacccttgttgcccaggctagagtgcaatggtgcaatctcggctcaccataatctccacctcccaggttcaagctattctcctgtctcagcctcccgagtgctgggattacaggcatgcaccaccacgcccagctaattttgtatttttagtagagatgggatttctccgtgttggtcaggctggtcttgaactcccaacctcaggtaatctgcctgccttggcctcccaaagtgctgggattacagggtgagccaccacgcctggcctggaacttcttaaatataaagaatatctacaaaaactatagcaaatgtcatactcgatagtaaaatattaaacactttcctattgagttggagaatgttacaagaatgctctgtgttattatttctattcgacattgtgctggaagtcttagtaatataataatactttaaaaaagcaaaaagggggctgggtgcagtggctcatacctataatcccagaactttgggaggccgaggtaggaggatcacttgagtccaggagttcaagacaagcctgggcaacagtgtgaaactccatctttacaaaaatagaaaaaagtagccaggtgtggtggtgcttgcctgtagacccagctcctctggaggctgaaatgggaagatcacttgagtccaggtgttcgaagttacagtgagctatgattacaccactccactccagcctgggcaacagagtgagaccttgtctcaaaaaaaagaaaaaaaaagaaataaataaattgtcattatttctaagcaacatgattatttatagagaaaatccaaaagactctatagacatgctgttggaattaatatgtttagaaatatcactgaatgcagtcaatataaaaaacaattgtacaatagcatcaaaaagaataaaatacttaggaataaattgaacaaaaaagtgtaagaagtgaacactgaaaactacaaaacaccattgaaataaattaaagaagttctaaataaattgaaaaatattttatgttcgtggattgaaagtcaatattgttaagatggcagcacttctcatattaattcataaattcaacaaagtctgtatcaaaatcctagctgtagtttttgcagaaattcacaggctgatcctaaaattcacgtggaaatacaagggacccagaatagctaagccaaccttgaaaagaaaaagaaggaaggtagaggactcacaattcttggtttcaaaacttgttacaaagctgcagtgattaagacaaggtggtgctgtcataataatagacataaagatcaatggaatacaactgagagtgtagaaataaacctttacctctctgccagtttatttttgacaaggatgccaaaacaatttgatggtaaaagaatttgaaaataatttttcaagtaatagggctgggcaactgcatagacacatgcaaaaggatgaatttggactcctacctcataccatatacaaaaattaactcaaaatgaatcaaagacctaaaggtaaaacttaaaactataaaactcgccaggtgcagtggctaacaccagtaatcccagcactttgggaggctgaggtgggtggatcacctgaggtcaagagttcaagaccagcttggccaacatagtgaaactctgtctctactaaaaatacaaaaaaaaaaaaaaaaattagccggctgtggtgatgggcccctgtaatcccagctactcaggagggtgaggcaagagaatcgcttgaacccaggaggcggaggttgcagtgagccaagatcgctccattgcactccagcctgggcaacaagagcgaaactctgtctcaaaaacaaacaaacaaacaaaaacctataaaactcttaaaagaaaacataggtgtatatcttcattcattaccttgtacaaggcaacagtttcttaggtatgacatataaagctcaagtaaccaaagaaaaaatagatgaattggacttaagatgaaaacttttgtgcttcagaggacactattcagaaagtgaaaagacaacccacggaatgggagaaaatacttgcaaatcatatatatctgataactaacttgtattgagtatatataaagaaatcttacacttcaacagtaaaaagacaaatagcccaattaaaactagtcaaggggccgggcacagtggctcacatctgtaatcccaacactttgggaggccgaggcgggtagatcacttgaggtcaggagttcaagaccaccctggccaatatggtgaaaccccatctctactaaaaatacaaaaattagccaggcgtgttggtgcacgcctgtaatcccacctactcaggattgagtggaaggtgaggtggaagaattgcttgaactcaggaggtagaggttgcagtgagccaagatcatgccactgcactccaacctgggtgacagagtgagactttgtctcaaaaataaaataaaaataaaactagtcaagggatctgcatagacattttccaaagaagtgatacaaatggtcaacacacatatgaaaagatgctctacattgttagtcaatgcagaaatgcaaaccaaaaccacagtaagataccacttcccactcagtagggtggctttagtcaaaatgatggacaataacatgtgttgataaggatatggagaaactggaaccctcatacactgctagtgggaatgtaaaattgtgcactgctttgaaaaacagttggtatttcctcaagaaatttaacatagaattaacatatgatacagcaattgtactcctaggtgtatatccaaaagaattgaaaacatattcatacaaaaacttagacatgaatgtatatagctgcattatttataatagcccaaactggaaacaacccaaatatctatcaactgatgaatagataagcaaaatgtggtatatccatacaatggaatattattcagccaaaaagaaaaactactgatgcatgctacagcacggatgagccttgaaaacatgctagatagaagctagtcacagaagaccagatattgtatggttcaatttatatgaagtgtctagaacaggtaaatctatagagacataaagtagattagtggttgtcaggggttgagggcaggaataaatgaggaatgactaataatagttatatggtgggttttttgtatgtatggtgatgacagtgttctggaattatatgatgactgttgcacaaccttgggaatatactaaaaacccactgaattgtacagtttaaaaatgtgaatggtatggtatgaattataatttaattaagaaatttaaaagtccattgtattcctgtataccagcaaaaaggataaattataattttattttattttattttaattttaaattatacttttagggtacatgtgcacaacgtgcgggtttgttacatatgtatacatgtgccatgttggtgtgctgcacccattaactcatcatttaacattaggtatatctcctaatgctatcccttccccctcccccccaccccacaacaggccccagagtgtgatgttccacttcctgtgtctatgtgttctcattgttcaattccacctatgagtaagaacatgcagtgtttggttttttgtccttgcgatagtttgctgagaatgatggtttccagcgtcatccatgtccctacaaaggacatgaactcatcattttttatagctgcatagtattccctggtgtatatgtgccacattgtcttaatccagtctatcattgttggacatttgggttggttccaagtctttgctattgtgaatagggccacaataaacatacgtgtgcatgtgtctttatagcagcatgttttataatcctttggatatatacccaataatgggattgttgggtcaaatggtatttctagttctagatccctgaggaatcgccacactgacttccacaatggttgaactagtttacagtcccaccaacagcgtaaaagtgttcctatttctccacatcctctccagcacctgttgtttcctgactttttaatgatcaccattctaactggtgtgagatggtatctcattgtggttttgatttgcatttctctgatggccaatcatgatgagcattttctcatgtgtcttttggctgcataaatgtcttcttttgagaagtgtctgttcatatccttcacgaaccactttttgatggggttgtttgatattttcttgtaaatttgtttgagttcattgtagattctggatattagccctttgtcagatgagtagattgcaaaaattttctcccattctgtaggctgcctattcactctgatggtagtttcttttgctgtacagaagctctttaattagatcccatttgtcaagtttggcttttgttgccattgcttttaatgttttagacatgaagtccttgcccatgcctatgtcctgaatggtattgcctaggttttcttctagggtttttatggttttaggtctaacatttaagtctttaatgcatcttgaattaatttttgtataaggtgtaaggaagggatccagtttcagctttctatatatggctagccagttttcccagcaccatttattaaatagggaatcctttccccatttcttgtttttctcaggtttgtcaaagatcagatggttgtagatatgtggcattatttctgagggctctgttctgttccattggtctatatctctgttttggtaccagtatcatgctgttttggttactgtagccttgtagtatagtttgaagtcaggtagtgtgatgcctccagctttgttcttttggcatagaattgacttggcaatgcgggctctttttcggttccatgtgaactttaaagtagttttttccaattctgtgaagaaagtcatttgtagcttgatggggatggcattgtatctataaattaccttgggcagtatggccattttcatgatattgattcttcctacccatgagcatggaatgttcttccatttgtttgtatcttcttttatttcattgagcagtggtttgtagttctccttgaagaggtccttcacatcccttgtaagttggattcctaggtattttattctctttgaagcaattgtgaatgggagttcactcatgatttggctctgtttgtctgttattggtgtataagaatgcttgtgatttttgcacattgattttgtatcctgagactttgctgaggttgcctatcagcttaaagagattttgggctgagatgatggggttttctagatatacaatcatgtcatctgcaaacagggacaatttgacttcctcttttcctaatcgaatactctttatttccttctcctgcctgattgccctggccagaacttccaacactgtgttgaataggagtggtgagagagggcatccttgtcttgtgccagttttcaaagggaatgcttccagtttttgtccattcagtatgatattggctgtgggtttgtcatagatagctcttattactttgagatacgtcccatcaataactaatttattgagagtttttagcatgaagggttgttgaattttgtcaaaggccttttctgcatctattgagataatcgtgtggtttttgttgttgattctgtttatatgctggattaagtttattgatttgcatatgttgaactagccttgcatcccagggatgaagcccacttgatcatggtggataagctttttgatgtgctgctagatttagtttgccaatattttattgaggatttttgcattggtgttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctgctagaattcagttgtgaatccatctggtcctggactttttttggttggtaagctattaattattgcctcaatttctgagcctgttattggtctattcagagattcagcttcttcctggtttagtcttgggagggtgtatgtgtccagaaatttatccatttcttctagattttctagtttatttgcatagaggtgtttatagtattctctgatggtagtttgtatttctgtgggatcggtggtgatatcccctttatcattttttattgtgtctatttgattcttctctcttttcttctttattagtcttgctagcggtctatcaattttgttatctttcaaaaaaccagctcctggattcattgatttttttgaagggttttttgtgtctctatttccttcagttctgctctgatcttagttatttcttgacttctgctagcttttgaatgtgtttgctcttacttctctagttcttttaattctgatgttagggtgtcaattttagatctttcctgctttttcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggatgttcagtttccatgtagttgagcggttttgagtgaatttcttaatcctgagttctagtttgattgcactgtggtctgagagacagtttgttataatttctgttcttttacatttgctgaggagagctttacttccaactatgtggtcaattttggaataggtgtggtgtggtgctgacaagaatgtatattctgttgatttggggtggagagttctgtagatgtctattaggtccggttggtgcagagctgagttcagttcctggatatcctttttaacgttctgtcttgttgatctgtctaatgttgacagtggggtgtgaaagtctcccattattattgtgtgggagtctaagtctctttgtaggtctctaaggacttgctttatgaatctgggtgctcctgtattgggtgcatatatatttaggatagttagctcttcttgttgaattgatccctttaccattataatggcctttgtgtcttttgatctttgttggtttaaagtctgttttatcagagactaggattgcaacccctgcctttttttgttttccatttgcttggtagatcttcctccatccctttattttgagcctatatgtgtctctgcacgtgagatgggtttcctgaatacagcacactgatgggtcttaactctttctccagtttgccagtctgtgtcttttaattggagcatttagcccatttacagttaaggttaatattgttatgtgtgaatttgatcctgtcattatgatgttagctggttattttgctcattagtggatgcagtttcttcctagcctcgatggtctttacaatttggcatgtttttgcagtggctggtaccagttgttcctttccatgtttattgcttccttcaggagctcttttagggcaggcctggtggtgacaaaaatctctcagcatttgcttgtctgtaaaggattttacttctccttcacttatgaagcttagtttggctggatatgaaattctgggttgaaaattcttttctttaagaatgttgaatatttgcccccactctcttctggtttgtagagtttctgccaagagatcagctgttagtctgatggatttccctttgtgggtaacccaacctttctctctggctgctcttaacattttttccttcatttcaactttggtgaatttgacaactttgtgtcttggagttgctcttcttgaggagtatctttgtggcattctttgtatttcctgaatttgaatgtggcctgccttgctagattggggaagttctcctggataatatcctgcagagcgttttccaacttggttccattctccctgtgactttcaggtacaccaatcagatgtagacttggtcttttcacatagtcccatatttcttggaggctttgtttgtttctttttattcttttttctctaaacttctcttctcgcttcatttcatgaatttgatcttccatccctgataccctttcttccagttcatcggatcagctactgaggcttgtgcattcgtcaggtacttcttgtgctgtggttttcagctccatcaggtcctttaaggacttctctgcattggttattctagttagctgttcatctaattttttttcaaggtttttaacttctttgccatgggttcaaacttcctcctttagcttggagtagttggatcatctgaagccttctctcaactcatcaaagtcattctccgtccagctttgttccgttgctggtgaggagctgcgttcctttggaggaggagaggcgctctgaattttagagtttccagtttttctgctctgttttttccccatctttgtggtcttatctacctttggtctttgatgatggtgacgaacagatggggttttggtgtggatgtcctttctgtttgttagttttccttctaacagtcaggaccctcagctgcaggtctgttggagtttgctggaggtccactccagaccctgttttcctgggtatcagcagcggaggctgcagaacagcagatattggtgaacagcaaatgttgctgcctgatcgttcctctggaagttttgtctcagaggggtacccggctgtgtgagttgtcagtctgcccctactgggggacgcctcccagttagcctacttgggggtaagggacccacttgaggaggcagtctgcctgttctcagatctccagctgcatgctgggagaaccactactctcttcaaagctgtcagacagggacatttaagtctgcagatgtttctgctgccttttgtttggctatgccctgcccgtagaggtggagtctgcagaggcaggcaggcctccttgagctgtggtgggctccacccagttcaagcttcccggctgctttgtttacctactcaagcgtcggcaatggcgggtgcccctcccccggactcgctgccaccttgcagtttgatctcagactgctgtgctagcaatgagcgaggctctgtggctgtaggaccctccgagccaggcgcgtgatataatctcctggtgtgccgtttgctaagaccattagaaaagtgcagtattagggtgggagtgacccgattttccaggtgccgtctgtcacccctttctttgactaggaaagggaattccctgaccccttgtgcttcccgggtgaggcgatgcctcgccctgctttggctcacacttggtgcactgcacccactgtcctgcacccactgtctgacattccccagtgagatgaacccggtacctcagttagaaatgcagaaatcacctgtcttctgcatcgctcacgctgggagctgtagactggggctgttcctatttggccatcttggctcctcccctcaaaattataattctaaaacagcatttacagtagtataaaatatcaaccttgtaatagaataacaaaagatgctcaagaccactacatgaaaactaaaaatcattgtttaagggaaattagggaaaacatacttaattaagataccgtttcaagaactgaaaagtttaatattataaagatgtcagttctccccaaattaatctttatattcagtgtcatcccaatttcagcagggttttgttgttgttgtcatttttttttctgaaataaccagctaattataaaattcatatgaaaattcaaaaggacagggtagtcagggcaaacttgaagaaaaacatattgggcaacctactttactagatatcaagacctgttattaaacagtagataataagaatgtgatgtaggcataaggatagacacattaaccagtggaatggactagagtccagaaatacacctacaaataatacagtcattgatttctgacaaaggtgaagtgccatgcagttggaaaacggacagtctttcaataaatgctgctagatcaactggatgtccatatggaaaaaattgtatgtcagtctgggcgcggtggctcacgcctgcaatcccagcattttgggaggccaaggtgggcggatcatgaggtcaggagattgagtccatcctggctaacatggtgaaaccccatctctactaaaaaatacaaaaaattagccgggcatggtagcaggtgcctgtagtcccagctactcgggaggtgaatggcatgaacctgggaggcagagcttgcagtgagccgagattgccactgcactccagcctgggtgacagagtgagactccgtctcaaaaaaaaagaaagaaaaaattgtatgtcaactctgacctcacactgtacacaaaacttatttgcaaatagatgactgatttaaatgtgaaagaaaaacaataaaacttttagaggagaaaaaataggtcttcgagaccttgggataggttgacttttttaaaaaaacagggcacaaaactttctaaccataaaaacataatgaatttgactatgttaaaattaagaactctgttcatcaaaaagataccattaagagtgaagggtgcaactcacagaatgtgaggaaaaaaatggaatacatatacctggctgttatgggctgaattgtgtttacccccaaataaatatgctgaattcctcagaatgcgactatatttggagatagggtctgtaaaagataattgaattaaaatagggttccttagtgtgaaccccaatccaatatgcctggtgttcttataagaagaggaaattaggatacaggcacacatggagggaagatcatgtgaagacacaatgagagagagccattcacaagccaaggagaggaacctcaggagataccaaccctaccaacaccttgatcttggacttgtagcctctagaattgtgaaacaataaatttcagttgtttaagccactcaatctgccactttgttatggcagccttaacaaattaatacactggaaagaacgattttacataatatataaagaactcctatatgtataagtaaacattttaaaaatgggtactcaattaaacagacacttcaaaatagaggatatccaaaaagtcaggaacctatgaaagagtatttaagttcattagacaaagtgagaatgaaaatctacaatgagatattgctgtatcattgtgcaaccatcaaaaggacttaagtgaaaaagaaaataccaagtattgataaggatatataacaactactactcttaatcactaatgtgattatagattgatacaactacttccgaaaactagcagtatttattaaagtttagcatatgcattctatgatagagtaattccccttgcatattatgtgatagagcaattctgcttctaggtatataccagataaaagtgtgcatatatgttcaccaaaagatgtattttggaatgttcatagcagtactatcatattagccctaaaatggaaaccagccaaaagctcatcagcagttagatggacaaataaattgtggtatattgacccaatacaattctacaggggtcagaaaactttcctaaaaggccagatagtaaatgtttttggtttgcagactatagatcttctttatatctatgcaactctgtctttgtaggtgtttgcaacccaaaagcagccatagacaatatgtaaatgaatagacatgggtgtattccaataaaactttatttacaaaaatagatggttggcccatgaactatagtttccaacccctgctatagagcaaggagattgaattacctatgactacacacaacaatatgaatgaatatcactaacataaagttaagcaaaagaagccagacacaaaaaggtaatactgtatgagtccatgtatataaattgcaaaaataagcactactaactctcatggtttgaattgtgtttcacaaaaacatacattgatggtctaatccctggtacctgtgaatgtgatcttttttttttccttctttggcattattttattttgattattttttattttatttattattattatactttaagttttagggtacatgtgcaaaatgtgcaggttagttacatatgtatacatgtgccatgctggtgcactgcacccactaactcgtcatctagcattaggtatatctcccaatgctatcccttccccctccccccaccccaccacagtccccagagtgtgatgttccccttcctgtgtccatgtgttctcattgttcatttcccacctatgagtgagaatatgcggtgtttggttttttgttcttgcgatagtttgctgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacctagtaaggggatggctgggtcaaatggtatttctagttctagatccctgaggaatcgccacactgacttccacaatggttgaactagtttacagtcccaccaacagcgtaaaagtgttcctatttctccacatcctctccagcacctgttgtttcctgactttttaatgattgccattctaactggtgtgagatggtatctcattgtggttttgatttgcatttctctgatggccagtgatggtgagccttttttcatgtgttttttggctgcataaatgtcttcttttgagaagtgtctgttcatgtcctttgcccactttttgatggggttgtttttttcttataaatttgtttgagttctttgtagattctggatattagccctttgtcagatgagtaggttgcgaaaattttctcccattctgtaggttgcctgttcactctgatggtagttttcttgctgtgcagaagctctttagtttaattagatcccatttgtcaattttggcttttgttgccattgcttttggtgttttagacatgaagcccttgcccatgcctacgtcctgaatggtaatgcctaggttttcttctagggtttttatggttttaggtctaacgttcaagtctttaatccatcttgaattaatttttgtataaggtgtaaggaagggatccagtttcagctttctacatatggctagccagttttcccagcaccatttattaaatagggaatcctttccccatttcctgtttttgtcgggtttgtcaaagatcagatagttgtagatatgtggcgttatttctgagggctctattctgttccattgatctatatctctgttttggtaccagtaccatgctgttttggttactgtagccttgtagtatagtttgaagtcaggtagtgtgatgcctccagctttcttcttttggcttaggattgacttggtgatacgagctctttttttgttccatatgaactttaaagtagttttttccatttctgtgaagaaagtcattggtagcttgatggggatggcattgaatctgtaaattaccttgggcagtatggccattttcatgatattgattcttcctacccgtgagcatggaatgttcttccatttgtttgtatgctcttttattttcttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagacgttgctgaagttgcttaacaacttaaggagattttgggctgagacaatggggttttctagatatacaatcatgtcatctgcaaacagggacaatttgacttcctcttttcctaatcgaatactctttatttccttctcctgcctaattgccctggccagaacttccaacactatgttgaataggagtggtgagagagggcatccctgtcttgtgccagttttcaaagggaatgcttccagtttttgtccattcagtatgattttggctgtgggtttgtcatagatagctgttattattttgagatacgtcccatcaatacctaatttattgagagtttttagcatgaagtgttgttgaattttgtcaaagaccttttctgcatctattgagataatcatgtggtttttgtcttggttctgtttatatgctggattacatttattgatttgcgtatattgaaccagccttgcatcccagggatgaagcccacttgatcatggtgggtaagctttttgatgtgctgctggattcggtttgccagtattttattgaggatttttgcatcaatgttcatcaaggatattggtctaaaattctcttttttggttgtgtctctgcccgtctttggtatcaggatgatgctggcctcataaaatgagttagggaggattccctctttttctattgattggaatagtttcagaaggaatggtaccagttcctacttgtacctctggtagaattcggctatgaatccatctggtcctggactctttttcgttggtaagctattgattattgccacaatttcagctcctgttattggtctattcagagattcaacttcttcctggtttagtcttgggagagtgtatgtgtcgaggaatgtatccatttcttccagattttctagtttatttgcgtagaggtgtttgtagtattatctgatggtagtttgtatttctgtgggatcggtggtgatatcccctttatcattttttattgtgtctatttgattcttctctcttttcttctttattagtcttgctagcggtctatcaattttgttgatcctttcaaaaaaccagctcctgaattcattaattttttgaagggtgttttgtgtctctatttccttcagttctgctctgattttagttatttcttgacttctgctagcttttgaatgtgtttgctcttgcttttctagttcttttaattgtgatgttagggtgtcaattttggatcttttctgctttctattgtgggcatttagtgctataaatttccctctacacactgctttgaatgtgtcccagagattctggtatgttgtgtcttcgttctcgttggtttcaaagaacatctttatttctgccttcatttcgttatgtacccagtagtcatttaggagcaggttgttcaatttccatgtagttgagcggttctgaatgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccggttggtgcagagctgagttcaattcctgggtatccttgttgactttctgtctcgttgatctgtgtaatgttgacagtggggtgttaaagtctcctattattaatgtgtgggagtctaagtctctttgtaggtcactcaggacttgctttatgaatctgggtgctcctgtgttgggtgcatatatatttaggatagttagctcttcttgttgaattggtccctttaccattgattaatggccttctttgtctcttttgatctttgttggtttaaagtctgttttatcagagactaggattgcaacccctgcctttttttgttttccatttgcttggtagatcttcctccatccttttattttaagcctatgtgtgtctctgcctgtgagatgggtttcctgaatacagcacactgatgggtcttgactctttatccaatttgccagtctgtgtcttttaattggagcatttagtccatgtacatttaaagttaatattgttgtgtttgaatttgatcctgtcattatgatgttagctggttattttgcttgttagttgatgcagttttcttcctagtctcgatggtctttacattttggcatgattttgcagcggctggtaccgattgttcctttccatgtttagcacttccttcaggagctcttttagggcaggcctggtggtgacaaaatctctcagcatttgcttgtctgtaaaggattttatttctccttcacttatgaagcttagtttggctggatatgaaattctgggctgaaaattattttctttaagaatgttgaccctctccctctccctctccctctcgtctccctctccctctttgcacggtctccctctgatgctgagctgaggctggactgtgctgccgccatctcggctcactgcaacctccctgcctgattctcctgcctcagcctgccgagtgcctgggatgcaggcgcgcgccgccacgcctgactggtttttgtattttttggtagagacggggtttcgctgtgttggccgggctggtctctagctcctgactgcgagtgttctgccagcctcagcctcccaaggtgccaggattgcagacggagtctcgctcactcagtgctcaatgttgcccaggctggagtgcagtggcgtgttcttggctcgctacaacctccacctcccagccgcctgccttggcttcccaaagtgccgagattgcagcctctgcccaggtgccactctgtctaggaagtgaggagcatctctgcctggccgcccatcgtctgggatgtgaggagcccttctgcccggccgcccagtctgggaagtgaggagcgtctcttcctggccgtcatcccgtctaggaagtgaggagcatctctgcccggccgcccatcgtctgggatgtggggagcgcctctgccccgccgccccgtctgagatgtgaagagcgcctctgtccggccgcgaccccgtcttggaactgaggagtgtctctgccccgccaccaccccgtctgggaggtgaggagcgtctctgactggctgccccatctgagaaatgaggagcccctccgcctggcagccgccccatctgggaagtgaggagtgtctccgcccggcagccgccccatccgggaggtggggggcagcccccgcccggccagctgccccatccgggaggtggggggtagcccccacctgaccagccgccccgtccgggaggtggggggcgcctctgcccggccggcccgtctgggaagtgaggagcccctctgcccggccgccaccccgtctgggaggtgtacccaacagctcattgagaaagggccatgatgacgatggcggttttgttgaatagaaaagggggaaatgtggggaaaagaaagagagatcagattgttactgtgtctgtgtagaaagaagtagacataggagactccattttattctgtactaagaaaaattcatctgccttgggatgctgttaatctataaccttacccccaaccctgtgctctcaaacgtgtgctgtgtccactgagggttaaatggattaagggcggtgcaagatgtgctttgttaaacagatgcttgaaggcagcatactccttaagagtcatcaccactccctaatctcaagtacccagggacacaaacactagggaaggcagcagggccctctgcctaggaaaaccagagacctttgttcacatgtttatctgctgaccttccctccactattgtcctatgaccctgccaaatccccctccccgagaaacacccaagaatgatcaataaatactaaaaaaaaaaaaaaaaaaaaaaaaagaatgttgaatattggcccccactctcttctggcttgtagagtttctgccgggagatctgctgttagtctgatgggcttccctttgagggtaacccgacctttctctctggctgcccttaacattttttccttcatttcaactttggtgaatctgacaattatgtgtcttggtgttgctcttcttgaggagtatctctgtggcgttctctgtatttcctgaatctgaatgttggcctgccttgctagattggggaacttctcctggataatatcctgcagagtgttttccaacttggttccattctccccgtcactttaaggtacaccaatcagacgtagatttggtcttttcacatagtcccatatttcttggaggctttgctcgtttctttttattcttttttctctaaacttcccttctcgcttcatttcattcatttcatcttccatcgctgataccctttcttccaattcatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcggagtaatttgatcgtctgaagacttcttctctcagctcgtcaaagtcattctccgtccagctttgttctgttgctggtgaggaactgcgttcctttagaggaggagaggtgctctgctttttagtttccagtttttctgctctgttttttccctatctttgtggttttatctacttttggtctttgctgatggtgatgtacagatgggtttttggtgtggatgtcctttctgtttgttagttagttttccttctaacagacaggaccctcagctgcaggtctgttggagtacccggacgtgtgaggtgtcagtctgcccctgctagggggtgcctcccagttaggctgcttgggggtcaggggtcagggactcacttgaggaggcagtctgccccttctcagatctccagctgcatgctgggagaaccactgctctcttcaaagctgtcagacagggacatttaagtctgcagaggttactgctgtctttttgtttgcctgtgcgctgcccccagaggtggagcctacagaggcaggcaggcctccatgagctgtggtgggctccacccagttcgagcttcccggctgctttgtttacctaagcaatcctgggcagtggcgggcacccctcccccagcctcgctgccgccttgcagtttgatctcagactgctgtgctagcaatcagcgagactccgtgggcgtaggaccctctgagccaggtgcgggatataatctcgtggtgcgccgttttttaagcccgtcggaaaagcgcagtattcgggtgggagtgacccaattttccaggtgccgtctgtcacccctttctttgactaggaaagggaactccctgaccccttgcgcttcccgagtgaggcaacgcctcgccttgcttcggctggcgcacggtgcactgcacccactgacctgtgcccactgtctggcactccctagtgagatgaacccggtacctcagatggaaatgcagaaatcacccgtcttctgcgtcgctcacactgggagctgtagactggagatgttcctattcggccatcttggctcctcggtcgtgaatgtgatcttatctggaatagagtttacagatataatcaagttaaggtggaccctaatccaatatgactgcatcctaatccaatatgactggtgtccttatatgaaaaggcaaaaagacacagacaccaagaaaactccataagaataccaatacagaggaaagacagccatgcaaagacagaggcagagattatagttatgctcccacaagccaagaaatgtctagagctatcagaaactggaagagttgaggaaggatcctctcctagagaattcagagggagtatggctctgccagcaacttatttcagacttttaatcttcagaactgtgaaagaataaatttctgttgttttaagccatccagtgtgtggtactttgttatagccaccctagaaaactaatatactaatctgtgctgttaaaagtcaagataaagattactcttgacaaagttgactagaataggacagaaagatagtttctaggggtgctgatatttctctgttgtgggtagtactgaactctatatatataatttccttattaagtcaagaactttcaccttttcacttaaaggaaactacagcttctctttggcacatccaaattgccagcattgctactcttgtgctttggggccattactaagtaaaacaagggttacttgaacacaagtactgtgataccatgaccgtcgatttgatcattgagacacctaccaagtgactaaggggtgggtagcatatacagcctggatatgctgggcaaaggaatgattcacatccaggacagagtgaagtgggacagcctgagattctatcatgctactcagaatgatgtacaatttaaaacttatgaaatatttatttctgaaaattttcatgtaatattttcggaccagagttgaccttgggtaactgaaactgtggaaagcaaaatcatggatgaagggggctactgtatgtaatcatccaaatcttaggaacttatgcacatccgtattgtacaattcaatttttatatgcaaatttatatatccctggataaagatacacaattatacctctaaacctaacatacatacactctttcttagtaactgacacaattaaggggcaatagattaccctactaaggctgtgacaccaaatttgggccttttcaaaacaatccaaatttcagttgttctaatcccttgtcaaatggtgttattaaatgatacaaactgatatttagttcagagaatataattgctaaatggctatttccaaatatgctttcaagttgaacaaatgtttcaattttgtatatcatcaaattataggactatatataaaaacaaaaacatgcaccttagggaatataaaataatgaaaaattcttttcatgctttctacaacttatattagtccgttttcatgctgctgataaagacataactgagactgggtaatttataaagaaaatgaggttcgatgggctcacagttccacgtggctggggaggcctcacaatcatggcagaaagtgaaaggcacgtcttacatggtggcagacaagagagaatgagagccagccgaaaggagagaccccttataaaatcatcaaatcttgtgagacttattcactaccacaagaacagtatgggggaaactgcccccatgattcaattatctcccccaggtctctcccacaacatgtggaaattatgggagctgcaaatcaagatgagatttgggtgaggacacagccaaaccatatcaaactttttgaaaacattcttttagctgcagtttctcacatatggttatagttccaagagataaaattcttgtataatttgaggaagaacatttttgttatttttaatatatggcaatgtgagacatatttttaagttgtaaaaacaaaaattaaaaaattttcaggcctgctctcagtatatgaagattaggcatttaaacttcttatcctttaaatgcattctaaataagaattacaggctttgcttaatttgaagaaaatctatttgacattaatacatttatcttcatttgcagtattattctgaatatgaatgtcttggagctaggtacagtggctcacacctgtaatctcaacaatttgggaggccgaaggcaggcagatcacctgaggtcaggaattccagactagcctggccaatgtggtgaaaccccatctctactaaaaatacaaaaattagctgggcatggtggcaggcacctgtaatcccatgtaatacgagctactcgggaggctgaggcaggtgaatcacttgagccttgggcggaggttgcagtgagttgagattgcaccactgcactccagcctgggcaacaaaggcaaaactctatctcaaaaaaaaaataataataatataataataataataattaatgtagttgaatgaatacaaggataaagccagtcctcaggcacattgtgtgtacatttaaatactagttaaaaggcagtctacttttctttatattctttggtgtgtatgtgcattaagttgcaaaatcaaggactccagttcagtgtattccttttctgcataaataaataacaaaatgatagtaaaatatttgacagaaaaatgaaaaggagactctctcatcattaaaaaaagtaaaaccatgaattgcataaatctatgattagcataaatggagaactgcaaaagtgaaagtaatactaaaaaaatactccagtagcttctgcacagaccaaattatttgaatttataattagaaagttatgctaagtgtgacagagattcttgctattttttatttattgtctggacttctttttttaaagaagtgacccttgccccgccacctgttaatgactctgttaaagtaattttaagtattttctttcaatacatttctatttgatattattaataaatttactttaaatgcttggaactagagactttataacatgtaaattaatacaatatgtggcaaaactatgaaaatatttgcacctcagattatgacagtgatggaatatggaatctgctatctttagagtatacttaagagtgcagcttaggctgggcacagtgactcacacctgtagtctcagcactttgggaggccgaagtgggtggattgcttgaacttacaggttcgagaccagcctgggcaacatggctggtctttacaaaccctgtctctacaaaaaatacaaaaattagctgggtgtggtggtgcatgcctgtagtcccagctactgagggggctgagttgggaggatcacttgagcctgggaggctgaagtttcagtgagccgtgatggtgccactgcactcctgcctaggtgatagagccagactttttctcagaagagtacagcttagattattttttttctgagaaccttatctttctaattaccaatatctgtaagcttatatttgctaataagataaattcagacaattctcaggaggtagggagggcggcagggtaaagggagcacttttattttcaaagtaccattcgtaacaaaaatacagcaaaaagatttcgtcaggtagtatccatgtgctagtgttctataaacaaacaaacaaaacttgcatacagtcctcattcctgacaagacttgccaactttgccttgaaatttttgggagccctcggaatctctctaattagagtcccagatcctagttgctgccactgggagcaaatgtgcttagtcattgtgcaccaccttgtggcagcgtttagacatgcatcttttttagaagttctttagtatttaagacccaaaggcaactctttattcttcattttaaaacagcaacttgcaaagcttttcttccaagtcttcccacctcaaaacaaaggttccttctctaaataacttaaatgaatcctctgggagagctaaagcaactggtacaactagagagagaattgttgatagatcagtctctggaattagactaccttgaattagaatctcaaatttgctacttactaacagcatagtcttgagcatcttacttaacctctgtaagaattaattttctcataggtgaaatggagatataataggaaccttataggcagacaaccaagggtgatgagacattttaggaaaatgtagaatgtgtgaaagtccaaaataaggaaatagaaaatggatgaaagagcaacaggataattcaggaatgtaataaaacctaatataaaactttagtaacgtccgagaaattaaagattaaattgcaaccacaaaactgaataggatgccattttaaaataaaaagaaccagagcaagcacagagaagcaaaaattatgtttggaaggaaaaccggaggtctcgaacataaagtcaataccttctcaatgaaagcaaaaagtcaaggagacagaaaatataagagaaaaggggggcaatttaagaacccagtatctaacttataagtgttcaagaaagaacaaacaaatcagaagaaataatttgagaaacgttttcagaactgaagtgagacagaaatcttcacattaaaaagtcttacttaatgctagttaggatgaatgaaaggtctacaaataaagctaattgcaatatttcagaacattgtggataaagacaaaattgtaaatgcttacgaggcacaaaaatttaaaaatgtaatagtcttttagtgagcaatgttggatgctaaaagtcaattgatttaaaattccagggggaagccaggcacagtggtttgtgcctgtaatctcagctacttggaagaatgagaaggcaggagtgcgtgcgcccaagagttcgaggctgcggtgagctgtggtctcacacctgcactccagcctgggtgacagagcgagaccctgtctccaaaactgtaataataaaaaataaaattccaagggaaaaatgattttcaaccttatgttctatgcccagccaaactactaagtatgaaagtaatataaagatgccttaatacattcaaagattcagaaaattttattcttatacatcctttcttaggcagttgctcaaaattgagcaccagtaaaacaagaaagaaaaagcccaagaatccatttgtagtagattcagcccaggaacttaatgaaaggaagttcaaaggtgacagttacaggacaggtctagattgcattaggaggcagatagagggttcaaggaaggaggcattgatgaggggggaataaatgggtgaggtattcccatgtatttgcttttacccttcaactattgagtgaacttaaagaaacaagatggatattgctagacaaaaaggaaggctgcaaaacttcaggggaagcaatatgctgctcaagaaagaaaaccactccacttgattctgcattaaaaatatttttaccttctgtatatctctcaaatcagtctattctctgtaactctactaccaccaccactctggagttaccatgatttctgcttagacttgtactggttttcttgcatcctttctgtcttatctcaaatctgttctccatattacactctatatggtgacgtttttcacaatgcagatctgattgtgccccctcttcggttaaaacatttcagtggcttcccatagctcttagaatctaaatcattagcatcccctagaaggttctatatggtcacatggtcaaccagtccctaagcagcaatgtagtggtagctgctatgtggtcttgcctcacttctgtagatttggctggtaaggacaccctaatggatttaaacagtttattacttacacagatggcaaagcaagatcagcatggtattagctgcttacatccccaattccacaggatgataccaaactaggggggtcagatgacagacaacatgagtggtgggttgctttgtttttgagaagtgaactctaggcttcagctaagcagttttatctgaaaggggcaaaatggaaagttccataccttagtggaatcagggaggcagatgagaaactgccgcatggcaagtcttctgcaagatcgagggtcttctgcaaggtatggagcaaatgtgaaatggcctttgatagctcctcacaagactacctatcttgccatttttaaggatgatcatggggcattctgccaacagttgagtcttacctacatggcctatatggagatatgcaattgccatggtgccatggtggaactgttcccctacaaacataggctgcctttactaccactatagtctcatcttacatactttctcatatttgctagcatcagtcatattgacctttcagtttccccaatgtgccatgcttttccttgtcatagagctttagcatatgctatcccctctgcctgaactctaatttctcctccttctttgccttcttaacttcccttctttcttcagtgctcagcccaacgttcctgaccagaacagcttcacctgttaccacatagcatgatgtaccactccttcacagcattcagaacaattttagtttaaaatttatttgtttaatcttggattgatgtaatagtagagatagcggatataatatatacattaatatatttgtttatcacttaattgtcaattgtttttacatacttaaattacattttatttttacgtctctgtgaggtaaacagaacagatattaaatcttttttcccaaataagagcctatattagagctcattttttttctattttagtgttccctgtacttcaccactatgttttttctgtaaatacattcaatataaggcagcatacagtaagcaagaggcacagagaaaatgccacaggggcccaaaggagagggaaatcagatcaggtgatcaccatagacctccaacccagaggtgccatttgagtcagacttgaaggttggtaggcatctgttgggcaaggaaatgagggtcttctaagacaagagatagtatcaaagctacagttataaaaaggcatggaactatttgaagaatggcaattgaatgtgttttgatggatgtagggctaatatgggtcccaggaagggaagctggaattggatcatgcaggaccttgaagatggaattgattttgctggcagtaggaagtaactcatgtttctaagtgggcaaattggtctgatcagcattggactttaaaagtattaaataagcaacaatgtgtagaataaattgtatcatggaggactggattcaaagaaaccagttctgatctaagtgagaggtaacaggaccatgacttgggacaaaacacctgaaacaataagtcgtgacacactttacaaagtttaaagtcaaagcctttcagtcagtgcctaataggaacacacttgggtctgaggaacgttaggtttatttaacatactgcagcaaaggagagcaccatagccacagaactgtgggtcatctcaaggagccaggaggattttcttataggatttcagaatcttattataggatttcagaatcttattataggatttcagcttgtgctgggtgactcttaggaaggtttagggaaagcagagatcagttctagattggatgctctcaggaagtaagatgttggatattttggtacattttttttttggaagtgagaggatttaaaaaatagtagtcatctgtgttagccagaagagggggatgtttcattattttttatgtttcttgagagttcttttctctagtttcagaaacatttacatggtagtcttatctctgtcttcttctactatggtcacagagtggccttatctgggtatttatattctcaaaattgtttgctcaattgggaatactgtggttagctgtcagcttccagccgcccaggtgttttctttttaccttatcagtacccaatacattgatctgttcagctctaaggaccagccgttgcctcatatgttgagcagcctcatccatttaccctaggctgcaatatgtatattatcactgtctagacgtgccatgacttggaaagcttgactgaacaatggtaccgaaaatgaagagtaaagtaccaagaaatgttgtaaagttttcaagctctccactatctccaacatttctggttcacttaaaatctatgctgcagcaaaaataagctgatttcagctcttacaatcggtgatttgctgcttttgggtatttgccctccacctggaatatcttccctttgtctcattctcatgttcgtatttccatctgtccttcaaggaccagttcaaacatctctctccttccccgtgctactagtgagagctaagatcaagaaaaagctgatttaaaatataataaattaagagtaaatcatatatttagatatattaattctaacttagaggagtcaggatggaaacaatctctctttcctgtaaattcatatagctaatttcttagatccctaaagcatttatttctaatatgtattaaatatgtattacatcttgtttactaacttctgtcagcagtaccatcaaaatgccataatgtttacttctttacaggtttttcaggcttgagtacaaagcaacagaagtgtttttaaactccaccctcattcttacctcatttagtaaaaaagttactgatatgtggccatatttggccctattttatatatatataatataatgtatataaagtatatataaaatataatatataaagtatatatattatatattagtgtatatattatatataagcatatataatatataagtatatattatatatataaagtatatataatatatattagtatatattatatataaagtatatatattatatattagtatatattatatataaagtatatacattatatatattagtatatattatatataaagtatatatattatatatattagtatatattatataaagtatatataatatatattagtatatattatatatagtgtatatattatatatattagtatatattatatatagtatatattatatatattagtatatagtatatatataaagtatatatattatatataaagtatatatattatacatatttaaagtatatatattatatatatataaagtatacacacacacacacacacacacccaccagggagattatacacacacaccagggaggttgagagaagcttgtaggtggctagatgtttcttgttgggagtaatagtggggcagggagtaacttatcaaaaatatgttttaaaaattaccaggcatggtggtaagtgcctgtagtcccagctacttggaaggctgaaacaggaggatctcttgagcccaggagattgaggctgtaatactaattatcatgcctgtgaatagccatagcactccagcctaggcaagatagcaagaccctatctctttattaaaaaaaaaattacgtggattacaaaacacttgagaaagtataaaaatcaatatttttgtattgtctgaaaggaaggaaactggataaaaattaattatattaaattaacaataataaatgtagtgacaaatggatttgtttttcttatattaatttaggaacgactgccagcaaaaaacctgggaaccgagaatgcaatcatctttgtaaaagtaaacatacatgtggacatgactgctgtgagttccttaaaacaagtttatttaaagtgttcaaaattgaaaggtctttggtggatagtaatgacatcctaattatgtatgatatttatattatgcaacttaataatgcaaataattttctctctgtgggcaacatgaaaaaagtaaatactagatttgaaattttaaagaaatttgactttataagaataagatctgaagtttaacctaaagaatctgaagtttcttttcataggtaaaattggagttgcacagaagtcagaaattaaagagtcaacaatttcttcatatttatctgatttaagaaacaggaatgctgtttcatctgttcctccagttaaacgtctgaaggttagttttaataacatttttcccattgttctgtagttaaacgtatataaatattctttgttctgtctgtcaattaggtatccacagtgtactatagaattacttgtgggcttgactaagaatattaccattattcataatccatcttcccttctttcttctttccttttttcttctaaatctttcttctttccttccatcttctttgagcaccaagaatatgccaaagtgctaagatacagtgacgattaagacagtcttattcccaatcatagaatttgtagtagagtgagagatacaagtaagtaaacatgcttttttaatatagtgtgatgagtgattctgtgacagaagtacaacacagttaagtttagacagaaaaggtactcaatccacatttgatggaccaagaaaggattcctaatagatgtgattgggacctgaaggataagccaaggatggaggggcaggcaccagaatgatcgtaggaagggatagctaaatattccaagcatagagattatacaaaggtccagaggtataaagaaagagagagagagagggatctttaaagaaactctttctcagtaatacagtacgtctagagtttgattacaagtaaaggagtagagagagatgaggctgaagaggcaagtaggagctagatcatgcagacctttttgctattttaagggattagactttatcatgaaagtactgagaagccaatgaaagattttaaccagtgacatgatcaaaattgtattttgtaaaagtcactctgactgcaatgtagaaaagggattagaggatgatagaataggaacaaagggactcattaggtggtttttacaataatctaagcaaaataatggcctagtttagggtagtggcaatagcaatggagggaagtgactgggttaaaatatttttcagaggtagaatcgctaccttgctacttcattggttataagagacaaaatagaaggaacagtcaaaaatgatgcccaggtttctggcattagcaactgggagaaaagtggggtctcattcaggtagatattctgaaggaaaagcaagtttgctgaaatagagaacaggataagttcaacttgggaaacactgaatttagagggcctgcaagatgtctagctaaggatgtcctacagacagctggatataactgtttgaaaatcaggagacagagctgagcgagaagtagaaatttgagagtcattcacatgtagatgacaattgaagccacaggaataaatgagatctttgattgagaaggtgtagtgtaagaagagacctagtaaagaaccatgaagaatgccaacatttaggccagatgtggtggctcacgcctgtaatcccagcactttgggaggccgaggcgggtggatcacaaggtcaggagttcgagaccagcctggccaacatagtgaaacccctgtctctactaaaaatacaaaaattagccaggcatggtggtgggcacctgtaatcccagctagtcaggaggctgaggcagagaattgcttaaacctgggaggcagaggttgcagtgagctgagattataccactgcactccagcctgggtgaaagaacaaaactccatctcaaaaaaaaaaaaaaaaatgccaacatttaagaagggcctgagtgaaatattcgagtcaagaactaacctgagtttctcctaattcattgatttggggactttatgtaccagcaggaattttgttgtttggctcatgtgttacaagttattgatgtgaaactgatagttgaacttatttttgtttcattaatagatacagatgaataaatctcaaagtgtggaccttaaagagtttggttttactccaaaaccttcccttcctagtatatcaaggtacaaatataatgttaatatctaaggtaaaatatttatcgtaaactctgttcctgcaggtaaccacttattcagggaaagatagtcactggctaccatcaagtcacagttatcgtttagttccatagtgaagcaataacatcataatggtttcattatctttgataccctaaatttatttagaactctgcagttatgaaataacattcattagatcatctcttccctaggaaactacctatcctctgtcattcccttaggttctctctttatagggaatataaactaagtgacaagagtatactttaaaatggaaatcatgttggtgtacagtctaacctttccatttagaagctcagtccatattaataatatctcagatttataatacgaaaattacacatttgtgcattatattttctgacttaaacaacaacatggcccataaaatgaggtattttttcgtcccattgtatagatggaaaaactgaagttcatattcctagttagcaagcagaaggccttaggtggtaactcattgttcttttcctgtatcctgatgcctacaggacaatcatatatgtaatttccctgctagataagggcattctatatgcaggaatgacattcaatgtatttaacaactagtacagaacaggaactgactcatcagaatagatgccagcagtacttctagagatcctggcttttgttatctaactaagggcatgtaaaggaaagtattggtcacttccatgaaacacctatttatttgctacccagcctgggtccagtgtatcatagaagtgttaaatggataaatcattatttttgtttatatgaataaatagttttcaggcttagattaatttccatattttctttaacattttcatggttttatctttataaaggtcagaatatttaaacatatctgaattgcctataatggagcagtgggatcagcctgaaatctatggaaaagttagacaagaaccatctgaatatcaagacaaaggtaaattaccattgatacttacttgagagagtaaatggcttattattactttgaattgacgagtagtgttattgaaacaccggcatctgaaattgttatgattattaacttggcaacatttttctcttagattactgaatcattttcaaattcttgggtctgttattgagatggtcttactctgtttgttgtactttttaaaaaaaaatctctttcctacataatgctattttaatttaaagatactatgaggaaaacctgagcaaataagggatccttgggtatatagagtattaacatactgaatgattacattcatatatcattagaattatttaaaataattttatgtttataaaactagtccagttttacaaaatatcaatgtgaccttgggcaagttatttaatctctttgggctttagtcttatctttaagatgaaggtattgaactgggtgacctttaatatctctccaattcttaaacctatgattcttacaattctatgttagtatgagaaaataacttaggttgtgggatatagctagtttgtaatctagatttgcttttttatctgtgtccgtcattaaattaatgagataatgcatataaattcaacactgcctggttcatcattactctggttcctgcaattaatagagcataatttccctgaataatgctattaatagccagtctgttaaaacatgagacaatcctatccattgagttatttcttcaagtggctgtatgtagaaatggtaagcttggggttttctgaaaatcatttcatgtgtttggcattggcttctgttgacattcttttcttcatgctgtcatttttttttcttcatgttgtaacttttttttcctctagtcataatttaagattttacagagtcaagggctggagtattcactacctcttgtgataccatggcagctattaggcccaataatgagatcaagaaaagttccctaatctcacctggagaaccagagcatttatccaacttattcaaagcctggatgtcattacaaagcggataggaagtataaaattgtcaaccttcttatatttatctttgttcaacatgtagccctctaacttactccttccttatattactacattattacctgtccttctgcatacaagagcttgtctatccttccctctgcttacttttgtgttatatttacatggttttcctacttttctttcccactcactattccaaatccaatttatattatgatattaaagtctcatctagatactttaacccccaataataactctatccctgttttactgagtgggccattttttttttaagaagttgctgcatggtatagtagttaagttcgcaggatctgaaaaccatctgtccaagtcctagctctgatatttagtataacctttcataatctacttaaccactttgtctaagttgctcatctggttatattttaggggttttaggattaaatgagataatgcatgtaaagctgttagggtttctggtactgttagtaataactaattatgtttattatatttttcacatattagtctttggtggcaaaacatactttaaatgtattcaaatactgcttttgagaatgttttttaaaaagcatggcagtttttatcttctgtattccaatttcaaaaagggaagaagaaaaaatgtcacaaattatatgagaaagcatgttgaatcataagatttaaattggaagggacctttatgcaatttctcattttatagtgaaagaagccaagactccaagagattaaatgacttgcccaaaaatttcatatctaattaatggcaaggccagaaaaagattccatatcttttgattcccagcccaatgccatttctataaaatgaaattgacttttagtgatcagtggagaactgaaaattgaaccagtagtatatgaactctttcagctttttgccccacccctcaactatatatttccctgtctctgcatccatctgtaaccatctatttgtcttaaaagaaaacttatcttttcttccactcgaggcatatctctcctcctgtaatcttaattctatccaatcctgctttccctgggactttagaagatcattatccatctcctctttcccatattttcattgtttcctctccactgtgtctttccctttagcatataaatatgctgaagtctcttccttcttcagcttctggtcatgacttttttattataaatgataaaaattctactcaaaatgacttaagcacaagaaaaggaaccaattgtctcaagtaaactgaaaagtatctggcttaattctggctaaatcaaggcactcatgcctctggctttctctcaatcttttagctatgcctgttgctacttggctttactttttaatagggtttctcacacagcaggtagcccctaacttacatcttaccagtttagcgcctcagtggaaaaaggtagacttccctgttagttttggcagaccagagctcattctaactggcctcatttgagtcatgtgtttatcccttgatcaatcccagtaacctgacgattgggtcgttgtatacctgtggccccagagaaggcagggcaccatgaataacggccttactaggatccagtagaattgtagaagcagtttcctcaaaggaaagggagggtactcccactaaaagaagggaaagcataccaggcagacaaaaaacagaattctagagtccccataccctctatctcttgctttctcatcaaaacaaaaattaattgaaagagcaattgacactcagtatgctcatcgcttccttataccctagttactctttattcattaaaatttaggttttctgtgtatcagtcctttgaagctgtttttgttcaggccatttagtgactttctaagttctgaattcagtgaactgttttcaactgttaatctctttgacctctatagtatttgatactactggtctttcctttcttttggaaatctctcctttgatttcagtaaaaccattatgttggtctcctgttacttcttagactgcatgggcttttcttcctgttgatgttgcaaaaggattcttttttcttttttttttttttattcttctcacttcaaaaacttttcctatacagtatcacccaagcccgtgtctttaatcactgactatgttttgataatttctaaagctgtatctcccatctagacctttctttctaactccaaatccatctgtataatcaccttcctggacatatccacctaacagttaacatatcagacatgtcagcatctgaactctgtcttcttcttacctcactctacaccttttctttttgccttagctcaatgaatgaactctttactttgttaagctgctaaagtgtccttctaaatagctcaccccacatgtaaataatcaccaaatcttaattattttgcctcctgcacatctctcatatttgttatttccactctatcctttctgctgatactctagcttaagcattcattctctcttgtttactgcaataacttacttttctctctgctttcagtctcattatccttcaatccataatattcaaagtgatctgacagacatatctggttgtgtaaaccttctgctgaaacatcttcaatagttatcctttacctataagaaaaacaaaaaacaaaaaaatctccttaatatggcaaataagcttcaacgtgatctagcacttaactacctgtgcagacacaatggaccctgccttctccaactttgtgctccagaaatcctgaaaacttacagttctccccaaattctctgttctctcatattgctgtgtcttttacatggtgttctcccttcatagcataggttccctttgctcttgccctgcttcacaactacagctctatcaagctgaaattccgactactcttccttcatatgttatcacctcaggagtctgtctgtcatgtggtatcaccttagaagagtatgtcttacttccattgcaggtttagatcctccttcctctgcattcccattgcactctgtacaaacttccatttttagtacatatatacattgtgtgtctcagtgtgtgcacatcaacatacaaaagtagagtaatgtgaactgtagttataggtacagttgaagaataaggaagggtttggacaggtgaagaaattcatagaagatatttaaagtggaggaaactcagtgatatgctggagcaagtttatactaacttatgagagatgattattaaattttcaagaatctttcagccattattgaaaatttaattacataaactttcaattaaattatgttaaaaacaaaggcaaaaatactcaaaactcatcacttcctaattgttctactgcattttactcttatctgtgttctcgagattatttatccatatggtagaaatactatattatagggttctgtcgtgcattttttcccaacttcttattcaattatgtcacattaatagcttgaaatcagttatggtgggaacatttataccataggaatcagcaaatactaccaatctgggtttgatttattgttttgcttattttttagacttaagaaagtgaaggataaaattttaatattgtagattaaacaaatgtgtgttgttattgtagccattacattgtgaataacacaaaaaattgagagaatattcttctagtatttgaaaattactatctaattcaggaaagaagttgcttaagtcaatggtgaatgagtgaaatcccaacagatgtctttgttgttttattaatattttcatcttacttgttagagtcaacaaaaatatcaaacaacattcacatgagagctacattcgtcacttgcagccataggttgactacagataaaacagtggcaaaacttaatgaaaacattcaatgagaatcaattagatatatggaatttacatttaagtataccatatatgttgttatttgtaaaacgtgtgctgtatagcctttacatcagcaaagattataataaacttatatgtgtatacataagcatacgctttttgtagaggtagctattaaacatttattagcacaatactgtgtaaaactgtacaactaaaggcatttagcgcctcataacaatcttttgaggtaggtactgttgttgccttattttgcagaatcaggaagtttgaattactgtctaagaccatacaactaataaatgagagaagtggaattttcacttatgtaatttggctctaaatccaggctgtaaacaatgaataacactgaggattttttagcaggagaaaaataaatattatttattttggacaaataccttttataacaatactgaaaattaactttagggagaagatctggaggaggaagaccattttagaaactattataatccaatcttggagtagagttattctaatatgggaattaagaggaaaaattaattgcctaaaaaatgtattgaaaattaaatttagtgcaactttatacagttaatagaattggctgaatacagtattcaacaatgcttgacacaatgcctttgaaaactattactcaagaactctgtttagtagttgaaagatgtgtttgatatatcaatagactacgatgcttgtggtttaaaaagtacctatagtcttttatacatacacataacagatttttctagatgtaactgttctacaacttcaaatgagaaagtctctcaaacagtgttcttcaacagaaatcttaatatatctggaaaccaacatttgacagatgcagataaaagcaattctctattttcagaagttttgaatgtgaactttgaattgggaaatgaagtttgggatgattttgatgatgaaaacttagaagttactagcttttcaactgatactgagaagacaaaaatatcaggtaaaatcatacttagcatgcaatcatttcattaggaattctttgaatatttttcatttcagctcctggaactaagtttctttgcctttgttgtgtgtgcttgtttagttagatttggtttgttaagattataatttttagcaaaactgaaaatgtgactcttctacaaagaacatttcccccctaagaacagagatcaaggttattccatgatgataatgtagcaaatgagcactttctattctattgctcctatctcttgtaaaagtcaaattcaaattgtttattcaattttctctcatgaaacagactattttgttctccattctaagatcacaaatggtctgctaatatttgtgaagaacaaaaaaatacatttttaaaactattcatctgcttgcaaagaaaataacttttatttctagttgaaatatggactttcagcttgaagtaaataaataagttaatacataaataagtaaataagaaagaaagattagtttctcctgtactagaaattctatttaaatcatatacaaccccaaaataatgaggcttattagctctttgagtgaaaggcaaatttactctatttcactaaaacagagaattgaaaaccttggccagtatgtgacaagatagcaatggagatactgtctcccattagggctgacagaaataaatcagtccctcagccttctcagtgcagactggtatttccacaattatagataccacttaccataccccacctcatgtttttaaaagagtatttcaaagggaagcagttagaagttgaaatgttattgttttgggggcccttagaattacctagagaactaatactgcttctgaaaagaacaggatttgaccaccttcacagaataggccaggagaatctccatgatgtggggtcattaggcacaattttgtttatcaccagacaactactgttccctacctcaaacttaagtgtcattgggtactgcaagttaataggcaatgtgtactgatcctttgaggtagcctagtcctaagacggcacagctttgtcactgggaaaatcagtctcaataagtgccattttcccccatgtatagagcactttaaatgattatgagcagaccactgaaaatattgagtgaacttcaacttgatcatttatgtgaatgaaaatgtaagtacataaataacgagagtgagtgcaaaaacacaaactgtttttcctcactctcacaccatgatcagcccagaagacatctatgaccaaatgggtgtgggttttttcccacacgccaagcaagcaatcagttccacagtgaataccagctgggtgtcttccaacccagtagagttagaaacaggagtcaaagaccaaatacgtattttaccacaacacaggtggcttgaagaccttttaatatagttactaataagctaatctatatgttttagagttttactcccttagccttgtgcccctaatttttctatgcaaattaaattaggttactgagaattattcattccttccttaatcagatcatatctgttggagagaacgttgtagaacttgtgaaaagcttcattcagctgtttcttggcattttgtttcaaaatgttatctcttcacataggatttggaaacactttgagttcaagtaccaggggaagtaagctaccccttcaagagtcaaagagcaaattccaaagagaaatgtcaaacaggcaagttttagaacttaggtttgtaatatttgcaactttatatccccttgacacatagttggagatggggatcaagttattagatgtcacagatgctaaaaggtattagccaacctaaaccctcttaatcttagaggtgtatttctcaaagtgctgttgtgaaaccacctgcatcaaaatcactttgaggtgcatattaaaaatgcacattcttaagccccacattagatctaccgaatttttgtctctgggactggagcccaggaaccttcacttttaacaagacttgaaaactgaataggagtttgacaactagaacagaggcagataggcattccaggtataagaaagcatctctaaagggataaggcttgaaaaggtatcccgtgctcaaagatcagtaaagtgtggtatgtgtggccacagcacaaagtctgttgctgaagtcttattgtaagggctttgagtgctgtgcttagacacctgtcctgtacccagtcgggtcgcaaacccaaataccttcaagatttggtgggccaaggccaactgtagagtgtcccatctaaagggagcagccactactcagctccaagcagttgttactgtgcaggcaatgtgagtctagtgttataaaatattctgacttttcaagaaaagctaggaatctgaaattttatgtgatatcttattatttttaaattttgacaactaattcaaaaaaatgtgatatactctgtggcaccctcctccaaataataataatatctgtaggccagatgtgtcctagggccctctagtttttacctgtatggtaggcagtgagaaaccatccaaaatatttaagcacagaaaaaacaatttgatttaaaaaatcatcctagcagcagtatgcagagtgaatcgtagggagtgggactgccagaggcatggtggccaatgagaaagacagactataatgaggcctaaactacagcagaagtgatgggaacagagaggtagggttggatttttaaaacatttcagaaatagagcagattcagtgtggcaattgataggatatgatagttgaggaagagggaagaataaatggcacctaggtagatgttatttaaggatataggaaacataagagatttagaatggaaaacataattttataaatcttcaatttgaagtatctttacaaaaaatgcaaaatgcattgggaaatactggacttgattagaagtcaagggagagaaatgatggccaaagccaaaattttcaaaacagaagaaataccaacaactttttattcagggtctgattttctacttaaggattatttatttctctgctttaaaaaaatactcgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgcagtgagccgagattgcgccactgcacttccacctgggccacagagcgagactccgtctcaaaaaaaaaaaaaaaaaaaaaaaaaaaaatactaaatttgtggtatcccttggaatttttgctgttatttggccattactgattattagtatcagcatcacagactcatagttttaatagaattccagagctaggggcgactttggtattgtttagtctccctctcactggatctttgaatcatcattcaacatcactggcaagtaatcatgccacctctaccaagacagttccagtgaccaggagctcattcacccttgttccatgttaggatttcttaaatcactgaatagctttttaaaacatttgcttaaaatgagtctttttatcactttgtttctttggttgtaactcttgagtgacatagaataaacggatataaccatccaagtgagacaaagctgtaggtgtagagaagcaaaaagtaggtaaatcataaggaggaaggtaacaaggcatatgaacagttttgtgcaccacacctttaaaaaacaacaaatacttttggaagagtttagaagggaccaacagaagatgtgtgggcttaaaaatggattctaacaagaagcctctgagaacctggtgtagaagttgctgctggggaaaaggcctgtgggacctgaggatttggggtggaaaggagatttgcttttttacttatttaaggtagagtacagtggcataattagggcttactgcagcctcaagctcttgggctaaagagatcctcccacctcggcctcccaagtagctgggactacaggtacatacacaccactatgcctgggtaattaaaaaaaattttttttttctagagatgggggtcttgctatgttgactaagctggcctcaaactcctggactcaagctgtcctcccacctcaacctcccaaaatgctgggattataggtgtgagccactgtgcctggcctgctttttcttttatacactttttactattttaattccttgccatgtatatatatttattagtcagagacaaaacgatccaattctatcagtatatgtgattcttccctgtctccacccacactgcccattgctccttacatggctgttacattttagccttcaggtgtcaacttaaatggttacctcatcagagatgcattgatgatcatcttttaaaaatgggcttatggctccacactattatttcttatgctattacccagttcattttctttttataatttcaggatttataattatttatatatttgtttttattcattgtctgcttgatggtaactccctgacgttttctttatcacttcatacacagcttctagtacaatatctggcatataatagtgaataataaatgtgttttagtgaatgagttaatacagaaggttcagagtaaattcttctatacagttatatctaataagataactagagatgtctaactacaatgagaccagaatagagaaaggagattaaaagttaagcaagtggaatttagaaaatgtttatagggttctatgtaatagacaattaagcataagactcaattttaaagaaaattgttgaataattatttctatagtcccttaaaaatagtactttttcctaatttgggatatgtaaattatggtttggtctaaaggaaaggaaatataccaagctctccatgaatattagaaacaatgcattacatttttgtgataaatgtgataaactttgatcatattccccaaaaatcattatgatccaaattaaaatggtttttcttgtttgccgtattttacaaataattaattttaatttttagttttgtttcatcacatgagatgtcggatatttctttatcaaattctgctatgcccaagttcagtgcatcctccatgacaaaattacctcaacaagccggaaatgcagttattgtaagaagaagcacttctttgtttttcttttaaattttgcccgagtgcttaaactttcaatgattgttattttttatctcaaatgtaggtccattttcaagaaagaaaaccacaaaatctgtcaccagagattgagaagcaatgctttactttctctgaaaaaaacccaaattcttcaaattataaaaaagtggatttttttattagaaacagtgaatgtaaaaaggaagttgatttcaggtaagaactctttaaagacactttaagattatatcaataaaaaacttttcacaaagaaattcagccttccgttttccttttcattttaaagatcacagcctgaacatttcatttattaaagacattaaaattttcaaacctcagtgagctaagctctttaagatgtttcaaacatcatatacctcagtttttgaaaacccgtatgtttgatgctgtttattcaaacattatattgagttgataaacttacttttactgatttgaatacagtatgttaattttgtaaagggtaaagtcacttgagaaatccagatgagatcagctaatttttcaaaagttgaagttgtattttagttaaccagttatttcacaatcaacacgttcaatgaaaatgtcagattaaatctcatgggttcccccactgctggccattttagaaaaggaaactgtgttgcagtttctctctccttgaagagtcaaaagatttgagacctgttcacactgttttgcttttgtttaagactagtcaagtgaagcagtggggatgcagaagaaacagaaatctgtaactggttgtgatcaattagttgtaaacaacacttcccttggaccaggccattcacacctttattaaatgacataacttttcaatatatttaaagaaataacctttacagttcctaccatttgcattttatgaagtctaattttccccaacagacttcctacaaagttatgcatactgaagtttatttgatacattaacttcatagcaatcttcaagtttattttattgtgtttagtattacattatttattgtgtattttaaaataaattgtgttaaaaaatagttatttttactttttcttctttctcccagtatgtatcatcctgatgatgaagctgatgaaatgaagtctttattgggaatatttgatggtattttctaaaacaaacaaatactttttatattgataagagaaagaataaagacacctaatcacaaagcatgctttttatttttaaaaagtagttcataattgttcggatttttttctcctgtatttgattagctttgttcactttttgcaacaaaatgtatgggccgatttattttcccattatattgtaacttcttgaaaagctcttttacagtggctttgtttcaataagcccttaagttaagggctgattgcacttagaaataagttgcacttagaaataattatttggctattaattggattttgacaagaaccaatgtaaaatttcatttttatattttcttaacaagaagaaaaatattctatgaaagcaaagtaatgctaacttaatgaatctgcttattgtatggattaatcactaatattattcccatgtattttgttttactaaagatttttaagaatccagtggctatttgaacctactgttatctaactttgagcaacaataaatgaaacattaatcagt
